United States Patent 10,889,864 (NON-CODING RNAS AND USES THEREOF) - sequence listing, part 2

SEQ ID NO: 1140 - DNA, 4397 bp, Homo sapiens
aactatcaacggagtgaagagacaacctacaggatgggagaaaatttttgcaaactacgcatctgacaaaggtctaatgtccagcatctataagagataaacaaacaaccccattaaaaagtgggcaaaggacatgaacagacacttctcaaaagaagatgtacatgcagccaacaaccatatgaaaaaaagctcaatatcactgatcattagagaaatgtaaatcaaaaccacaatgagataccatctcacaccagtcagaatcgctattattaagaagtcaaaaaataacaaatgctggtgatgttgcagagaaaatggaatgcttatacactgttggtgggagtgtaaattaattcaaccattgtggaaaacagtatgtcaattcctaaagagctaaaagcagaactactatttgacccagcaatcccattactgggtatatacctagaggaatataaagcattctaccataaagacacatgcacgtgaatgttcattgcagcactgttcaccatagtaaagacatggaatcaacctaaatgcccatcaatgacagactggataaagaaaatgtggtacatatacaccctggaatactacacagccataaaaaagaacaagatcatgtcttttgcaggaacatagatggagctggagactatcatccttagcaaactaatacaggaacagaaaaccaaatactgcatgttctcatttataagtgggagctaaatgataagaacttatgaacacaaagaaaagaacaacagacactgtggtctacttgagagggaaaggtgggaggagggagaggagcagaaaggtgaaatggatgaggtgagaaaggcccggaccacaccgagaatcgaatgcatggtaaacatagggccacggggaagtcttgacaccgctcggcaagatctctcaccgatggatccaccctctatgttttctgattggacacatttcctgagatgggaaggatcatgctattggctgaggctgcatcaggggagtaatatttactctggaaaatctgggagagggtgtcccagtctgtgaactacccagacccccacgttcacagaatactaggatgaggaggatcccaaggaacacctgcatcaactctcatgttctacaagggaagaagccaggtctcagggacattaaatcactttcccaaatgtaccaagctagttagagtgaagaaagatcctatttatcccagttcccagtgaaatgccatttctgctccataccttctcttctccatgtgtcctatgctctcgcactttttgtgctgcttagcgttttgcccagaggtgtgccagagattattgctcattctttctccttccacggtcacaacacctccctgggctggtgtcacctcttactttgcaattcaaaacgttgaagaaggtgcgacctgtctagattttcgtgtagccttctctcctgattgctgtttcagataacacattcagggtgttggtaaatagctgtgaatcagagcctcggggacagcctggtttggtgtgtggatagtctggctaatgtcatagcagtccctgccttaaatatcaatgtccgaggaaggtgggatgctgtttccaaaagattgatttgcacttctgctaatatatggctgagtgttctttaaaatggagtattctgcttgccctctgccaccttcacaacaccctaaatctttggaagaacgtgcttcttgttggacctacaagtggggagcatcttgccttgtccggcctgtcccagtttctcgggaacccttgaggtttctgtccctgttccacatacttagccccatctccaggcttcctgtccatcagcctgagagaccatactctaggagtcttaagtgctgagttccctagtgggaactcactggactgcaacgccccaagtccctccttctctctctgtgccttgggatgggctttgtgccagctgtgcccatcctgctgttctgcagcttggtgccccttcctaacgtgatgggcctctgctaaggtcatgttctttcaccaacccagggtccttccagctcctccaccaaaacagtgccctggttgtcctcacttgtcccatcttcagcagggaggcacttgattctgtggcatttggcactgctcactgggctttcttttcttttcactgtaagactcatgcattagatctgtcttgctatagtcctaacaatgtctctgtgtccccactcccattcaactcttgccattctccagccattgctcttgaagaatgtgggactaataaccctgggtagggtcacaaggccctgcagaggtgatgccatgaagttgcctacacagaactgcctccctgctaagagttccaggatcaaattcttctaggtgcctgcttgggtgggtcctcatccccacccctgcccagggcaccatctgtgggagattaggaggtaatcactgtctacccctcagacaccacgtgctgcatgactgtgtcctgaggcagccacatggctgccagctctgaaggtcctgagatccccattctgaggcccttcgctgactcactgctctcattcttctttctctgtccactctcagggcaactacatccacacggtgaaggcagggcctgtgtagtggatgccaggctgtcttcacgtacatttctctttctcttaagcatcctggaccataaagccctagtgtgctgctcctaccttgccagtaggactcctgtctcagctccgtctcctgaagactgaccctacaggagagatacaagcatctcctgttacctgtgcccagatggtccttaaaaaatcattttcctatttgataaacataaaaatgttatgtctgaccagccaacaggctctagacctgagccatctaggaagatgaggccccacccctaactggtgccctctttgcagattcactgatgcagattcttgtcagcagagataacttgtcaaattttactttcatcaagagaaatataattagagtgatgtacttttcatttctaaattatgaaattctattataatgtgaaatatgtattttcaaagtatacatacatttccttttagaaatgttgatatacctccctaggaactttccttccttttgttagaaaatcaatgctgtaaaatgttagggaacaaaagaaaggtatggaggaagatcaaccttgtgggacccaggaagaagcagggaagaagaatcccactatgaaactacctttccaggacaaataatgttctcagaaatgggcatgtactttgtctccaggcagatagcctgcccattacatttttgttttgttttgttttgttttgttttgtttgagacggagtctcactctgtcacctaggctggagtacagtggcacgatctcggctcactgcagcctccacctcctgggttcaagcgattctcctgcctcagcctcctgagtagctgggactacaggtgcctgccaccatgcccagctaattgttgtatatattttttagtagagatgtggtttcaccatgttggccaggctggtctcgaactcttgacttcaagtgatatgcctacctcgacctcccattacgttttaaatagcacagctctctgctacgttgtatatttcccaaataaaaagttttcagctcaatctctagaaaagctctgctttatcaactttctgtttctcatgccatgagttgactatgactctctcacgcacctgccaatcagttttatcacttgccattaggaggtccttgggaagcaatgggaaagctccccagtccagagaaactaacttcaggcatgtgtctgaactcagaggctccaaccaagagcagggaagggccttgtgggaggtgagtgcattttggatatggggagcaaggctggtgggattctgctaacgaaactgatcacaggtgacagggctctcctttgaacttgattatttttaaagttcacctctccctgatccataacgaggtctggtgagacttgtcatagtcccagaattatttcgatcattccagctcagccgaaacaatgagagaacatcaatatggcaactcctcagatgtctgggaagagggatcatcacccaggcctgggagctctgcgcagttttgtctgccttggctccaaagtgctctttgcccttaacactgcaccactgtacagattcacacagctggcactagctccacagtggctaaggttgtgctgcttaggactgacctggaggagaggggagaaaaagatggtattagtggctccctttcatgtcaacaggttcactgaaaaaggagcaaagggcttagtcatgttttaatgctctcaaagcttactatgtatccagga

SEQ ID NO: 1141 - DNA, 2859 bp, Homo sapiens
ccaaagtgctggaatgacaggcatgagccaccacacctggccaatcctagcactttgggaggccaaggcgggagcatggctggaagctgggagttcaagaccagcctgggcaacatagcaagatcccatctctcaatcactcaatcagctggatgtggtggtgcttgcttgtagttccagaaactcaggaggctgaagtgggaggatcctttgagtccaggagttcgaggctgcagtgagccatgattgtgccactgcactccagccagggccatacggcaagaccttgtctccaaaaaaaaaaaaaagaaaagaaaagaaaaagaaaaaagaaatgctggggagggagattgcagtactaaatcaggggagggggcagtgagaaagtgagatttgcacagtagcccaaaagaggaagttcagttaggggagctttgttgtattagtctgttttcctactgctggaaagaactgcccaagactgggtaatttataaaggaaagaggtttgcccgtgtacggtggttcacgcctgtaatcccagcattttgggaggccaaggtgggcagatcatgaggtcaggcgttcgagaccagcctggccaacgtggtgaaaccccgtctctactaaaaacacaaaaattagccaggcgtagtggagtgtgcctgtaatcccagctactcgggaggctgaggcaggagaattgcttgaacctgggaggcggaggttgcagtgagccaagatggcaccactgcactccagctgggtggcagagtaggactgagtctcaaaaaaaaaaaaacaaaaaaatacccaaaaaaacataagaggtttaatttactcacagttcaacatggctggggaggcctcaggaaatttacaattataacagaaggcaaaggggaagccagataccttcttcacaaggtggcaggaaggagaagagccgagagaaggcggaagaatcccttataaaaccatcagatctcgtgagaactcacttgctatcaggagaacagcatgggggaaccgcccccaggattcaatgacctccacctggtctctcccttgacacgtgaggattatggggattacaattccagatgagatttgggtggggacacaaagccaaaccatatcaactgtgactaccttgggtaagggccatccaggcagaggcagggggaacattctgggcaaaggccttggggcaggggcctggtatgttcagatagcagcaagtaggccagagtggccggaggggagcaagtgtggggaggccagtggagagatgagggtagggaagggatggatcagatcatgcagggccccgggggccacaggaaggacctcagcatttactgcaagtaaggtgggagccatcgaatgttctaagcagaggaggaatgcgctgtgactcaggtgttcacaggtgccctcttgctgctggggagagaactgagctttttactagaagtagttgagggaaatagtgtcctccctaccttccatataacagagctttccaaggtcaaggtggtggccatgggacccagtgggaggcagcccgaggcccggtgaggtttctgctgtgtcttgaagagcccttgactgatatctgcttagttgcaaatcaaaccccctttcccagaaacgcacttcactaatggaaataaaagcacaactatatttgggcacgacggatttaagtttttcttgttgagaagagtacatctttccaaactggacatcaaggaattgctacacagaagaaccacatccaggatagaaaggaccagccagagctcgttcagtagtgtatttcagaatcatcagggaggagccggtagcagaattatcccgttaacactgagaccacatttcacctgttacttatttttctaaatggagtaggagagaaagatgctaaaatgtgatcttgggaggagtcccccagtcccccgaaaaagaagaagaaaaaaaaaaagcagaactccaaacccctgtggtcatggcaatttcccatcaaaactgcccatgtaaaataaacacaagctgctaaaagtgaatgttaagaaggaaggcactggttagtgggtggtcctgaccaatcccctggagctggagaggggttttcccacggcctttggtttaatgtgtctgtaaactcaacaaacctccgtttccctgaggtaatctgcaaaaacatcagttttcagtccccagagaccatttccaattaaacctcaccccccaaatcattcaatgtaacatttgccttatttttagaagaaacaaatgttcccatattattcccagtttttgagagaatcctgaggcagctctctcggctgctacttgaagttgaattcttgaaaaatcttatgtaaacagaaagcttaggccaggtcaggagtaaaatgcagtcaaagctgtttctcatcacacaggtgattacaggttagctctgccctattcaagacaatctgatccattcctttttttgacagcagtttagagacaattggccaacaaaaccagcctggccaacaaggtgaaaccgtcgctactaaaaatgcaaaacttagatgggcgtggtggcagcaagttactcaatcctacctcctcaccccttccgcccaacccccagcatcccttagaagtgacccctagtttgaggctgtggtgagctatgattgcaccactgcactccagcctgggtgacagagccagaccatctcaaaaagaaaaaaaaaaaaaaagaagtgactcctccattagcaaaaattgtcacatcagaaagtcgccgacaactgcctgcggtggctgggaacgttgcttcatttccttttctagcagg

SEQ ID NO: 1142 - DNA, 2859 bp, Homo sapiens; identical to SEQ ID NO: 1141

SEQ ID NO: 1143 - DNA, 2859 bp, Homo sapiens; identical to SEQ ID NO: 1141

SEQ ID NO: 1144 - DNA, 2859 bp, Homo sapiens; identical to SEQ ID NO: 1141

SEQ ID NO: 1145 - DNA, 2859 bp, Homo sapiens; identical to SEQ ID NO: 1141

SEQ ID NO: 1146 - DNA, 2859 bp, Homo sapiens; identical to SEQ ID NO: 1141

SEQ ID NO: 1147 - DNA, 2859 bp, Homo sapiens; identical to SEQ ID NO: 1141

SEQ ID NO: 1148 - DNA, 16567 bp, Homo sapiens
aaaaaatctatagttaataatgatttgataacacccaacataactcacaatgattcggaaggggttcaatttttaaaaaataaacacaaaattatttttttgctttttaccattcactgttttaagcggcataacaaaaccacatgtaaataaaacattgcataaaggagggaagcagtcattttgtgatactttatcataataaaaagatccacaataaaacattctaaaattattcatgaaggccaggcgcagtggctcacgcctataatcctaccactttgggaggctgaggcaggcgaatcacttgaagtgaggagttcgagaccagcctggccaacatggtgaaaccttgtcgctactaaagattagctgcgcatggtgatgggtgcctgtaatcctagctactcgggaggctcaggcaggagaatcacttgaacccgggaggcagaggttgcagtgagccaaaatcaggccactgcactccagcctgggcaacagagcaagactctgtcctccactgccccaaaaaattattcatgcaagtattgtaaaaatcctcccattgtagaaaatgttattaataaaacgtcttacaggctactttaagagtacatcctgatttcttaagtttcctagtatttgtagaagatacaactctatacaaattataggcagaattatgatcttaaaaaatctagatacaaattaccttgttaagacaagaaattatatgactgaggtcaatccagggagcacctgcttctgtcacctgatgaaaaagatgatccctaaagagtttcaacagataacggtctccagtctctgaccaagtgggatccttctgaaacctgggggaaatgaacattttacctcagtaactcatgctgtatggtctgtggccatatgtctattttttagactccaaactagttttactttttcccaataaacaaaaaattgggagggagtctggtacagtgtttttaaaaaataatctaactgaactagtaagtctatgaattccagttttcagttagcaaatgtcagggggaaatcatcccttatgcattcctattttacattacctccttatttcagcccctaccattagataaaatggaaaaggtaaaaatatctttaaatatcttctcttctcttcctcccactctgtaggttacagaatagagaaaggtcaggtacatcttctacttcaccaataagcataaaatagaaaaatgtttaggaaacaaaaaggaagtaaatatcggtttcctaccattccatgtgaaaacaagctgtgaagaaccagatgaccactgtgagttttcagtgaccttaggaacttacagtctagtaggaaacagacgttattcaaataatcaaagaaagctgtaactgcatatttacataatgctcctaaaaggaatatgatataaaacgaagatgaatttatctagggccgcgcctggctgataatcccttttctgtatcatttaaagtcgttctgcttcccagatcaaactgtgatacaattcccattaagaaaaaataggtaaaaacaatgattacagaaaatgtataacattaaatttatgtaaaattatgtgtgaatataagtatataaagcaattaaggaaggttttccagaggaagtagtggctgctcttcccagaagaaggatgctccttcgtcagagatcggtatttgcatggacattgaagaaacttaaggaaggtcatgtgtctgaatgggttgggggagaaaagagaagaaaagacgacagaatacacggagagggagggtaagggcaaggaaaaggaacagagtgaagacaagaacaaagaatgggggatggggggaagaaaattaaataaaaggcagatttgacgccaggatgagaagtaggtagggatcagactacacagcttaggacatgttttaaaactgggtctttattctaagaaccagaggagaagttcaccatatggttttagcacaatcatatatgtatgtttgcaaaggtcactccaaggacttccaattaaaatgaagattaaacacccatttatctctgctccctttcaacagcccatcaaattgacagtaaatacctaaaaaagggtataaacacaaggacaaagggatcagaaaaagcaacaatagtgaacaagagataatcatgaacatctggaatgcagaggcagataggtaagtgggatgacttagtagacctgacaaaactgaaccctaattctacaagggatgtgggaagagggtgcccacaggaatcaagcaacccacactggcgtagctcagaaactgaagccacaaaggactactaaaagtgcaagtttggactgaggctgaaaacaggagaactgagaaaaggttctataaacagcaaacagataacccatctctcaaccccactgccacctgtctggcaaaaatctggaggttttactttctaaaaagggtgaaagagagaagcttgagcctcagggatgccaagcaaaccagaagatgaagagctgaggagtgctggatgacaccctattcaacaaatgctttccctctgtgtggttcccaaaccctggctgtcaggcttataccacagacagtagaggttggaagattcttttcaggggatgctgacctgtccaagacaaatgataatccttgacagtctatcaaaaacaaacaaaaatcatgtataacaacatcacactgctttatcacagagaaaggttcaacattctataatccctgccctcacaaaggcttcccattggctttttaggaccttatttttaatacaaatggacagctaagtatcagaaatcttttgttacaaaacaaaacaaaataaagcaaactcttgtttcctatgagatactgcagggaatggaacaaaacttaaaactaagacaaacaaaaaccaaccaccagcaaaaatctattaactgacggcctcagagaaacaagaattagatggtacaagacaaacattcagaaaacagaattgttcttggaaaataaaaatatgatagcagaaatttaaaaattcaaagaattagaaaaaaaactttaattttagaaaaatgcagttgagataactgcccagaaagtagaacaaaaaaaattagagatagaaaatagaagagaatatttgaaaatcaattgcaaaggtctaacatctgagcgatgagaattccaggacaagaagttattaaagaaacaatgaagaccatgtcccagaactgaaggacgttaagtttccaagattaaaggggttcacctgttaatccatcattatgactcaaaacctacaccaaggaacatcactgtgaatttctgaacatcagtgactaaacaaacaaacaaacaaacaaacaaaacccaaaagcttggaggaaggaaaggatttataaagaaaatgcctttgaatctgcctggaagttaaaaggaacaatgcttcaaattctgaactatcatcactagtacttacctatgtactgaaagtacccgctaacacaaccactcaagagaaattaaaagtatagaaactgggaaggaaactatcattatttgcagataacacctgggaaactcaaagagaatttactgaaaacgacccaaacaataaggtaccagagcataaaatttaaagaaatcaagaattctcatatataccagtaacaagaagacagaatgggggaaattttcccacttataatagcaacaagatgaaatacctaagaatacactcagtattgctataactatataaagaacaacttaaatactactgaagaatacaaaagtagacatcaacaaatagaatgacataccatgatcttggttacgatgactcaacatctaaaatcacaaatgttcccagagtttaaacacgataaatatgctatcttccctatgaagaaaccatcaggtttattgatttttttttaactaaagaagctgattctagaatttgtacagaaaatttaatagtattaggaaaacaacaaagtggtgcccaatgaaatggagatgggaaagaatactgctagatttcaaaattcaatttcatgattgaattaaaatagtatggaagaggtgtggcttcaaaaaccagtggggaaaagctagattgttcgactattcaataaacagcttttggactactaggtagtcttggggacaaggggagatggacttacaccttacaccctatacaatttctaaccacataaaacatttttaatatgaagaaatgaaaccacaaatgttctggaaaaaaccatgaaatagttccttcataatcttggagtagaaagaggctttctaactatgattcaaaatccagaagcaaagaagaaatttggtcagttacagacatatacaaatgtctccaagggtggggaatgagcagtcaaaaaaaaaaaaaaaatcacaaaaagagtgaatctctttagctcttatatatcaataagaaagacaagcaatccaattgaaaataaaaatgggcaaaggatatgaattgaacaggacataagaatggatcaatagcataaaacagaccctcaaacatgcttgttaagagtacatagaacataaaactgcatttaaattcaatttttcacctacaaggttgacaaaaatctaagagtttgaaaaaagtattttggtgaggcagtctcacgaattacacacatgggtaaactattctccaatagctatgaaattatagtggcacacctactgacctagcaatcacaattggcctatatttacatatatataagattaagtatgcacaagttagtccctacagtaccgcccaccctagcaaaggactgaaaacagcccaaatgcccacctatagggaactggggaataaactataacacatccataggataaactactaccaggccattaaagtatgaggagacacatagcatagtggttaggagcacacactctggaaccatactgtctagactggagtcctggatcatatacttattaattacgcaacctttgttcaagttatttaacctctctatgctgcaattactctgttaaataggaataacaatggtaactccatcatagggttgttatgaggaataagtcaggtcatatttgtaaactattttgaatagtgcttggcatatactaaacatatctaaatagaaagatttctaaaacacgctgttatgataaaatatactgtgtatggtttacaatttttatatatttaaagggggaggggataagaatatatagttgtatttgtaactctggaataatacagaagaaactaaaaatatagactgatgggggaaactgggaatagatattggggatgtcaggtatgaaagagagacttttacagttttcactgcaaacttttcctactttttactttattcatagacaacctatttaaaaaatttaattaataagaataatttcctggctgggcacagtgactcatgcctgtaatcctagcactttggaaggctgaggcaggtggatcacctgaggtcaggagttcgagaccagcttggacaacatggtgaaaccctgtctctaccaaaaatacaaaaattagctgggcatggtggcatgcgcctgtaatcccagctacactggaagctgaggcaggagaatcgcttgatcctgggaggcgagggttgcagagagccaagaatgcgccattgcactccagcctgggggatagagcgagattccctctcaaaaaaaaaaaggaaaaattttctgaggacaatctagaatttagtatgcattcacagtatcaataatgtgtgaaagtagaataatgccattttcaaacttgcaagactaaaaaaactcacctttttcaggaagctacaaggacatgctccattaagtcaaaataaataaataaataaataaataaacaaaccaaggaataaagcaagaaaacagggtatccaacacagagagataatgagaattcccagataatactgaagggaagttccagttctaaagtgtaagcacgtgcaggcttaaagcataaccagcccagataggaacaggaagtgcagaggatccagagccaattctctaggtgggagggaaaaaaaggaactgataggttacctatttttgaccgcatgggagaggtgttttgtaacactaaatacagattcaactcatgtgtgcatgtgtgtgtgcacgtgcgtgcacgtgtgtagggaagaggatgagtcattagctgaattatatattgggggaatcaagaatagaactataagcagacattttaaagtaaagagataaatgctagaagaaacagctaaaagtttattaaaaatggtttaacatatattgttatgttctcttcacttagaaaaattattagggaagacactaaatgagtctttcgactttgaagaaaagcaagtggacttgaattccatggtaaaaaaaaaaaacaacccctcaagtaatagtatttatctctcacctatctctattaacaaatcaaacattcctgaaatgtaacttacgtatatagtcatagtaattgcaaattctgttctacctgtctttgacagttatgtagtacaaacatcgactctgcttatgtatatatggttaacattaacttacaaatgaggtggaactaagtgacaaatagtgtaaaaggtaatgcctttccaatgtcacttatatgatggctataaaaagtatactttaggccaggcgtggtggctcatgcctgtaatcccagcactttgggaggccaaggcaggtggatcacctgaagtcaggagttcaagaccagaccaccctggccaacatggtgaaaccctatctccactaaaaatacaaaaattagctgggtatggtggtgcacacctgtagtcccagctacttgggaggctgaagcaggagaatcgcttgaacctgggaggcagaggttgcagtcagccgagattgtgccactgcactccagcctggcgacagagggagactccgtctcaagaaaaaaaaaaaaaaaaaaaagtgtgctttaatagaaggtaagaggcatgcaaaaattagagatttctcaagtctctaaactgaccagggtaaacttacatgaaacttcttcctcaaaaagaagatagggtagaggtagtattagtcataaaatgtgccctcatgtgcaaaccacaagagatttctaacacaccatattttctgtgtgtatacatgtgtgtaaaattcgtaaggacagccacacctaggctgttgttaaaaatagcaccttaacagctaacacaatcttaaggtcacttcacatgagaatttttctctttttccaaataaagccaggcatacttattcttattatgcaaaatagtgctctcgattaaaaatatattgtaaaatactgtaaatccttactccggcctctcattgattgttcccaattttgctaggagcctaaacagtcttccattttgaacctcctataaaacattttaaaaagagaaaaatgttaatgttccagataactgaacataaaagccaaaatttacaaaaactggtaacctgtaccaatattacctttaaacaataaatcctaacatccccaccttttggttatacttttaaacaaacacaatatgtccatttcatttcataatggtactcaagaagattatggagctgtccataggaattggaaaagtaactcacatgaaaaaccaagatttttgtcacatgactgtagcaaagccatgaatgaaaagaacagtgttgtccagaggacataagaaattaaaataccaaacattcagtgccgacaaaaatatctgaaatcttagcaaataaggcattatatttagtacaatgattattttgtgtctatttatatacacagatgcaagttgtgtgtacattcttttaattacactctttactggccaggtgcaatggctcacgcctgtaatcccagcactttgggaggctgaggcgggcggatcacttgagctcaggagctcaagaccagcctggccaacatggtgaaaccccgtctctactaacaatacaaaaatagcggggtgtggtggcgtacacctgtaatcccagctacttgggaggctgaggcaggagactcgcttgaacccaggaggcagaggttacagtaagccgagatagcaccactgcactccagcctgggtgacaaagcaagactctgtctcaaaaaaaaaaaaaaaaaaaaaaaatttacactctttacctttgcaaggtcttcctctatgacatcatttctcatttgagcagcatccaattgagtataaaatcgagcaccaatcatgggcatgatgtcatttacacttcgcatcctgttttggtcagtcaacaaatacctacccaagataaaagaggaattacttggatgtccaacatgcaatttaaaaaacaagataacccaaacatagctgttttggctgccgtcatcttagcacacaaaattttgaaaacattttaattcatgcaagtcaagttcattcttaaatattacatttcattcctctggaaaactgtaacagccaatggagaaacagtaaacatgtctcttctctacattttcactactatggaaatgagaaagaaaagtgaagtaggactgcacttacccatttccattctcaaacccttctttacaatagtgctagatgaaaagattgttacaggccaggtgcagtggttcacacttgtaatcccagcactttgggaggccgaggcaggtggatcactttaagaccagcctggccaacacggtgaaaccccgtctctactaaaaatacaaaattagctgggcatggtggcgggcacctgtagtcccagctactcaggaggctgaggcaggagaatagcttgaacccaggagacagaggctgcagtgagctgagatggcaccactgcactccagcctgggcaacaaagtgaaactccatctcaaaaaaaaggaaacaaacaaaaaacaaaaataaattaatagaaagaatttttttttttggtgacagagtctcgttctattgccaggctggagtgcagtggcgtgatctcggctcactgcaacctctgcctcctgggttcaagcaattctcctgccttagcctcgtgaataactgggactacaggcgtgcgccaccaagcccagataatttttttctatttttaatagagacagggtttcaccatgttggccaggatggtctcaatctcttgaccttgtgatccacctgccttggcctcccaaagcactgggattacaggtgtgagccactgcacccggccaaaaaagaaaaggtttttagaaacttttttgagaggactaaaagggggtaggtgtggggtggggagcttttcctgttgttttgcaaagattaattttcagaactaaaactgggttttcaattttgctaaactgaatgagcctttttaagaagctgtcctctgctctaaaacttaatttacaaggtatcatgacatattcatttctgagaaatgcagtaacacgcagcagaaggaaccagttaaatttcttctatcattagaacagtggcagaaaatactacacatttcaagggctacctgttagaacacaaagattctcaatcatctactgccgcttattctatacgtaaagccattctctgccctttctcatgaaagcagcctcctactcactccttcactcttctgcttgtaattctcttattttcttcataggtcttatcactacctgaaaatatctcactggtttttatgtttatttactctttcttcccattagggtgtaagctccagaagatgggaattttgttcacctcattcaaagtatcctgcatttggcatatagtagtcatcatttttgtggataaatgaatagctatacccatgtgaataaactatatcttagcaattcatccgtaagtatggacatatgtgtaccctgctaatcatatttaatgttattacaggctatgtgactttggcaagttattttatctctgtggctcagttttgtaactctaaaatgggactaataatggtatctaatttatagagttattgggagaattaaaaaaattaattcacatcaagcagtttgaaagggcccgatacatggtttaattactccataaactttagtttgtgtttattattaaagtatggcttttttgtttattcatttttttaataaagaaaatttcaaacatttataatagaatagtaatataatgaatccccatgtatcatcacccagtttcaataattattaacatatggctgattatttttgtcctctatccccacttttttaaaaaggaaaatttagagattataacctgaaattatttgaggcatcctaggtatttgcaaactaaggctaggaatcactgttgtgatcatatataaaacaagtatttttattcagaagataaatcatcttatttgaatttgattatgaataggatccagacaaccactggcttctagtgctgtcacaagtaggacatttatgccagtgtaacaaagaacaggtgggcaatcccaccctccatcccccaattcataccccagggctggtccaaaaagaaactggatcatccagggctacacagaaagatcagaatgggcagctgtaagctaaaagagactgttgattagcacctcttctctaatatagctcataactgtaataaaggtcgtggttgcccaccctctgggatctcccaatagtagctatatcttacggagaagtccttctgttgtgacagtagtccacacaatgggtttctcttaagccaaattcatctcaaatcgatactcaaggattctctggagcgttaagatactggagtgtaagcatgggggtctccacacaaatgctttccagaatgggtattttggccagagtacatgactggattgcacctgaggcttactcatgatggctttcacactctctagagcagcactatccaacagaactccaagatgagggaaatattctatgtctgtgctgtccaattatattagccagtaattacatgtggctgctgagctcttgaaatgtgactagtgtaattgaagaagtaagctttaaatttcaattaatatcaatgtaaaaggtcacatgtagctagtggataccaacaaacttctactgggtgccctttaaccaaatgtttaaaacatcaataactaatttaaacacactggtttatcaatttatctaagaaatatttactttgcaataaaaataaagacataaagtttctgttttgcttgattttaaatagtgggaaccaaaacaatcacttaaaacaaaaaaagctctgtcttatcgcaaataatcattctgtacaatttatcatatattaaaacttacaaaatcagattcttcaggtcagaggaatagttgattgtcaccagttccatggctttctgtaaattctctcgctgaattcctgccaaagagttgcaagccaaagccaacacaacttttcctaatgatatcagatctgcttgctgacatgaaagaataaatataacttttaattttcatttcacaggtactcatttaatacactgacactactgcctaaatggaaaaagcatcattataaataagctgcaggcagggtcctcaaatactggtgattctcagaataacctggagcttattaaaaagacgacttcgagcctctctaccagagattctcattgggtgggtccagaaaatggctcaacatttttaaagcacccaggtaattctgatgaaggtagttctaggtccacgccttaagagactttaagcaattcccatgccaactacaaattgccacttttaaaaagtttttctaattttttcttatttaaatagaggtaatattcttctctattacaacaaatttaaggttactatacatttgctttgctatgaccactataacttaacatacatactttgctcattttctgtaactcccagaatatagtgggaatgtgaaggattatctgaagaaaagttatcctattacaaacattagcattaaccagattttagagcaaattctctagaacatcaaaaatgctgcaaacctcaatgaatgacatcccatctatctttgtttccaaatagactatttttcctcacactctaacagatctttgagctctggaaccaccacctgctttcctaaaacctctcccactcaagatttaccattctgaggctttccttctaaaaggattttcaaaagacagctggctgaattaagtcctttatcacctattataactccaggaaacagtatggtcatcccaagtggccctgattggtaggaagctattaacaaccacatgccttcaagaatggagtacttcagagttaacatgaaaccacctgaagcaatttctacaacagacatttgcagatctttaaaatctgagaactcatctaaattattagacacacgttcatttactgaacattcgtttattataaggaattttcaagcatagctgtatattaccatcacttgagaagcttaaaaacaaaaccaaaatcagcagtagccatcccctcgtcccaattttggtataattagtctgggataaaaatctaggtattggtatttttctaagcttccacaaatgatggtaatatgcagccaggattgagaaccactggtttgttggaatatttgtaactttaaggcaatcattagtgaaattctagcattatatggttatacttaacaacagcctacccaaataatgagtaaaaagacgttaaactccattactaaaataacatttaaaagttcatactaaaaaatttatccaaaactagcatttgtgaatctgacactgaacatgagataaggagacagactgattaggtagacaaactactttgaatctattagaaaagattcaaagattcatcccagaaaacttttaaaacttcactggtgatagagtcaggagcccagaatggcaggagggaagctggcatgggaaggagaactattactgttgccatcatttctgtttgctggaggacactgtgatgaactccaaaaagaattcctctcaatcacactttagatcaagtaaaacattccaagttatattcatgaaattacagaaatctcagccaaaagaaatcagtgcatataaatgccaactataaatttctatgggcgattcaatccaaagtatccagcaaagcataccaaagattgttgttatttatcacgtgtttgagcagcaggtaccaacacacagtcttccaactcttcaagcagcagaattttcagtttggttccaccctgaactgatgctgtattaagcctccctcccagaatattccattattctctattatgagacagaaaaccaaaatggtccaagagagctgaagaaccagatgggtttaaaaaataacatctgatttttagtacatcccatcacctctctaaagcggactcaaggtaagaacatccactttttgaaataaagtacatgtatgacacagtccagattaaattagagttgtttttttaaacaaaagaagttaataaaatcttaagagagtttcacaccgtaaaacccagtaactctcctttccttatttctcagctaaataattttccatttgttattttgcttcttacctccatctggtttccccccatttgttgaattcaggagatttgccccccaactgattttcagtttcttcctgattcttgacttcttgatttctttttctgattctatctatggctctacttatgtccattttactcaaagtcagtctctattcacgtgtctgaaacaaactatgaaaaatagactacaagaaacaatgcactcctcatgtatcctcttctctgtaaaatcacactccccctttgggactatctttaattctttcctataccttactataataagcaatataaaaaatcagctacacatatatacccaaaaaaagaaagcctgatatatatcctttaatgctgaaaaaaataaacaggtgataattaattgaaggttgcctgattttatgaatgaaggcatatcctgacttacaaatattaataaggtgccctaaatgcttaaagttggttgtctgaactcagggatttttttcttatgaaaagttttgtttttcaaggtaactacacgactcataacatacttgaaaaggaaccctactgagaaaagaatgaggagcgtgtgcagttttttttttttttaatgcagacacgggtttctagatacttacattagaagatgatggtactggctctaaaaatgtgtaattttccttcaaaaatttaatattatctgcttggatgtatatccaagtgtatatattcactaatattttaacagtcaataatctgtcacttttggaagcataaaggtcataaagaaaaattaatcggagccaactacctaggcactaagtataagagagaagataagaatgaaagtagctaagaaacaatgtctccagataagaaagagggggcaaatgccctcaggcagaagaacagaatgatgctgctgggggaaaaacagaactaatcatattcctccctgtgttgcccactagatgttgctatcaaccagaacagcttggctgctgctgaggttaggtgggcacaagcagagggaaagaagggtgtgaaacgtctgcaaacaactgaatgcaatgagtgcctgcaagtctttgggactgtattctctgtggtttacgagcaaaacagatttatgcatgaactgaaatactaaacactgattagactctacttctcattttatcctttttgttctctttttgttctgaaattctatcagtgaactaaaatcttcttccaaaactttaaacaaaataagttgaaaagagaagaataaggtgtttctccatgtaattaagaaattctgccttagagcaaacctttgtaagttaataaatgttcaaaaaacccaaaaacttcttatacacaaagaactaaaattgtcttaaaatcatagctgcctatcctaatgtgaagcattccaatacaaactgaatgacctatttactttagttttgttacttgcagagtaatcaaggcaaaaacaactattctcttttttttttttgagatggagtctagctctgttacccaggcaggagtgcagtggtgcgatctcagctcactgcaacctccgcctcccaggttcaagcgattctcctgccttagcctcctgagtagctggactacaggtgtgtgccaccacacctggctaatctttgtatttttaggagaggtggggtttcaccatgttggccaggctggtctccagctcctgagctcaagtgatctgcccacctcagcctctcaaagtgctgggattacaggtgtgagccaccacacctggcctaaagcaactgttcttaatgcttgaagatacgttcttattcttcgatactttatcatttaaatcaggaaataagaaacagcaaaatagctaagaagcatcacgaggcctaaatcaacactaataaaatgaagtcagacaataatcaaatactaataaagtataagaagtgagtggtatgttctgactaaataaaaaaattacttagaaaatggcaatccaataacaaacctatgaaaacatttctaaaatttcatgactggtagtcagacaagtgttctaaaagtaaaaataataggtgtaattaaaggagtgaaaaagaagggtgtcatttaatataatccattcatctgattagtcttgttttaatctatctatgcttaggacacgtttcctaaatcacataaatacattttcattttgaacagttaagagtctctgacgttatcaggaggccgggcacagtggctcatgcctgtaatcccagcactttgggaggccgaggcaggcggatcacctgaggtcaggagttcaagaccagcctgaccaacatggagaaaccctgtctttactaaaaatacaaaatcagccaggcatggtggtgcatgcctgtaatcccagctactcgggaggctgaggcaggagaatcgcttgaacctgggaggcagaggttgtggtgagttgagatcgcgccattgcactccagtctgggcaacaagagtgaaactctgcctcaaaaaaaaaaaaaagagtctctgacattgtcatgaattctctttattccaacccacaagggctctacactaagtacatcataatggttaagaaatacagcctgggcaacatcgtgagcctctatctctacaaaaaataaaaataaaaaaaattttagccagacacagtagtgcacatctgtagtcccagctacatgggaggctgaggcgagacgattgcttgggcccagttcaaaagctgcagtgagctgacagcaccactgcactctagcccaggtgacagagcaagacagaagcaaaagaatagaaaggaaaagaga

SEQ ID NO: 1149 - DNA, 16567 bp, Homo sapiens; identical to SEQ ID NO: 1148

SEQ ID NO: 1150 - DNA, 8428 bp, Homo sapiens
gccaccgcacccggccgggagagtgttttataagttgaaaaacactagaaaaataatattagctattataattggtccactcaacttcctcagatggagttcgccccaagcaaaacaaatttccctcaactccaccccataaactgcaagtccccataactgcccctcctcttctcctcctttccaggctcacccaaacttggcttcctctgcctgtcccaggcacaggcctggcaggaagtgaccagcctcccattagctcttgccacaggtctgggagagttcacaggctgctgagctgagataagaggaccggcaggaactgagggtttcctcaccctagaaaagcacctcctcctactactcctttgccctccagactcaaggcaggaagagaaacctggggaaggggcctcagaggagaggcctccatcatgtgttcattctgactgctcaaactgttccttccattttgggaccagggaacagagctcacttaatgctgctctcccactgatgatgcccacccattctcggcctgcaagccctaccactcacagcttcaaaaatggctccgcccttcctgattccaccccacacagaagaaagcaacttcttgtgatgcttccttattctggatgtggctcacctcttaccccttccaactcctttgggtcccctagaaagcctccctggctaaggggtacaggccctctcctcagcagtgggcactgaccgtctaaccagggctctgtctcggcacctggtagcaaggacggcaagatacaacaacatgctgattttaatagcctctggctttctccactgcgtttctcacctgaatgccctgcacaccaaatcttccatggggtcacccttgacctctagggcaattcccaagaatctagcagaggagtgggggaaaccaaaaggctgacatgaaggactcaagggaagcctctggaaagaagagaccagacactaaaagggatgtgtgtgaaatactggtttttattggttggcacaagattacaacctacaatttcaatgcccttccctcccacacagctcaaatggaaggaaactgattaacacatagaaaggaacggcaggctcacaggtttaagcatttgtttttacaaaaaggagtgggatatgggggtggtcaagttttacgggtaataacaacattctctctagatggcagggggtaagtctgcctgtcctccattgctggtaccacataagggatacattagtaaagtagggaaagggttatatgtgtggctggcctgttctttagagaggaaggtgggatggtatctgctgtgtacctgtctcagaccaaacctggggctggaccagtgcccctttcttctcagccctcctccacagcctgactgtactgccagccgcacccatgagaaggaggtgtgaaggaagcctgaggacatccacctcgagaaaaggaaacaggaaaactatttccttccgccttctctggaccaaatttcactcccctcagctccagagagtgctgcaaaaatcttccttagggacgctgtgaagacacggggaagaggccagccctgagcgggcaagaagaaaagcttgaactttccatgcagtaccaagcaaggctattttggaaacaagcaaacaaacaaaaaatggaaaccaacaccatataaccacaggttgggtagctcctaaatcctggacagcatttggattgggggtaagggcaattttactccagctccttgttttataacccgcacaaggtgccaagaggtttaaggaccacaactgacctctctttccctacaagcaccattccttggattcccagttttgttgagctcatttgaggtcatccttgccatcctcttaaaaaatgacacagcctcttggttattccattttctatccctttctacaattatgaacacactctctaaacaggagatctatatatgctctcatcctgcaacccaagagattaggtgacctaatgatgagaaggctaacttatttgctttcctgggtggtcctgatggaaatgaacagcagcagagttctggtgggatagagcagtctagtctgagccactgtgtgattccccaggggactggtccctgggtacatgggtccctggctctctgtctcagttccacagatattactcaacttggccatttacgcctcagctaaaacatatgagcatgagggaaaagggacaagaaatacttttgtcctctagaaaaacttaactcaatacatcttggctactttgcctcaacccacggggttccctggaaacatttgttgaacttggccaagaggagattgtatatggatggcacacctggaaaaggggagaaagcacactagttcatctcttttataagtagaatggtcccagggatgttaacctttctgatgctgatagtagatgagtggagtggaggtaatcgtgagaaaacttaaaaacccttaagctgtttggagactacacaccacagtggagcaaaccaaggtggggcctcactgcctcctcagagcccatccctgaccatgtcattggataggatggaagacaaagtctttgaaatggaggctgggctggcaaaagtaagtatgaagatgctactactggccttccacttcctctctctgatacacctaagaaggtgagagacactagcttcaattccattttacaacagttctcaacaacctgaaatattcttgacttccttaagcacatggaaaactggtaagctatatctttctaactgaaattttacttattctaaccaccaaccttttctttgattatcaaccagtttgacagtcttcagatcacaaaacaatagaacagacctgacatttacaaaactgtactacatacttatttcttttacagtagagctgaccaattacttttctaactactaatgcaacaccatgccactgggccctggactctgatgtttctgatccctgagcaacacatctatgtccattcacagatggaaatgaaagagtgagattctcagaggctaaacaacattctgggagcaaattggatttttgaagggagagtcctcttagaaaattctgagcaaacatgctcccagtcacgagggatggggtgagcgggcaggtttctgtctgtgagctatagctcccttctgaactccctcatgttcttgggaggacacaagcctcttgctcattaagcaaaggccctccaagtctcctttttacttcagcactttggaaactctccaagacttaacttccgatctggggaggttctacgtggagcagacctatcccttcttattcctgttcctgggtgtctccataatcagcctctaccttccctggcataagtcatatctgttatgctgcaggaactgagtaaccaaagctagatatcccttggaccactgattagtgacacattttctccacaacaaagggaggttaaagacaaaggtttaacctgagaaactttttttttggcaagataataaagaggttaaagaggctacgtggatctgtcactgctttagcttaccattttcaattcagcaccaaagtgctcagaaagacaggctcagatcaggacgacttcttaaagggattcacaggcaatattactggcaaaatgattttccaaagctgagccacgcgccccaccctacagggaggggagtagaatcttatggcccagcattggcattgaggcatcttgctttttttcctcagaattccacaaaggcttaagagtgatctaaatgcctggctggaagctcaagtctaggagagctattttactgcactgttgagatgttctctgcaaggtgatatcccaagtgacacagaaacacagctcctccggatggtgaagtctccgctgcaaaactcacgaaacagcacagaggatgactctagggtgctctcccacttgctccaagttaggcaggtgccctgatggaggcaaggctgagccattaacatgcacagctccatatcctggaagcctctgtagccttgaggagataggctctatccaacaggactcagaataaatgactgccacctcaactgagcagtatgaactgcccacctcaactgggcagtctgacctcttccacagtctttaagaaacagaagagccatttgcattatttaatcaccattcaataatctcctccctccccatagctgcttgagttaactgtcccacaagtgtcctgtgttttgtaaagatgagggttattttctgaaatgcagatgggactaggatgaagctgtattatcaattacagagacagccaactctcatttctcttaaagcaaaaattcattccactgtgatttctccaggtatttcctgcaattctaaatccgcccttgatattagagaatattaaaatcacacagttgtggcaaaaatcacattgtggctattaaatcctttttgtgaactaaaaaaagtgaatgtggcttaggctaagctgtttttttttttttttttttaaagatgaggatgcggactccaacaaaggcattaagaaagtactagatgaaaatgagaaatatgtgaaggataacatgtgaaatgtacactcaggtctaacaaatacctattatttctctggttaagaaggtttagcaggagcctccaatgagcactgtatgtagagaaaagggaaggagcaggaggaggaacagatctgcacagaatttttttcttaaaaaccacaaagggtgacttttttcttctaagcaagcaagcctgagaggcattacatgggctggctcctaatatcaaaacaaaatatttctttgccacaaaggaacttgactatgtagcaacacatttacaaaactactgcaaaacactcccagagggcagtgacctactctgctccccagaggctccaagaagcaaggcctcaagtgcctcatgttccatggggctgtgcagtgcaatgcagaaggcggaaatcctgctgtgacgccaccctcgagaccttctgcagcctgagagggggtgatactcccacaccctttgatccttccagatggctcagcctagatctagcagtgagagagccctctccatgcagggcagatggagtggtggacacttgtgaaaacaaaacactaactgttccatcctgttatatttgctgtgaggaaaattaagattcctgttgtatgggctgcactgtttctggaagactacagaaaatctaacatggttgacacttcctggtagcccttctgtacatacacacacacacacccagagagaagacagagagaaaatcctggtccaaaagatcacatgaccttactagtgtttccccaatgactgtaatttataaactaaaaatttttacaaatccactgctatcttcttctgtcctgagtttggtagactttaatggatgctccagcaataaccagaatctaggacatgcagactcactgtgagcgagaggctagggatctgccctaaacataggaacctgtttctatcaagcctgaatgaggtcagctctggtagaattaatgacaaatcaatgtcagtgaaatattctgcaaacagggtagcttttgtgctttcttttgattattttctttggggagataaaggtattgcaaccatgggtctaactaatctatcactaaaggactgtgacgacattctcaataaagacagtcatggtgtttactgtgccaaggagggaaaatcccagatcatcagaatcccagtgcaacagaaaacagcaccagtttcaacaattctgatgttggacaaagcctctttttgtcagttaagaaagcgtaagcacaatctctcagtcaattgcattaacaggaatccattcatgtcactgaaaaatacttcttggcacagttcactttcctgacccaaagacaccaacaacaatcaaaactgcactttcagggtagtatattgttacactagcccagtcaaaacatactcagaacatttaaaaatgtataaattactgttagcactgcagttccgttttattttcttatttatttattaagacagagtcttactctgttgcccaggctggagtgcagtggcatgatcttggcttactgcaacctctgcctcccaggtttaagcaattctcatgcttcagcctaccaagtagctgggattacaggagtgcaccatcatgcccagctaatttttgtattttagtagagatggggttttgccatgttggtcaggctggtctcaaactcctggcctcaagtgacccacctgccttggcctcccaaagtgctgggattacaggtgtgagccactacacccagccctgcagtccctttttaaagagtactgactgttttcctgcaaagtactttcaaatccataccataaaggtagaatttatctggaagaatgtgttttttgaattccacctggcacttggttaaatctactttattttgccctttatttatttgaacagaactttagaatgctctaggtcaggaaaagaaacagtgtgttcgtttttaagaaggatgtgtgaatagtaagttggcattcagactcaagtcccatggtattgttcttatccaatgggacctctccttgggaatataattcctttcccagaggtatcatggtatcccaagaatataactgctctttggctctgtgtgtgaagattgggggagaggatgtaaactaagagtatatagcaaaaaaaaaaaaaaaaattttttttttttttttttgagatggagtttcactcttatcacccaggctggacgacagtggtgcaatctcggctcactgcaacctctgcctcccaggttcaagcgattatctcgcctcagcctcccaagtagctgggattacaggcgcccacctaatttctgcatttttagtagagacggggtttcaccatgttggtcaggctggtctcaaactcctgacctcaggtgatccacctgcctcagcctcccaaagtgctgggattacaggtgtgagccaccgtgcccagtgagtagacagcaaaatttaaagttcaccaactgatgttcccaaaagtgctgaacactaaatgacacagggctatgaggtacatacatttcttttagtaggagggaaaagtaaaagcttttcaaagtttgagtgctttattagaatttttaaatgaggcgaactatgattttaatttcacatcttggctaaggagatgccactggagtacagagataatctcctgtcttaagccacggatcagtcagtgtagccctccctacccctcaatctcaagaccctcttacttccgaactaaacaacacaattggcaaatgaagccagcacgaaactgtatcaaaaaacaagagagtctgcagtgagccagtgtattatgtaaccactgtaataagtgattacgtggcctcccatatggacctttcatatcctggtgggagatgggagaccaatttaatagctctgagcatgctccatggtgcaatcacaagtgccatgccaatacaaagacaagcaagcaggtgaatttccctagtgtacttttcaggaacacggttactcagttcagggacaggactacattgatgcacctgcaaagtaaagttggatgcttcagagcacatggatgatacccaggtcagcacggtgtaaggcatatatggacacaaagagaggccattgttggcaataaatagcattacggaaaagattccaaaccagcagaacagaaatggacctgatgctccagttttttagataagtaatcccaagaatccagttccaactctactgtcaacatgtggggcagaattcaatttctatcattgtttttacagatctgggctgaggccatttgctccttgcttggttaaaaaaaaataaaaaaataaaaaaaggtttcttcctgtttctttctgggcagggaaatacagcttaaagaaggaaaggccatgagtcctgggagcactatgaaggtagctaaactcttcccatatctacagtcaatgactgggaaatagagaaaggacagggcaacctgcccagccactagcatcgaaaacaaaaaggtatgttaattgtgaggctctcaattctagaaatgcccaaattaaaagagaaaaaaaccttgaaaaattaaacaaatttctctttctagaagtcatttatttacatattatatgtccgatatataatgtgtagataaatgtatactgcagtgaaagtgaccactctactgaactgtacagcacattataggacaaattattggaagttttcatctcatactggtatcttttaataaaaaaaaaaaattaaaaatcaaagaaaacgtctggccagggccaggataag

SEQ ID NO: 1151 - DNA, 1195 bp, Homo sapiens
ggccctagtcctggccacagagtctccttgcagcccaagacagaagctgatgattcacagtagagaagaagtgaatattccagttcattttatcttcaaacagctaattggattagctactatcacccgaattttacaccaagaaaactgatgatcagagaaataaagccaagttcctaggaccacaaagtgggtaagaggcagagcaggatttaaacccagatttgtttgacttcaaagcttatgctttttcactatttctcctcacacccactgaccccacaatgtctcataaggggatctgcaaggcagccctaaattccaagcaggacatgtaactcctcaatggacaaatggacactggaccctggttgaaggaacctgttgttcttatggtggagggcagaaacccaagagggctggagccaatccatccctgttttctttagacgctgactcctgctgtctgccagatcctcgtggtacaatgactggtgtagactggcttgttgaagtcactctctggatctgagcaacgctggctgagccgtgatgaagtattcctatccatccactatgcttcacagtgggaatctctcactgttcatcaccgctgccctagcagccgcagctaacatcttctagtcaaacaactctccttttcaaagggaccaggcacagtttctgcttatccctgagtagcagtgttcagtttcctgccagcctgtggagtttttcaaacaagccaatcacctcctcctgtgggaactgagaagcaccccaccctctcgatactacaaagcccctgcttgttccctagtgcaactcccatgtggtcctgtggagcatatggtatcttcctcttctgggcagtgagcatatgtgactaataaactatctatctcatctgttcagtgccaggtgtcatttgttctgccatcccatgacctagggtggggattccttccacaccaacagggtgaatgcaaggtgattaaaacaagaagcctcttcaggatctatatcctagggaaaaaattaaacaacaacaacaaaacaagaagcttcaactctgaccctgtattccagatgtgttacaggggcctgtctccccagagccactctccaggtcagagcttacctccccttgctcagggttaggagctctgggcaggaaaaggacatcatgttaaaa

SEQ ID NO: 1152 - DNA, 1195 bp, Homo sapiens; identical to SEQ ID NO: 1151

SEQ ID NO: 1153 - DNA, 2515 bp, Homo sapiens
ggcttttcttctcccaggaagaatccagaatagttcagacaagcttcaggtccgccagaaccggggaaaacaacgtctctgcctggatggactggcctatctctgctggattcccgaagtgcattgtgtagagacagcaactcaggtcaggctaaaagctcaagcaagcaagcgcgcacacacacgcgcgcacacacacacacacacacacaaacactcagcttccttaggacaagataaaatcttagcattcccctctccccgattaggtaggtctctgggaggactaaggcttcaggtgcaaggctcagataacctgcagtgtctctccaactctgggatgacaaagacctcacttcccttttctggtgttcacacaacaatgagaaagtacgggtagcctgcagaaagacctctccattcatggtcccccaggggtgtgggttctgagaggtgggaccagctgccaggccctttctccattggttgagttcagcaggtaacctgaagctttgctgagaggtgcataaataaagagtgaaactagtaccacctccttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccgggcaggagtgcagtggctcaatcttgggctcactgcagcctcaacctcccaggttcaagcgattctcctgcctcagcccctcaagtagctgggactacaagcgcacaccaccacgcctgactaattttttgtatttttttgtagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggacactgtcatctctcaagtacccatcttggagggtacggaccccacatgaggaaaggaccaaccacaccgagctcagttatggcacacacagtgggacctagacaaagggagagggtgaccgacatcccaactagatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctactgaaaagcctctctgcctctatgttttataccatcggatgccaactcccggccttctaagccacctcccctttaggctaaaactgagacatgaacttgaaaaattgacactggcttcctctctctttagggtccccaggcaggtggctgggacactatttgcaatcagcaaggaaccctgctgcccttagactccccacagagcaagcagaacttgcagaatggggtaaaaacactctattaaagattttttaaacctatttatattgtaataaagtaaatgtaaataaaatttaagtgaaggcagattgcagatatttccgatgctatacaagatatatctcatagtatgggtgtagattctgcaaaggttaatgcagttaaacatatttgacacataaaaatgtcagatccaacattaatcattcaccaattgtaattgcctttctatgggtctcttctccccaagacatagcttaaaacaccaggctcggtagaaatctgggaggaaaaaagcaaataatacctctcagctgtcagggtctatgatacgctttgatagatttagcactgatttcattctctttacaattcagtgtgattgggtgtgcgtgtgtgtgtgtgtgtgtgtgtgtgtgtgtgtgtgtgttactccatgtttctcctttttaaggaaggagaaggtgtggaacaagagaaagttcctaagtctgaaggaagtccaacccagttatgaagggaatgccatccacaagccttttttataattggcccctgcctcaggtaaaggggtctcctttaaggagccagtctggctaaattggcagattctgaacaaagcctggccctgacaagtcttcagaaaaaccggttttcacctccagaatgtgccccag

SEQ ID NO: 1154 - DNA, 2515 bp, Homo sapiens; identical to SEQ ID NO: 1153

SEQ ID NO: 1155 - DNA, 2515 bp, Homo sapiens; identical to SEQ ID NO: 1153

SEQ ID NO: 1156 - DNA, 2515 bp, Homo sapiens; identical to SEQ ID NO: 1153

SEQ ID NO: 1157 - DNA, 1355 bp, Homo sapiens
cgatttgctgcctgaccttgttggtgcctgtgatgatgattatacagcattgtgcatgccattaaaggggaggggaggaacttgagaggagatcttagggccctagtcctggccacagagtctccttgcagcccaagacagaagctgatgattcacagtagagaagaagtgaatattccagttcattttatcttcaaacagctaattggattagctactatcacccgaattttacaccaagaaaactgatgatcagagaaataaagccaagttcctaggaccacaaagtgggtaagaggcagagcaggatttaaacccagatttgtttgacttcaaagcttatgctttttcactatttctcctcacacccactgaccccacaatgtctcataaggggatctgcaaggcagccctaaattccaagcaggacatgtaactcctcaatggacaaatggacactggaccctggttgaaggaacctgttgttcttatggtggagggcagaaacccaagagggctggagccaatccatggattcttcacccatggttgcttaggtttataagcaaggaagctgaatgaagtccctttcctctctggatgagcccctgggtttctggaagagtcttaaaatcacccctaaatggcttccaagcactgaagcccgagatgttagctggcctgtgtgaggccttgagacagaatgccacagccacaccccaaggatgctgaaggggatttccctcctctgtggtttttctcctttcttcccgcagcactcctcctacgtgctaacatcttctagtcaaacaactctccttttcaaagggaccaggcacagtttctgcttatccctgagtagcagtgttcagtttcctgccagcctgtggagtttttcaaacaagccaatcacctcctcctgtgggaactgagaagcaccccaccctctcgatactacaaagcccctgcttgttccctagtgcaactcccatgtggtcctgtggagcatatggtatcttcctcttctgggcagtgagcatatgtgactaataaactatctatctcatctgttcagtgccaggtgtcatttgttctgccatcccatgacctagggtggggattccttccacaccaacagggtgaatgcaaggtgattaaaacaagaagcctcttcaggatctatatcctagggaaaaaattaaacaacaacaacaaaacaagaagcttcaactctgaccctgtattccagatgtgttacaggggcctgtctccccagagccactctccaggtcagagcttacctccccttgctcagggttaggagctctgggcaggaaaaggacatcatgttaaaa

SEQ ID NO: 1158 - DNA, 1355 bp, Homo sapiens; identical to SEQ ID NO: 1157

SEQ ID NO: 1159 - DNA, 2829 bp, Homo sapiens
ggcttttcttctcccaggaagaatccagaatagttcagacaagcttcaggtccgccagaaccggggaaaacaacgtgtagggtttgttttaaagggcttttaaatggggtttgggagatccaggtagattagaatcttgactctgcactggctgtgcaagacagaaattcacctttcaaaacttctgttccccagtctatgcggtaagaagtttagattagctgatttctagggagattttgggcaggcatgattcagttccatgaagggctgtgggacaggactgcactaagaggtcctatagattggattcttcagttccctcccttccgctggagaatagaggaatctgccttcgctgcacactagatttacctggagaacaaatggaaagcaggccaggatcctgggtgaaatgtggcacatttgaggagacttcaacttcccttgccctccagctctgcctggatggactggcctatctctgctggattcccgaagtgcattgtgtagagacagcaactcaggtcaggctaaaagctcaagcaagcaagcgcgcacacacacgcgcgcacacacacacacacacacacaaacactcagcttccttaggacaagataaaatcttagcattcccctctccccgattaggtaggtctctgggaggactaaggcttcaggtgcaaggctcagataacctgcagtgtctctccaactctgggatgacaaagacctcacttcccttttctggtgttcacacaacaatgagaaagtacgggtagcctgcagaaagacctctccattcatggtcccccaggggtgtgggttctgagaggtgggaccagctgccaggccctttctccattggttgagttcagcaggtaacctgaagctttgctgagaggtgcataaataaagagtgaaactagtaccacctccttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccgggcaggagtgcagtggctcaatcttgggctcactgcagcctcaacctcccagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggacactgtcatctctcaagtacccatcttggagggtacggaccccacatgagggtgaggctctctgcacactccagaaaaggaccaaccacaccgagctcagttatggcacacacagtgggacctagacaaagggagagggtgaccgacatcccaactagatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctactgaaaagcctctctgcctctatgttttataccatcggatgccaactcccggccttctaagccacctcccctttaggctaaaactgagacatgaacttgaaaaattgacactggcttcctctctctttagggtccccaggcaggtggctgggacactatttgcaatcagcaaggaaccctgctgcccttagactccccacagagcaagcagaacttgcagaatggggtaaaaacactctattaaagattttttaaacctatttatattgtaataaagtaaatgtaaataaaatttaagtgaaggcagattgcagatatttccgatgctatacaagatatatctcatagtatgggtgtagattctgcaaaggttaatgcagttaaacatatttgacacataaaaatgtcagatccaacattaatcattcaccaattgtaattgcctttctatgggtctcttctccccaagacatagcttaaaacaccaggctcggtagaaatctgggaggaaaaaagcaaataatacctctcagctgtcagggtctatgatacgctttgatagatttagcactgatttcattctctttacaattcagtgtgattgggtgtgcgtgtgtgtgtgtgtgtgtgtgtgtgtgtgtgtgtgtgttactccatgtttctcctttttaaggaaggagaaggtgtggaacaagagaaagttcctaagtctgaaggaagtccaacccagttatgaagggaatgccatccacaagccttttttataattggcccctgcctcaggtaaaggggtctcctttaaggagccagtctggctaaattggcagattctgaacaaagcctggccctgacaagtcttcagaaaaaccggttttcacctccagaatgtgccccag

SEQ ID NO: 1160 - DNA, 1371 bp, Homo sapiens
tttcgtatttttcagccaaatggatggacataattttgtgattcagactgtgtagcagtgttaccagtttttgttcaattaatccaggaagactgaataacataaatccgcaaatcacatttgagaaacatctttccaagtctatatattaaaaaaaaaaagaggcaatcaacctttgccagttgcattcaaatactgggtttggaaaggataaaccgactgaatagtcagaatgtgaaccactgaagggagacaagttggagaggaagctggtacattactcacgaatgaatcagacatcccctccctccgtgtttgaaaatgtcctcggcataaagcatggtacaattccaaacgaggaactatgctcaggattggatttatatgactgatcagtttcctctgctgttatcgaaagcagatatcaaatggctgtggaggaatgcaggtgattggagttggtccaaagggaagttgtgagttctgggaggcagaaggaaagcagctgccatgttctgaaggttatcagcacctgttggtgatagaaacagacacagaggtgttagcaggttcctgtttgtcctcgcacccccctccctcctgatggtgaccttgtcccaggtcttctaccaggccttctaccagatgctttgctgagaattcacagaggccgtagacctgaagaaccaacaaccttccataggctttgaggtcccactccggcagcaggacgtgctggctcccaggaatcactgtgaccactattctaaattccttatgtgttcagaatttattcagagctcaggaaggtgatactactgtaacagatgctcttcagccccttgactgggcaaacttcaaacaagtgactgagctcccttagctgccactgattggaccaggatggacaacaaatgtaggaggagttcatctggatctagcctgagccagtcagatatcccctttgaatccatgcctatagaaatacaaaaaaatggaagccagaggatgatggatccttgaagtaataagtcagctctgtggaagtttgagtgactcattgcagagaggaattgatgaagtcaacagctgctggaaaaacttctttttccttaatagctgtatcaacatgtggttgctattattcaagtaagaaaaatatgtatatcaaacatccatggtagtccttgctaaaattttcattagagagactcatgttttgacattaaaaaaagttcaaatgggtaccttagaggatgttttgttggagaacaaaatcatggagaaataaagtctaaaaagaaaaataaatggcaagcatgttgttaataatgctgtaatttatttcagagtgggttgggtgattttctt

SEQ ID NO: 1161 - DNA, 3963 bp, Homo sapiens
gcagttagttttggggctggaaatttgagcagagagaatggcagagtcttttcaggagccagaaatgcatgtgaggaccaagaacttctaacagtagaggaactctggctggggtagttgagggggaggagaaatgaggatcaagggggcatacagtgcatgaaaacaaaaggtgaggcccaagatcagccaaagtgagtaaaccacggttaccatggctactcttcagtggagacggaaggaagccctgtatcctccccttccaaccacactacgctgttccactccccatctccatctcctgtaccccagacacactcaggcaagcacagcaccaccctggatgactctgcggaatgcctctcagagacacggaactagaaacctaggggaagagggacatcaaggcttttgcctcacaagctgactctggaacaaagagccaggctgaggggctggaagaagaaacttccagcagagccacccagatatgcttcccccaccctctagaccttccacaccaaccagtgtccagtcagtccacagagcatcctcctgggctgtggtgactgaagttgaagggaagaaaatataataataattttgggcaggtcgtctttctttactgtattggatggatatagaatcaataaatctataggtttatcccatttttctgaacaaatttagaggtcaaagatgaaccctcaaggggacagaatatgaccagcaggactattgatatcgtctgccctaggcactcctccttaccctcctctcccctatattttgggggcagtcatattcctcagcagtcagttgctctgcctccagtcctaactggcttctgaaaaacagttctggtccattcattccctgtctcgagacttccggagcttcctgacctgtgaatgaaatccacaggcccatcacaagatggctgcgctctccagtccccggcaccccaggctgctctgaacatgtgagagctcctccctcaaggcctgaattttcgcaggtcttcatcacactcagcccgccatcattttttcagattcagttccaatatgtcactctgtctgtagagccttccctgaatctcacagacaaatgcggcagttccctttgtgggggatattcatcatgtttttcctcattggcctatgtttttgcctcttcttgtagatgtccatctaggctgggagctcctagggggtaaacgcagcctctcactcacctggcacagagtcgatgctcatggaatgatacgtgatggggagagtgagtaagtgaatgaatgaatgaatgctattctggaaggaagagggagagagggagcagggaaaggtcagaagggggcccagagtcttcagcacacaatgtgggtgtatcactgtggccaggaacaattcgcttctctgcctgcattactttttgggaaatgggagagctgaggctcagtgtaggcaaactgggtccagtcagcagggaagccatgagctccacggtttaggggaggagtccggtgcttaaggaagctatcacgtggaagatctccctgccctcctcctattggtctgtattggtttttcttcttcaccagtggaggcttttcttctcccaggaagaatccagaatagttcagacaagcttcaggtccgccagaaccggggaaaacaacgtgtagggtttgttttaaagggcttttaaatggggtttgggagatccaggtagattagaatcttgactctgcactggctgtgcaagacagaaattcacctttcaaaacttctgttccccagtctatgcggtaagaagtttagattagctgatttctagggagattttgggcaggcatgattcagttccatgaagggctgtgggacaggactgcactaagaggtcctatagattggattcttcagttccctcccttccgctggagaatagaggaatctgccttcgctgcacactagatttacctggagaacaaatggaaagcaggccaggatcctgggtgaaatgtggcacatttgaggagacttcaacttcccttgccctccagtgtggtcttttccccacccccagacatgaaagggaagcaggtcacaaagcctttcggattataaaagaaacacttgcttctcacaaggggagcagcagacttactctgtactaaatgccaggataagcctctggctgggcctcgactgtgaccctccggcctctttctacagctctgcctggatggactggcctatctctgctggattcccgaagtgcattgtgtagagacagcaactcagaggtgggaccagctgccaggccctttctccattggttgagttcagcaggtaacctgaagctttgctgagaggtgcataaataaagagtgaaactagtaccacctccttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccgggcaggagtgcagtggctcaatcttgggctcactgcagcctcaacctcccaggttcaagcgattctcctgcctcagcccctcaagtagctgggactacaagcgcacaccaccacgcctgactaattttttgtatttttttgtagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtggtccccaggcaggtggctgggacactatttgcaatcagcaaggaaccctgctgcccttagactccccacagagcaagcagaacttgcagaatggggtaaaaacactctattaaagattttttaaacctatttatattgtaataaagtaaatgtaaataaaatttaagtgaaggcagattgcagatatttccgatgctatacaagatatatctcatagtatgggtgtagattctgcaaaggttaatgcagttaaacatatttgacacataaaaatgtcagatccaacattaatcattcaccaattgtaattgcctttctatgggtctcttctccccaagacatagcttaaaacaccaggctcggtagaaatctgggaggaaaaaagcaaataatacctctcagctgtcagggtctatgatacgctttgatagatttagcactgatttcattctctttacaattcagtgtgattgggtgtgcgtgtgtgtgtgtgtgtgtgtgtgtgtgtgtgtgtgtgttactccatgtttctcctttttaaggaaggagaaggtgtggaacaagagaaagttcctaagtctgaaggaagtccaacccagttatgaagggaatgccatccacaagccttttttataattggcccctgcctcaggtaaaggggtctcctttaaggagccagtctggctaaattggcagattctgaacaaagcctggccctgacaagtcttcagaaaaaccggttttcacctccagaatgtgccccag

SEQ ID NO: 1162 - DNA, 605 bp, Homo sapiens
acagaggaaatgcttatgtcagagaatgaatgttttaagacacacacaggtgtctctgggacaaccaagaaaagtgcaacaggcagatggattgaggagtctggctaaagataaggatttaggaactgctgaattaaaattacccaagcgtgagaagtggtgttgtgattaagagagaaaaaaaaaatggaggtctgaggaataacatttaaggaataaatgaagaggccaaaaggtggggggtggttcaggagtgagcaaaatgtaagaagtcaagggaataaatctttaaagtaggggttgtcaaaaatgtcaaatacagaaaaaaagtcaagtactagcttgtgaattaaactgtggatttagaattaagattttagactttacaggaagggactgttaaccagagagccaaatggcagattttagttaaggagccagtagaaggtgacaaagtagaggtaagaatattccttcaaaaagattggcagctaaaaaaaaaagaggccgggcgtggtggctcacgcctgtaatcccagcactttgggaggtcgaggtggaagaatggcgtgaacctggaaggcagagcttgcagtgagctaaga

SEQ ID NO: 1163 - DNA, 605 bp, Homo sapiens; identical to SEQ ID NO: 1162

SEQ ID NO: 1164 - DNA, 605 bp, Homo sapiens; identical to SEQ ID NO: 1162

SEQ ID NO: 1165 - DNA, 605 bp, Homo sapiens; identical to SEQ ID NO: 1162

SEQ ID NO: 1166 - DNA, 605 bp, Homo sapiens; identical to SEQ ID NO: 1162

SEQ ID NO: 1167 - DNA, 605 bp, Homo sapiens; identical to SEQ ID NO: 1162

SEQ ID NO: 1168 - DNA, 531 bp, Homo sapiens
cctctaggcaagaaaaaaaaagaagataagggaaagacaaaggaaggaaatggaaggaaaggacaaagaaggaaagtctactctgaatcttgacatgtcagcttgattctagaagtgcgtttacctggaggacttacccacaactttaaccttgatgcttgcatgtgcctctccagcttcgtttttcagattgatgtggtaaacaccagagtcatctctttcagctatatcaatgaccagagtgctgctatcaggtcttcaacaaaccagaagactcattaggatccataatagctgccagtgtagaggagcctcagttactttcactttgatcattatccctgggagaagaagccaacagctcctggtgaccacaataagagatttcatttttacctcttacgaagagctcagtggaacatttctcatcaccggctgtcacataatactctgaatcatctgtcatctgacagttattgataaacaggattctctggcatcctttgtgttcaaagatgtatctgttttgaa

SEQ ID NO: 1169 - DNA, 2212 bp, Homo sapiens
gggaaagccttcccaagccacacaggagaaaaatctcccagctctccttcccttcctctgttctggacacaggctggtgatgctggagccacaacaaccaccggaaaccccaaggcgaagaccagagaatcccagagatgcagacagagacttcctagagctacagagtaagccaaattggagttgccttttctggacgtcttgttaaggacaaccagaggcctatttatctcatgatggaaggcaggagaacaagcaggcaagaccagctgtgctagcacatgccacctctttgcccacgtcacacctgctgacgtcccattggccaatgcaagtcacacaaccaaagccaacatcaacaggacaaggaaacagactctgcctctagatgcacaaactacagagtcacggacagaggacacggatccagggaaggaagatggagaatgagaacaatgaccctcaataacacagcctcccacaggtttccaaatccccaacccaggcatatatccaaggaaatggaatcatgggttcaggttttagagcaagcaatttctgctctccctgcctagtttccacacccttaacacaggggcaatgatgtcacatcaaaacatatcatacaaatttgtgatgatgtttcaacaactaaacaccagaaaaatgcttagggcagggccgggtaggaggggcagaagccaatagtaacttaacatcactgctaacccacaaagttctgggaatttctttgaatgtctaattagagaaccatgtccccaagaattaacatttcttttgcttttttttgaatctgagaaaatactaattgtcacagggtagaatatttatctgatgagcatatagaagttaagggctccttgaaatcacagtgctaggtttgggtctcattcctcctcctacctgcctctctgagcctcagtttctcatctgtagaatgggtacaatcccaacctcatgtgtttgtggcagtcagggttaattgggctaatgattctaaagtgctctgcgcaggcctggcaggtactgagcaaccttgggccatagagagagcactgacttgggagtcaggagctgggacctcaggtcctattccctggggatccgggaaaagtcccttggcttccctgagcttcatctgccccacgtgctagtgaggtggctagaccagtcaggccaaggacgtccctgcagctatctaacttctccttactccctgttcagcaaagggcaggagctgggcctggccaggctcccacaaagcccaggcgtggccgtgctcagctcacgacgggtgtgggggatgcgtttctgccctcaaaggactgagctccagtttctttcttcactgagtcctttactctctgcctgcgggtggttatttaagacatctcctgcctgcaggggcctcttagagaacaaacagatcgttccttcagctgcagtgcaggctttactgggcttgttcctgcatcaagtagacagatccttcctgaatggagtcgccccacaggccccacactcggagaggggcagccaggagcctccgaggctctgcccagcccgtcctgaatgtgctccctgccctgagtggagcgctcacagctccccgcatcaaggtttctgtctccccaaggatcttcctcataaaaacccttcttctcccagatcccacaaaccgacattataaaaaacacaaacacccaataagcaccatgtaaattgatcacatacaaataatatccaaaaataagaactcgtataaccactttaaactatagaacatgtctgttgggatttgtgggagatcatggatcacaggttccccctgctcctggttcagcactgtgagaaatggaagtgaggttcacccagggacgggaaagcgtcagctgccactcatgaggctggggggcaggggaagcccttcatccgtggacacaaacaggcatcctaacatgacttccatgagcagaagtgggcagacagggctgaaaagctgaccttacaaggctgaggacctgccttgagctctgcctgactgcagagaaggaaagttctcttcttgcaacctcaaatcttccagataagaaccaaacgacatccggcctttgcgttctctccaccagctcccggctcacccacccagcagctcagcacctgcgaaatccgtctcccgatgcacacttgc

SEQ ID NO: 1170 - DNA, 671 bp, Homo sapiens
ggaacacttgctaatgtctggacacagttttggttgtcacgactaggctggtgatgctggagccacaacaaccaccggaaaccccaaggcgaagaccagagaatcccagagatgcagacagagacttcctagagctacagagtaagccaaattggagttgccttttctggacgtcttgttaagtctgatggggttcatcacatctgagccaggactggcttttcttggctgcaagctgaaagttgggtccaggtctgctgtactgagggtctcctatcttccttggacagggacaaccagaggcctatttatctcatgatggaaggcaggagaacaagcaggcaagaccagctgtgctagcacatgccacctctttgcccacgtcacacctgctgacgtcccattggccaatgcaagtcacacaaccaaagccaacatcaacaggacaaggaaacagactctgcctctagatgcacaaactacagagtcacggacagaggacacggatccagggaaggaagatggagaatgagaacaatgaccctcaataacacagcctcccacagataagaaccaaacgacatccggcctttgcgttctctccaccagctcccggctcacccacccagcagctcagcacctgcgaaatccgtctcccgatgcacacttgc

SEQ ID NO: 1171 - DNA, 671 bp, Homo sapiens; identical to SEQ ID NO: 1170

SEQ ID NO: 1172 - DNA, 2017 bp, Homo sapiens
ttccaagtaactcaaatgtcccagaagaaagctcaagaggatttacagattacaaatatatccagcacccaacaaggtgaaactcacaatgtctggcacccaatcaaagagtatcagttctacaaagtagcaggcaatgcaatccataatgagggaaataagcaagcataacccacaactgaaaccgatgttaaaacgggcaggtaagtacaagttactctaattttattccacatgttcaacaaattaaatagaccctcatatatatggttaaaagatttttgacaggagtgccaaaaccattcaatggaaaaaggacagtctttttaacaaatggtgttgggagaactgaatatccacatgcaaaagaatgaatttggaccacataccacatacaaacatgaactcaaaatggatcaaagacctaagtgtaagggctaaaactataatattcttagaagacataggagaaaagtttcataacagtgggtttggtgatgatcttttggatatgacaccaacagcacaggcaacagaagaaaaaaatagataaattggaattcatcaaaattaaacttttggctaggcttggtggcccatgtctatagtttcaactacttgggaggctgaagtgggaggttcgcttgagctcgggagtttgaggctgcagtgtgcaatcactgcatctgtgaacagccactgtactccagtctgggcaacatagcaagactctgtctctaaatacattaattaaacttttgttcaaaataggacactatcaagagagtaaaaaggcaacccacaaaatgggagaaaatatttgcaaatcagatacctgatatgggtttaatatacacagtatacaaatagcttctatagtgcaacaagaaaacaacttgattaaaagaacttgattagacatttattcaaagaagatatacaaacagtcaataagcatacgaaaagatgctcaacatcactaataagtagataaatgcaaatcaaaatcacagtgagataccacttcatctacactaggataggtattattaaaaaaaacaaaacagaaaataagtattggcaaggccttggagaaatcggagtctttgtgcattgctgatgggagtataaaatggcacagccactgtagaaaacaatatggcagttcctcaaaaaattaaagaatcaccatatgattcaacaattctacacctgggtatgtacccagaagaactgaaatcaggggctgaaatagatatttttataccagtgcagcattattcacaatagcaaaaaggtgaaagcaacccaaatgtccattgatggatgaataaacaaaatatgacagactataatatagccttacaaaaggagtttgtttttttttttttaattgagatggagtcttgctctgtcctctgtcggccaggctggagtgcagtggctcgatcttggctcactgcaacctctgcttcctgggttcaagtgattcttgtgcctcagcctcccgagtagctgggattacaggcacatgccaccacacctggctaatttttgtatttttggttgagaccgggtggtctccgccacgttggccaggctggtttcgaacccctgacctcaggtgatccagctgccttggcctccagaatgctgggattacaggtgtgagccaccatgcctggctggagtgagattctgacacagctacaacatgggtcaacctggaagacgttatgttaagtataataaggcaggcaaaaagggcaaatattgtaggattccacttatatgaggcacttagagtagtgaaattcagagacaaaaagtagaatggtggttaccaggggttgggggagcggagaatggagagttaatgtgtaatgagtatacagtttcactttttttttgtttgttttgttttgtttttttttttttccccaaggcagaagaatttttcttagtgcagaacaaaatgaaaagtctcccatgtctacttctttctacacagacacgg

SEQ ID NO: 1173 - DNA, 2017 bp, Homo sapiens; identical to SEQ ID NO: 1172

SEQ ID NO: 1174 - DNA, 860 bp, Homo sapiens
ctctctctctctctctcaataaatggccaaagggattagtacttttacctttggaggtcctcaaagcattatttggagttcataatacttcagctagaacttattccttcaaatttaactctgtacccattaaaagtggttttgtgtgcaattaacagacacatgttctacccatacattgttttccaaaattattgtgtggctttaaaaaaaaaaaaacccacacaacaaattgcaaaaggcactgagataacatctgcttctagatcattgctaggctcgaaaaataaagcttgttctaccaggaatgacaagttagaacttagtatttgccaaagcagaaattatatagtgtcagttatttcaggcaaaccttattcggctctcatccccaactatctgtcagaacaattaaaagagatcaaaacagtccagcataactaggcttcattatataagcaaaagtctgaaacctaggctgggaaccatgtaacccaggccaagaaggtactttaaagtgtcttagagttgtttttcaacttagggggaaacaacagattccattaaatcccataaaggatttttttgtgtgtgaaaaagggcctgatgtaatctaggttagactcaggaggctttaacaagttttgtcttacgggtaaatggtggctattttcacagataacatcattactcccatcccttactatggtttatacaaaagaggctggagaataagtacatttttacagccgggtgtggtggctaacgcctgtaatcctacttagcactttgcgaggccaagacaggaggatctcttgagcccaggagttcgagaccagcctgggcaacacagggagacc

SEQ ID NO: 1175 - DNA, 860 bp, Homo sapiens; identical to SEQ ID NO: 1174

SEQ ID NO: 1176 - DNA, 4439 bp, Homo sapiens
taattttttgcatttttagtagagacggggtttcaccgtgttagccaggatggtctcgatcgcctgaccttgtaatccgcctgcctcagcctcccaaagtgctggggttacaggcgtgagccaccgcgcccggccgagacactctttaaattggcattcatggctctgtagactcctacataattgtttctttcctctgttatttactcacctattctatcagagaagctgattcacatttctgccacaatacattgtgcagcaaattcatggaaatgtgctcctttcttttctgaattaaactcaatttgaaaatcccaaccttctctatgaagcatccttagcaatcccagcccaccagactcatctcttttatctatgtggaaagtaacagagtaatcattatttatgggattcatttgacattattgctgactgccttattttgcagtctccttggtatgtattttcaatgtgctccgtattttcactgttcacacacagaggtcatcttgtgttgcttaggtagtagcatagggctcccatgcataacacaatgcctacatgtgacaggtgcacttggtaagtgttttgattgactaatgtgcacctctctcttcactgggtttcctcttgccatcctgcccttcatattattttgaatcctccaacctagatattaaatagacccttcccctgaactccacccagatattcctgcttctattcatcccagagattccaaattgtaatgtctgtctttgccctgaataccagcacaagccatcaaagtaatattgtgtatttggctgtacacgtgggcatttgtgtctaagaaaatatcataaagcactgatctactattacagcctccatggtttcagagaaacgaattcactgccttgcacctccatctacctcattcatgtaattgttgtttctgttggataaaccctcatgactcttctagctctaaaacacataatattttatgaataactgtgtataggtaatatttcttgagtattaactttctgctaaatttcatcatataaaatacagcagtccatgaagtaggtgctcttattattcccatttttaagattagaaaattgaaaaagagaggttaagtaacttgcccatggtcggggagttaataagcatcagaggtgagcttcaaacccaggcagaatgatgccttaagcactgggaacactattccactgcaaggaaataccagactgagcatttcaatctattccttttcaatactgacttctcaactgcagtggagaaaatgtaattaaataatatccaaattagaaattatttaatgtgactttaaaatgcttttaactagaaggatgagtggggcagggcttactcgatgccccaggagttttctttctttgcaaaggtaacttctgttgcttaaaatagatgattgcaacatattccagattgtcaagtgaggcttgcttccttttctctggctgttaggctttcagtcagacaagggtatgcgttccaaagaaggtgtacaatctccataaagaaagtgatgttgtaaaatacatattaaagatatttatgggttccaaccaaaggctccttggctggtggtttggattgatttcgaggtgcggctgatggaagcccttcttagatgttcccagaactggtgtggtttggcgccctaatggcctaagttcaacaaggcaccggagtcagagcacagaatgcagatttcctggtcctgcaaatgatggcccccaaccttttgccttaggaagcctttattcaacacaaataacccttattgtgcattgaggatgaacataatgcaaattaaaaatagacaacgtatacagaatgataaatgtaaatgcaaacgcaatgtctgtattctttaattgcaatttttcctgatacccagccatattatgtgtattcactgaatagcaagaaagaaaataatactgaacataaaatgccctagttggaattttttatatctgtgtgtccccacaaaataaacatctttatgttcacaatattttgtttgataaagctaaaatgttctaacactaaaaactgctctctaatctaatgataaataaccacaagtccagggaataattaaatatacaaaaaaaagatccaagtctgcgctcgcatcagtaaaaggatggcaattaaagtaagtgatagctataattacgcacacataactatatttcaacaaatgaacaaacagataattatttctgggaagcagaggtagcatgcagatactggcattcaaaagagaaatgtttcctagaaaataacactgtttctgattcaattagaactttaagttattttaaacatttattttcatcttgtgcccttatttagaaagtgcattggctgcactttgtaagttatgaacctgtactaataattgctttaagagttatcatgctcatgtatacatcacattctgcacatgtgtaatgtttgttcaatttctataatactgacgaggcagtttttctgactctgccctctgtatgggatttactggttcctccgtaacaaacaacattgtttcaatcagcaaatgcttactcagggcctaagtataaagggtattgtgctggatgttttaaaaatcatggggaaagttccaggcccccagaaattcatggcgctcacaagagtagatcagcataaatgtgtcaagttgctttgaaagattgaatttccaattgaaataattttccttttgcacgcataactcttgagattttcaagtggtttttacttaatgacagcatagaaccaactttattttaaaaattgtaagtgtgttaagggagaacacagaaatctgtgttgcaggctttggccgtacacactatgtgttacatgctgaagtttagaaccctgatactcctaaagaatttatattattaatttcatggatcctatttcacaaacatctccattttggtctagagggtttctgcttgtttccttggtttttggttatgttttgatatttagagtatgacttgccgtttttattattattattattaagttttttaggatcatttccgaagctgtagtttttgccttttgcctcaaaacacagaaaacttaaatattttggtgaagagaagttccctttctccatctctttcttcctccttttttttttaaattgcagaattgtaacaaccacacaaataaaataaagaaatagaacactggcagctctgcggaagctcctgtagtcatctctccaaatcgctactggccttcccctccaaatgaaattgccatcctcactttgtggcagtccgttctccgagcacctcttccttttcaggcgggcttcatccatgtgctagttcagcctgtgagatgctggtgagcccacctccaggcactcacggactccccacccattgagtgtggcctggatttagtgactcaatcaaacgtgacagagtgctggggtgtcattttcaagactgggttatgtgaagactgcagcctccatctggggtgctctctcttggattgcttgctcagggatgtggggagagctgctgtgctgggaggctgcccatgtgagttgacttggatgtgaaccttctgtggcctgccaatagccacgtgagtgaccttgaaaatggatcagccttcactcaagtctcaagatgactgtggtcttggctgacagcttgattgctgtctcatgggggaccttaaaccaaaggcaccctgctaagccacacacagcttcctggcccacagaaactatgaaataataaccatttcttatataagcctccaagttttgggagtaatattttgcacagtgatggatcactaatacaagccagtcatcagttgaaagacactgaatttatttccagttttatgtgattatgaataatgtcaccatatgcatttgcatacaggtgtttgtgtggacactgctgtcatttctcttgggaagatactgaggagtcagattgctggatcccgtgaagaatgtgcacctgggattggctcttgcttcctaaggaacctcaaaaaagctgcaacctattggagacttttgattcagcatcaaggatatgcgtgagactttggttcttttctgttgggacacagttgattctgactgtcttaaagttaggcttttctaaagatttagactaataaattatttgaatgggacaacacacatcatttgctttattatactttaaatatggcagaacggtgtattaccaccccaatcccaatcaccggtacctccataggcagagatgttatccttattttgctgaagaaggaattagggttactcagagtcatgcagttggaaagagatagaatggaactttaacctgtatgttctgattattattcagtct

SEQ ID NO: 1177 - DNA, 10678 bp, Homo sapiens
ctccttaccccagctgcctggctgccctcagcttcccaaagctcaaataagaggggccggcggcgcggggaagaggaggagccaggaggctcggccgctccattcactcagcagcccaagcccggccaggcagcgcgcgctgctccttgggggcgccctcgcagctggggtgagggcgggtccgagggagcgtccctctcggagacaccctcctcttcaacccaacacgcgctctcagctggccggtgtggcacaaccctccccccacctccccttcttggccttcgccagtgtgggagcctcgtctcactggagagtccgttcagcttgcattgcataaacgttgtcgccattaaattctggctgcggacccgaagtgtgtgcgggcccaggacttactcgaagggcgcacttcttgggaatgcgcatcccgtaggcgcaggagaccctgagggtaaagatgcggcacttgagccctccgcttgcctcccaggccacctttgctgcttgactttgcgtcgtctccactcagaagcttttaaaattattattaagaaaagaaagattctacaagacactgcccccacgctctctgctcagtcctctcccacacgatctatccctaaacctttcgcggggctcgcgcgtttggttttttgagtggagaaaggactctcgagacaaaattcactgccagttgccctaagaaccccccagatccctgtatctcccttccttctccccgcctattatttctacttggaagtcgtttttcttaactaggactcaactgtgaggggcgaggagccctttatgaaaagccggggactttcatttccaaacgaaaagattgagattgtttcttcttttaccatccttggcacttttagcggggggagaggaggttatctgaagggaggctggcttgaatgtgagtcgttgtgtttgtgaaacccaggtaaggcaaagacacgtaaatctctgccaacatttttcaaaaataagtttttgccccggggtgagggatgtaggggtggataggaggaaaggagagccaagcaaatgtagaactcctctctcctctgccatttattttctcagaatccttgtgggggcggggaggggaagagcaccggtgcgaaccccggggtgccccctcgcccgacttggacttctccgactaaagaggtgggaggagttccctgcagcctgcggggccaagaagaaagtgctaagctgaggagccgcagtcggaggaccccagggacccgacaggaagtctccgtacgaccccaacggatccacatgcccggaagcccaggcgacactaagccagcgctggggaactgacgtactcctgcagtcgcagggcgctccatgcctctctgtcctcttctttgttgtgggtaacgttctctgcgggagacctgaggttttccaagggggacatgccagctacactggccttggcgccctgagctaagcaccaggactcacagcctagcacgaaggcaggtagcaccttcacccgccgcggacgataggcgctctcctgtacctcctttagctcgcgaggcccgcccttcgcgaggtcccagagaaaagcaggctgtggaaaactgggcgcccccttctttcacccaccttcttacccctgtcagcgccgagatctgtagcagaggttcctggtctgaaccaccgattggcaaagaaagctgcagattaaacttctcgttttacagagaaggaaactgaggcccagacagccgaaggagaggcagtctatggagcgcagcggtaaagagcaaggggttggtggccccagaatggaacctcagctctgccagagctaatgggatgcagaggcgaggacagcccctggaaaaccatgtggcgttgatacactggcaaagcgcaggcatcccggcctcgaaggtgcataattattgcaatatgaaaaaatcgaggctgggtaggagcagggcagtgaggatttctcaacccttactttcaccccggcgctgtccactgcatctgacagagcgcggagctgggctgctacagccgcaaccccagggaccagtgcgcacgcctgggccgccctccgggagtcacccagcggccgcggacaactgaataaacaccccaaagcgctgcggtcggtcaagggcggggacagccacactgcgcgcggggcccgcaggccgtaataaagagtggctcgacctcgctgctgcctgtcgcgggagaggaacaagctttcgactagcgcctctccccggggcccgcgccccgagccccacgcgcaagacagcccaacagctgttcctcccctccccgccgactccaactcttcggaatctgcccactcggggctgcagggcaagtgtttaggatggttcccagccccgcgctggcggtgaaaatttcaacgtcattccttcaattaaaaaaaggggggggcaagggaggggctttgtgataactactcccagcttcttctgatcatttcaaaattaagtcgattttttttaaccagtccccacttactgtcctaactctcctcgctgaccctatctgggagcccggaaccgttaggtactgccgaatgcggtgcaaaatttccccctctcccccagttcgcagtgcctggagccgctggggttactcgtctgttctgatgccaccgcgagatggtccccgagctccccgagagtcctcagtgaaaggattccgcggcactgcctctattattataccgtaaatctttttaaattctggaactaattatatagaggatatgtctcaatttgttctgcattaatgccacagtggggatggaggccaggccgtggccagagcagatacgtaggcccatgaaattgatgaactgagagttgcttccagtcctgagcgcaccatctggaattccagtctgaggttacaattagaactcctgaccccagattcaactttgcaaacaacaggggaaaaaaatggggaaaagaaaaaccacgagagagggaaaaaaaattattctgcacctgtaaaaaaaaaaaaaaaaaaaaaaaaaaaaaaaaagtcacacaatcttaaaatctttccgtcttagacaattctttccaagtatttcttttgtgttttttaacctataaaagataatggaatgttttatagactggattttatctcatcccctttccctctcccaactgccctcagtttaatagttgtcagttttacctcagtgttgaatttaattatataggaacaaaatattcctcagtaaatttgcttgctaaatattctgtcacatttacttcccctttgagaaatggcttaattatagaaatctacctgcatctaggaattttttttcccttttcttttttgaccgccattccagcttaatcgtaagcagagattttatttgtgcagtaattttatttgtgttctaaattcgtttagccaatttcttccttctttctttagtaacaccctgctttattttcctctcactttgaccccctgaagaaaacgaaggaccaagcagtactggagaatctgttaaatttattagcataaatgcttagacaaaacgagatataaatcattcagatgtattaagccataaagtatcccaatgaagtcagtcccttgccagggtcctggtgtataaatgttcatataaaacaaggtatcagtattatctttcaaactgaatatatgttgtaaaaatatccaaggttgagttaggaatatggggggagggtgcagcagggcaggaaggggatattctttagaccagtttgttaacatagtggtggctcagaaagtatggtggaaaggaaaaatttcaaccgtttacatttggagtcttcttagataatatgtttttaaataacggtatgcaggatatatttgagagcaaaggaataagagaaaaaaaagatgactagagggagaaaggcattgatttctgtagaatgcatttgtcccccaaagatcagtttagcttcacaaaaatccacccagaggaggcactggctcttcacacagataacggattatccagtagagaagagctacctgggccttcgtctggcaactgggatatgcagccgctggtcagcagagggatgtgtattcattagcggtggaagacgaggaaagcgcccgggagtgaggaagaggaatggacagaattcctggcagaagcttaccaagacaaaaatcagacacaatgtttaagcagcaattgctcgtgaagttcataaccatggctctctgtaaatcttggcaaattgggacattctttgctttttggaaatgattgttttcaagactttttttaaaaaatcaagttgtccaccagaaaaatggaatagctcaccttccccatcttttttttaaagcagggatatcctcatcctttccgtgccattcattctttcattcattcactcaccgtgcaacaaagattgttgggcattgtagcagcaagtaggagcacagggtaatgacaggctcaccccgctctcacagtttatattccagtaggtatgacagatacattacaaggaaacaatgagatattttcatatagtagtaattgctataaaagaacaaggagatctgtaagactagagaatgactaaaggtgagatgggaatgaggagcaacagatagccctcacttccttttgctttctgcccacactaccacattttagtgtgtttaggaagtattccaccttacagtccagatgcaggaagggtttgaaggatttggaatggttggtctggataaatctctgcctacaaaactggactttatgaaagcggcagggcagctgtttatatagctggcttaaaatcatcaccactagctgagtgactctgaaagctatttaacccctgagaaattcagttttcttctcttcaagataaaaaataacagcaagttatgaggactacataaggtaaggcatgtaaatttcttagcctttaggaagcactcaatacatgttggctattatctatatagacataaattctatgctttgcttccaattaattgataagttataggcttagtattgatattggtgtgaattcagaaaaggtggaagtctttgttcttgttggatcagggtgaagagcaggaagagaaacctttgctgaatctgaccttaaacaaggttgttgccatctagaaggaaatttaaatgattttgccctacaccaggaccctaaaacaggaaatatgtggcttttgcctcaaaatcaagcttaggttccttcttttagtacagaagtctataggttaacaacctgaaaatcttagaattgcattgaaaatcttagaattgcattgttccttagagccacatttcaggtttgcagccttgtccaggataaagaattctggggtaggtataaaaacacctgaactcaaatcctatctctatcagttactgtgatcttagggaaatagcttcagctctcagtttttcagtagctttatgtgtaaaatggagattatataaaatgaaataaagcatccataggtgatttgaaaactctgaagtgtcagacagtgcagaagaccatcataacattgttacatgtgaacatgtggaaaggaatatgtctattcagaacactggggcacattgcttgctctcatggttcttcatttttaagtgagtatagtacctttcatgcagggctattgtgataagtaagtgagatcatatatataaactttcaaaacaatgcatagcatagaatgtgtgctatgtaagcatcactgctacggttattgttactgttctctggccatcttgttgggccaagtgttgaaccttataattttcacatagagagcttcttactgtagaagtttataatagtatagagagcaaggctttgggatcagatgactggggtttaaagcctcctcgctagttattttctgtatggctttgggtggcttccttattttctctgagctttaattttcataaccttaaaacagggctaatgataccatcacctcacagggttgttttgagaacaaattaaaacaccatatgtaaattgctttcgtggcacctggcatgtagtaagaaatcaataactggtagttattaaacctacaattcttctaatcagacaatattagctatgacttaaaacaggtgagcctgcaagagcttgaattacagcatgattctgaacaaacacagaaagtaatttctatcttcttttaaactcacctgtactacactgaaatctcactctttcacatatgaaagactttgcaaccaaggcactgacaaggatttcctttttgactatgaacgctttaggttaaaattctgaatctcatttatttttaatgggtttctttgcaaaatacccagcgtatgtcaaggacattggtaatcccatgttcttcaaaataagcaggaaattgatttcagccaatggggagaaaaagtagtttgatcctcttcctggagttaccacatagcatttattaatagctctgtaaacggtctggaacacagtatcagcttgctgttcaaaatatgacaaaagtttatgcaaagttgcttaggaaaaacaagatctagtcattagaaatctgacactggtcaatagtacatttattccaagtctccataaatcacaaacaaatgaaacttctattgtgatcactgttccagatctaaaagaccctcccccttactttggtagaaattaaatacattttagaaagcccaatattttttcctctacaaatagaggctaattacaaaatttcccaagaaataataaatattaaactataatcaacagatgtgacacaagatgaataagaagcacataacttagctttcattccttatgtagggcgcatgtttatctttaattatccccaacctgggaatggcataaatgttatctgttttatttattatttgtatctagagtgacatcacattttgattttgcccaggacagtctcagcttaagctgttgtcccagcttaattattaattactctccttttactccaaagtattctacttttgatggtaaataaggacttcacttgcttaaaattttattttattaaaaaaatgatagatttaagaaagccattggaacaagggtaaaagataggctaaatggggctaatgagaagaaaaaaattgaattaatattagaatcaaaggatgcagatagttactataattgagcataatgcaattctgaacttcctgacagccaagtaagaaaggggaaaatagcactagttacctatctttcgtgatgcaataaagggaagaaacctagtttttcagaagagatgaattttttctagtactaaactcaaagaggaacttaccatactagcctttctataagagttatcaggtaacggttagcgacttcaaaaataatgtttcaaaagatgcaacgacattttctggtagtttatttcaacccaatgtccacagcattaaaattatggttctgtaaactgtaagaggagagaggcaataatatagtccctttttgtagttttctggaggatctgacctgatcaaatcaacctgatttgttaatttttagaatgtgcctaatgggtttttttttatttttattttttattttttttgaggcagaatcttgctctgtcacccaggttggagtgcagtgaccccatctcggctcactacaacctccgctacccgagttcaagcgattctcttgcctcagcctcccaagtagcggggattacaggcacccaccaccccgcctggctagtttttgtatttttaatagagacagggtttcaccatgttggtcaggctggtcttaaactcctgacttcaggtgatccacccgccttggcctcccaaagtctgggattacagccgtgagccaccacgcccgaccccgtaattttttaaaagcatcttttattcgttaatcatcagttaacttgaacccgaatccaaacgctgcgaaagacctgaccattgttctccagaatctgcgaacgatttggtgagagctctagggcagtggttgttctcaactgagatgatttgcaacccagcagacgtctggcaatgtctagagatattttttgtcacgacttacagtaagacaggatcactagatgcacagtcctggtatctagtgagtagaggccagggatgctgttaaacattctataatgcacaggacagaccccccagaacaaagaattatccagcctaaaatgtcaatagtgccgagactgagaaactgtgccccagggtactgttagaagaagggatggagggccaggcgcggtggctcacgcctgtaatcgcagcactgtgggaggtcaggcgggcggatcacgaggtcaggagatcaagaccatcctgattaacacggtgaaaccccgtctctactaaaaaatacaaaaaattagccgggagtggtggcgggcgcctgtagtcctagctgcttgggaggctgaggcaggagaatggcgtgaacccagcaggcggagcttgcagtgagctgagatcgcgccactgcactccagcctgggcaacagagtgaggatctgtctctaaataaatatataaataaaagaagggatggagacatagtttttagctggagtcaaaagaaaaaatcctcatggggaaggggagcttgggctagattccttcatcccacccagtggagctggaggatgtctctccccaagctcagcaaatgtcaggaaaaaaatacaagaagaggcaatcatgtggaaatgcagtccacaaagggaattgtggataaactcatttaaccagaaaggaggaagaatccatgtagagcaataagaaagaaagccagatagcacagcacatgcaaatttagggcaaagagtttctgttttgatgttatgctccaatatcactaaatattgctggtattttttaaagccacacaaatcaagggcagcataaacttttatgttcccagagttcatctttggaatactggcttatagtgtatatgtggatatgcacatattttgcttcctctcctccacatcgttttttaccacttacataatagggattccttggaactcagttttatatcacattaaatttaaaaatgggtgcctactcaaaaagacaacctatcaaggcacagaaaattctgaaccactgctgtaatgaatacatcattggaatctccattaagaaatattattctgacctagttctctgtgtcatgctgcagattgtccttctcttgactcatggaatgctttgtgagaaagaactacaaagccgggtccctcgatattagccatctcacccttcaaagttcagccaggagtgggacaaaaccctcgtcaccatgttgacatgtttacttctggcgcaggaaaatactgctgttgcccaatttggtttcccagtccattcacttgcctggagacatatattttatgctttcctttgatgatttacaaataaattaacgtgattcactaaggtctgccagcatatatgcgttactggagaaatctgagatgttgaaaaagtattttaatttattgtatcccaatactttcttaagaaagtttcttaagaaccaaataaatatcatcagctagtttatatacctgacatatttattacggtattcccgctgagcacttcccattgtcatgtgttctcacacattgttttcacaaattgtgttttgaaagaagtcaagggaaattcaggccagagaagcaagatgttatcttttggaaaggatgagcccactctaatggaagaggataatccattcagaggtttgtgaggccaatatcccccagtgggtgtgataaatccacagcgtctgaatccagaattttgcactgggaccttgaagttgcatgaacaatttagtcatgttccaaataaacacagtgtatcattattattattggataaacatgaacatctgttaggtcaagtttgccctatttccttaaaggcaactggagtccctgaacacagttctcatatgtctatcacaaatggatctgagatgggtgtataatgccaaagcggctccttgaccatctctgtgtttggaaaccagattttaaaaagaaaaaaaaaagtcacctgctcatctgaggtgggtcacatgcctagagagcaccatagagactgcagttcccttctgaatcccatcaacagagctactgtcaaaagatgaaaatatttgaatcagctggccttcttcatttttaaagcaatgttgtacatattttaagcaattatttggggcgagaggactctaattgacaccattctcttgtcctaactcagcctggcacctttccagctgtcactcagtgggcacaggatatggaggatgatttctcaccaggctgaatcagcaggttgcagcaggttacaactgcaagggactttacaaagcttctaatcctacccctcatttttcagataagacattattgatacgatctgcccaagatcatgcacttagttagtggcagagctttacccaaggccaggaaataaaatctgtctttctggaacagcattcattggtttgcacttaccgagtaccttttacag

SEQ ID NO: 1178 - DNA, 9901 bp, Homo sapiens
ccttaccccagctgcctggctgccctcagcttcccaaagctcaaataagaggggccggcggcgcggggaagaggaggagccaggaggctcggccgctccattcactcagcagcccaagcccggccaggcagcgcgcgctgctccttgggggcgccctcgcagctggggtgagggcgggtccgagggagcgtccctctcggagacaccctcctcttcaacccaacacgcgctctcagctggccggtgtggcacaaccctccccccacctccccttcttggccttcgccagtgtgggagcctcgtctcactggagagtccgttcagaatccttgtgggggcggggaggggaagagcaccggtgcgaaccccggggtgccccctcgcccgacttggacttctccgactaaagaggtgggaggagttccctgcagcctgcggggccaagaagaaagtgctaagctgaggagccgcagtcggaggaccccagggacccgacaggaagtctccgtacgaccccaacggatccacatgcccggaagcccaggcgacactaagccagcgctggggaactgacgtactcctgcagtcgcagggcgctccatgcctctctgtcctcttctttgttgtgggtaacgttctctgcgggagacctgaggttttccaagggggacatgccagctacactggccttggcgccctgagctaagcaccaggactcacagcctagcacgaaggcaggtagcaccttcacccgccgcggacgataggcgctctcctgtacctcctttagctcgcgaggcccgcccttcgcgaggtcccagagaaaagcaggctgtggaaaactgggcgcccccttctttcacccaccttcttacccctgtcagcgccgagatctgtagcagaggttcctggtctgaaccaccgattggcaaagaaagctgcagattaaacttctcgttttacagagaaggaaactgaggcccagacagccgaaggagaggcagtctatggagcgcagcggtaaagagcaaggggttggtggccccagaatggaacctcagctctgccagagctaatgggatgcagaggcgaggacagcccctggaaaaccatgtggcgttgatacactggcaaagcgcaggcatcccggcctcgaaggtgcataattattgcaatatgaaaaaatcgaggctgggtaggagcagggcagtgaggatttctcaacccttactttcaccccggcgctgtccactgcatctgacagagcgcggagctgggctgctacagccgcaaccccagggaccagtgcgcacgcctgggccgccctccgggagtcacccagcggccgcggacaactgaataaacaccccaaagcgctgcggtcggtcaagggcggggacagccacactgcgcgcggggcccgcaggccgtaataaagagtggctcgacctcgctgctgcctgtcgcgggagaggaacaagctttcgactagcgcctctccccggggcccgcgccccgagccccacgcgcaagacagcccaacagctgttcctcccctccccgccgactccaactcttcggaatctgcccactcggggctgcagggcaagtgtttaggatggttcccagccccgcgctggcggtgaaaatttcaacgtcattccttcaattaaaaaaaggggggggcaagggaggggctttgtgataactactcccagcttcttctgatcatttcaaaattaagtcgattttttttaaccagtccccacttactgtcctaactctcctcgctgaccctatctgggagcccggaaccgttaggtactgccgaatgcggtgcaaaatttccccctctcccccagttcgcagtgcctggagccgctggggttactcgtctgttctgatgccaccgcgagatggtccccgagctccccgagagtcctcagtgaaaggattccgcggcactgcctctattattataccgtaaatctttttaaattctggaactaattatatagaggatatgtctcaatttgttctgcattaatgccacagtggggatggaggccaggccgtggccagagcagatacgtaggcccatgaaattgatgaactgagagttgcttccagtcctgagcgcaccatctggaattccagtctgaggttacaattagaactcctgaccccagattcaactttgcaaacaacaggggaaaaaaatggggaaaagaaaaaccacgagagagggaaaaaaaattattctgcacctgtaaaaaaaaaaaaaaaaaaaaaaaaaaaaaaaaagtcacacaatcttaaaatctttccgtcttagacaattctttccaagtatttcttttgtgttttttaacctataaaagataatggaatgttttatagactggattttatctcatcccctttccctctcccaactgccctcagtttaatagttgtcagttttacctcagtgttgaatttaattatataggaacaaaatattcctcagtaaatttgcttgctaaatattctgtcacatttacttcccctttgagaaatggcttaattatagaaatctacctgcatctaggaattttttttcccttttcttttttgaccgccattccagcttaatcgtaagcagagattttatttgtgcagtaattttatttgtgttctaaattcgtttagccaatttcttccttctttctttagtaacaccctgctttattttcctctcactttgaccccctgaagaaaacgaaggaccaagcagtactggagaatctgttaaatttattagcataaatgcttagacaaaacgagatataaatcattcagatgtattaagccataaagtatcccaatgaagtcagtcccttgccagggtcctggtgtataaatgttcatataaaacaaggtatcagtattatctttcaaactgaatatatgttgtaaaaatatccaaggttgagttaggaatatggggggagggtgcagcagggcaggaaggggatattctttagaccagtttgttaacatagtggtggctcagaaagtatggtggaaaggaaaaatttcaaccgtttacatttggagtcttcttagataatatgtttttaaataacggtatgcaggatatatttgagagcaaaggaataagagaaaaaaaagatgactagagggagaaaggcattgatttctgtagaatgcatttgtcccccaaagatcagtttagcttcacaaaaatccacccagaggaggcactggctcttcacacagataacggattatccagtagagaagagctacctgggccttcgtctggcaactgggatatgcagccgctggtcagcagagggatgtgtattcattagcggtggaagacgaggaaagcgcccgggagtgaggaagaggaatggacagaattcctggcagaagcttaccaagacaaaaatcagacacaatgtttaagcagcaattgctcgtgaagttcataaccatggctctctgtaaatcttggcaaattgggacattctttgctttttggaaatgattgttttcaagactttttttaaaaaatcaagttgtccaccagaaaaatggaatagctcaccttccccatcttttttttaaagcagggatatcctcatcctttccgtgccattcattctttcattcattcactcaccgtgcaacaaagattgttgggcattgtagcagcaagtaggagcacagggtaatgacaggctcaccccgctctcacagtttatattccagtaggtatgacagatacattacaaggaaacaatgagatattttcatatagtagtaattgctataaaagaacaaggagatctgtaagactagagaatgactaaaggtgagatgggaatgaggagcaacagatagccctcacttccttttgctttctgcccacactaccacattttagtgtgtttaggaagtattccaccttacagtccagatgcaggaagggtttgaaggatttggaatggttggtctggataaatctctgcctacaaaactggactttatgaaagcggcagggcagctgtttatatagctggcttaaaatcatcaccactagctgagtgactctgaaagctatttaacccctgagaaattcagttttcttctcttcaagataaaaaataacagcaagttatgaggactacataaggtaaggcatgtaaatttcttagcctttaggaagcactcaatacatgttggctattatctatatagacataaattctatgctttgcttccaattaattgataagttataggcttagtattgatattggtgtgaattcagaaaaggtggaagtctttgttcttgttggatcagggtgaagagcaggaagagaaacctttgctgaatctgaccttaaacaaggttgttgccatctagaaggaaatttaaatgattttgccctacaccaggaccctaaaacaggaaatatgtggcttttgcctcaaaatcaagcttaggttccttcttttagtacagaagtctataggttaacaacctgaaaatcttagaattgcattgaaaatcttagaattgcattgttccttagagccacatttcaggtttgcagccttgtccaggataaagaattctggggtaggtataaaaacacctgaactcaaatcctatctctatcagttactgtgatcttagggaaatagcttcagctctcagtttttcagtagctttatgtgtaaaatggagattatataaaatgaaataaagcatccataggtgatttgaaaactctgaagtgtcagacagtgcagaagaccatcataacattgttacatgtgaacatgtggaaaggaatatgtctattcagaacactggggcacattgcttgctctcatggttcttcatttttaagtgagtatagtacctttcatgcagggctattgtgataagtaagtgagatcatatatataaactttcaaaacaatgcatagcatagaatgtgtgctatgtaagcatcactgctacggttattgttactgttctctggccatcttgttgggccaagtgttgaaccttataattttcacatagagagcttcttactgtagaagtttataatagtatagagagcaaggctttgggatcagatgactggggtttaaagcctcctcgctagttattttctgtatggctttgggtggcttccttattttctctgagctttaattttcataaccttaaaacagggctaatgataccatcacctcacagggttgttttgagaacaaattaaaacaccatatgtaaattgctttcgtggcacctggcatgtagtaagaaatcaataactggtagttattaaacctacaattcttctaatcagacaatattagctatgacttaaaacaggtgagcctgcaagagcttgaattacagcatgattctgaacaaacacagaaagtaatttctatcttcttttaaactcacctgtactacactgaaatctcactctttcacatatgaaagactttgcaaccaaggcactgacaaggatttcctttttgactatgaacgctttaggttaaaattctgaatctcatttatttttaatgggtttctttgcaaaatacccagcgtatgtcaaggacattggtaatcccatgttcttcaaaataagcaggaaattgatttcagccaatggggagaaaaagtagtttgatcctcttcctggagttaccacatagcatttattaatagctctgtaaacggtctggaacacagtatcagcttgctgttcaaaatatgacaaaagtttatgcaaagttgcttaggaaaaacaagatctagtcattagaaatctgacactggtcaatagtacatttattccaagtctccataaatcacaaacaaatgaaacttctattgtgatcactgttccagatctaaaagaccctcccccttactttggtagaaattaaatacattttagaaagcccaatattttttcctctacaaatagaggctaattacaaaatttcccaagaaataataaatattaaactataatcaacagatgtgacacaagatgaataagaagcacataacttagctttcattccttatgtagggcgcatgtttatctttaattatccccaacctgggaatggcataaatgttatctgttttatttattatttgtatctagagtgacatcacattttgattttgcccaggacagtctcagcttaagctgttgtcccagcttaattattaattactctccttttactccaaagtattctacttttgatggtaaataaggacttcacttgcttaaaattttattttattaaaaaaatgatagatttaagaaagccattggaacaagggtaaaagataggctaaatggggctaatgagaagaaaaaaattgaattaatattagaatcaaaggatgcagatagttactataattgagcataatgcaattctgaacttcctgacagccaagtaagaaaggggaaaatagcactagttacctatctttcgtgatgcaataaagggaagaaacctagtttttcagaagagatgaattttttctagtactaaactcaaagaggaacttaccatactagcctttctataagagttatcaggtaacggttagcgacttcaaaaataatgtttcaaaagatgcaacgacattttctggtagtttatttcaacccaatgtccacagcattaaaattatggttctgtaaactgtaagaggagagaggcaataatatagtccctttttgtagttttctggaggatctgacctgatcaaatcaacctgatttgttaatttttagaatgtgcctaatgggtttttttttatttttattttttattttttttgaggcagaatcttgctctgtcacccaggttggagtgcagtgaccccatctcggctcactacaacctccgctacccgagttcaagcgattctcttgcctcagcctcccaagtagcggggattacaggcacccaccaccccgcctggctagtttttgtatttttaatagagacagggtttcaccatgttggtcaggctggtcttaaactcctgacttcaggtgatccacccgccttggcctcccaaagtctgggattacagccgtgagccaccacgcccgaccccgtaattttttaaaagcatcttttattcgttaatcatcagttaacttgaacccgaatccaaacgctgcgaaagacctgaccattgttctccagaatctgcgaacgatttggtgagagctctagggcagtggttgttctcaactgagatgatttgcaacccagcagacgtctggcaatgtctagagatattttttgtcacgacttacagtaagacaggatcactagatgcacagtcctggtatctagtgagtagaggccagggatgctgttaaacattctataatgcacaggacagaccccccagaacaaagaattatccagcctaaaatgtcaatagtgccgagactgagaaactgtgccccagggtactgttagaagaagggatggagggccaggcgcggtggctcacgcctgtaatcgcagcactgtgggaggtcaggcgggcggatcacgaggtcaggagatcaagaccatcctgattaacacggtgaaaccccgtctctactaaaaaatacaaaaaattagccgggagtggtggcgggcgcctgtagtcctagctgcttgggaggctgaggcaggagaatggcgtgaacccagcaggcggagcttgcagtgagctgagatcgcgccactgcactccagcctgggcaacagagtgaggatctgtctctaaataaatatataaataaaagaagggatggagacatagtttttagctggagtcaaaagaaaaaatcctcatggggaaggggagcttgggctagattccttcatcccacccagtggagctggaggatgtctctccccaagctcagcaaatgtcaggaaaaaaatacaagaagaggcaatcatgtggaaatgcagtccacaaagggaattgtggataaactcatttaaccagaaaggaggaagaatccatgtagagcaataagaaagaaagccagatagcacagcacatgcaaatttagggcaaagagtttctgttttgatgttatgctccaatatcactaaatattgctggtattttttaaagccacacaaatcaagggcagcataaacttttatgttcccagagttcatctttggaatactggcttatagtgtatatgtggatatgcacatattttgcttcctctcctccacatcgttttttaccacttacataatagggattccttggaactcagttttatatcacattaaatttaaaaatgggtgcctactcaaaaagacaacctatcaaggcacagaaaattctgaaccactgctgtaatgaatacatcattggaatctccattaagaaatattattctgacctagttctctgtgtcatgctgcagattgtccttctcttgactcatggaatgctttgtgagaaagaactacaaagccgggtccctcgatattagccatctcacccttcaaagttcagccaggagtgggacaaaaccctcgtcaccatgttgacatgtttacttctggcgcaggaaaatactgctgttgcccaatttggtttcccagtccattcacttgcctggagacatatattttatgctttcctttgatgatttacaaataaattaacgtgattcactaaggtctgccagcatatatgcgttactggagaaatctgagatgttgaaaaagtattttaatttattgtatcccaatactttcttaagaaagtttcttaagaaccaaataaatatcatcagctagtttatatacctgacatatttattacggtattcccgctgagcacttcccattgtcatgtgttctcacacattgttttcacaaattgtgttttgaaagaagtcaagggaaattcaggccagagaagcaagatgttatcttttggaaaggatgagcccactctaatggaagaggataatccattcagaggtttgtgaggccaatatcccccagtgggtgtgataaatccacagcgtctgaatccagaattttgcactgggaccttgaagttgcatgaacaatttagtcatgttccaaataaacacagtgtatcattattattattggataaacatgaacatctgttaggtcaagtttgccctatttccttaaaggcaactggagtccctgaacacagttctcatatgtctatcacaaatggatctgagatgggtgtataatgccaaagcggctccttgaccatctctgtgtttggaaaccagattttaaaaagaaaaaaaaaagtcacctgctcatctgaggtgggtcacatgcctagagagcaccatagagactgcagttcccttctgaatcccatcaacagagctactgtcaaaagatgaaaatatttgaatcagctggccttcttcatttttaaagcaatgttgtacatattttaagcaattatttggggcgagaggactctaattgacaccattctcttgtcctaactcagcctggcacctttccagctgtcactcagtgggcacaggatatggaggatgatttctcaccaggctgaatcagcaggttgcagcaggttacaactgcaagggactttacaaagcttctaatcctacccctcatttttcagataagacattattgatacgatctgcccaagatcatgcacttagttagtggcagagctttacccaaggccaggaaataaaatctgtctttctggaacagcattcattggtttgcacttaccgagtaccttttacag

SEQ ID NO: 1179 - DNA, 10532 bp, Homo sapiens
ccttaccccagctgcctggctgccctcagcttcccaaagctcaaataagaggggccggcggcgcggggaagaggaggagccaggaggctcggccgctccattcactcagcagcccaagcccggccaggcagcgcgcgctgctccttgggggcgccctcgcagctggggtgagggcgggtccgagggagcgtccctctcggagacaccctcctcttcaacccaacacgcgctctcagctggccggtgtggcacaaccctccccccacctccccttcttggccttcgccagtgtgggagcctcgtctcactggagagtccgttcaggcaaggagaagaaccgggggccggagcggagcgtgtttcagaggtgcgtataaaatcccaggggcgccaggaggcagcagcgacggcgcagcgtgggacggccaggcgcgacgggagggaagcaaccggttgcagtccggcctcctgtacctggctggcccgggctggggctgcaagctttccagccaaacttatgtgaagcaaagtagttgcagtttgacaaagaatggcgtttcaataaatgacatagtaattttttacgctttggtttttagcttgcattgcataaacgttgtcgccattaaattctggctgcggacccgaagtgtgtgcgggcccaggacttactcgaagggcgcacttcttgggaatgcgcatcccgtaggcgcaggagaccctgagggtaaagatgcggcacttgagccctccgcttgcctcccaggccacctttgctgcttgactttgcgtcgtctccactcagaagcttttaaaattattattaagaaaagaaagattctacaagacactgcccccacgctctctgctcagtcctctcccacacgatctatccctaaacctttcgcggggctcgcgcgtttggttttttgagtggagaaaggactctcgagacaaaattcactgccagttgccctaagaaccccccagatccctgtatctcccttccttctccccgcctattatttctacttggaagtcgtttttcttaactaggactcaactgtgaggggcgaggagccctttatgaaaagccggggactttcatttccaaacgaaaagattgagattgtttcttcttttaccatccttggcacttttagcggggggagaggaggttatctgaagggaggctggcttgaatgtgagtcgttgtgtttgtgaaacccaggaggaaaggagagccaagcaaatgtagaactcctctctcctctgccatttattttctcagaatccttgtgggggcggggaggggaagagcaccggtgcgaaccccggggtgccccctcgcccgacttggacttctccgactaaagaggtgggaggagttccctgcagcctgcggggccaagaagaaagtgctaagctgaggagccgcagtcggaggaccccagggacccgacaggaagtctccgtacgaccccaacggatccacatgcccggaagcccaggcgacactaagccagcgctggggaactgacgtactcctgcagtcgcagggcgctccatgcctctctgtcctcttctttgttgtggagaaggaaactgaggcccagacagccgaaggagaggcagtctatggagcgcagcggtaaagagcaaggggttggtggccccagaatggaacctcagctctgccagagctaatgggatgcagaggcgaggacagcccctggaaaaccatgtggcgttgatacactggcaaagcgcaggcatcccggcctcgaaggtgcataattattgcaatatgaaaaaatcgaggctgggtaggagcagggcagtgaggatttctcaacccttactttcaccccggcgctgtccactgcatctgacagagcgcggagctgggctgctacagccgcaaccccagggaccagtgcgcacgcctgggccgccctccgggagtcacccagcggccgcggacaactgaataaacaccccaaagcgctgcggtcggtcaagggcggggacagccacactgcgcgcggggcccgcaggccgtaataaagagtggctcgacctcgctgctgcctgtcgcgggagaggaacaagctttcgactagcgcctctccccggggcccgcgccccgagccccacgcgcaagacagcccaacagctgttcctcccctccccgccgactccaactcttcggaatctgcccactcggggctgcagggcaagtgtttaggatggttcccagccccgcgctggcggtgaaaatttcaacgtcattccttcaattaaaaaaaggggggggcaagggaggggctttgtgataactactcccagcttcttctgatcatttcaaaattaagtcgattttttttaaccagtccccacttactgtcctaactctcctcgctgaccctatctgggagcccggaaccgttaggtactgccgaatgcggtgcaaaatttccccctctcccccagttcgcagtgcctggagccgctggggttactcgtctgttctgatgccaccgcgagatggtccccgagctccccgagagtcctcagtgaaaggattccgcggcactgcctctattattataccgtaaatctttttaaattctggaactaattatatagaggatatgtctcaatttgttctgcattaatgccacagtggggatggaggccaggccgtggccagagcagatacgtaggcccatgaaattgatgaactgagagttgcttccagtcctgagcgcaccatctggaattccagtctgaggttacaattagaactcctgaccccagattcaactttgcaaacaacaggggaaaaaaatggggaaaagaaaaaccacgagagagggaaaaaaaattattctgcacctgtaaaaaaaaaaaaaaaaaaaaaaaaaaaaaaaaagtcacacaatcttaaaatctttccgtcttagacaattctttccaagtatttcttttgtgttttttaacctataaaagataatggaatgttttatagactggattttatctcatcccctttccctctcccaactgccctcagtttaatagttgtcagttttacctcagtgttgaatttaattatataggaacaaaatattcctcagtaaatttgcttgctaaatattctgtcacatttacttcccctttgagaaatggcttaattatagaaatctacctgcatctaggaattttttttcccttttcttttttgaccgccattccagcttaatcgtaagcagagattttatttgtgcagtaattttatttgtgttctaaattcgtttagccaatttcttccttctttctttagtaacaccctgctttattttcctctcactttgaccccctgaagaaaacgaaggaccaagcagtactggagaatctgttaaatttattagcataaatgcttagacaaaacgagatataaatcattcagatgtattaagccataaagtatcccaatgaagtcagtcccttgccagggtcctggtgtataaatgttcatataaaacaaggtatcagtattatctttcaaactgaatatatgttgtaaaaatatccaaggttgagttaggaatatggggggagggtgcagcagggcaggaaggggatattctttagaccagtttgttaacatagtggtggctcagaaagtatggtggaaaggaaaaatttcaaccgtttacatttggagtcttcttagataatatgtttttaaataacggtatgcaggatatatttgagagcaaaggaataagagaaaaaaaagatgactagagggagaaaggcattgatttctgtagaatgcatttgtcccccaaagatcagtttagcttcacaaaaatccacccagaggaggcactggctcttcacacagataacggattatccagtagagaagagctacctgggccttcgtctggcaactgggatatgcagccgctggtcagcagagggatgtgtattcattagcggtggaagacgaggaaagcgcccgggagtgaggaagaggaatggacagaattcctggcagaagcttaccaagacaaaaatcagacacaatgtttaagcagcaattgctcgtgaagttcataaccatggctctctgtaaatcttggcaaattgggacattctttgctttttggaaatgattgttttcaagactttttttaaaaaatcaagttgtccaccagaaaaatggaatagctcaccttccccatcttttttttaaagcagggatatcctcatcctttccgtgccattcattctttcattcattcactcaccgtgcaacaaagattgttgggcattgtagcagcaagtaggagcacagggtaatgacaggctcaccccgctctcacagtttatattccagtaggtatgacagatacattacaaggaaacaatgagatattttcatatagtagtaattgctataaaagaacaaggagatctgtaagactagagaatgactaaaggtgagatgggaatgaggagcaacagatagccctcacttccttttgctttctgcccacactaccacattttagtgtgtttaggaagtattccaccttacagtccagatgcaggaagggtttgaaggatttggaatggttggtctggataaatctctgcctacaaaactggactttatgaaagcggcagggcagctgtttatatagctggcttaaaatcatcaccactagctgagtgactctgaaagctatttaacccctgagaaattcagttttcttctcttcaagataaaaaataacagcaagttatgaggactacataaggtaaggcatgtaaatttcttagcctttaggaagcactcaatacatgttggctattatctatatagacataaattctatgctttgcttccaattaattgataagttataggcttagtattgatattggtgtgaattcagaaaaggtggaagtctttgttcttgttggatcagggtgaagagcaggaagagaaacctttgctgaatctgaccttaaacaaggttgttgccatctagaaggaaatttaaatgattttgccctacaccaggaccctaaaacaggaaatatgtggcttttgcctcaaaatcaagcttaggttccttcttttagtacagaagtctataggttaacaacctgaaaatcttagaattgcattgaaaatcttagaattgcattgttccttagagccacatttcaggtttgcagccttgtccaggataaagaattctggggtaggtataaaaacacctgaactcaaatcctatctctatcagttactgtgatcttagggaaatagcttcagctctcagtttttcagtagctttatgtgtaaaatggagattatataaaatgaaataaagcatccataggtgatttgaaaactctgaagtgtcagacagtgcagaagaccatcataacattgttacatgtgaacatgtggaaaggaatatgtctattcagaacactggggcacattgcttgctctcatggttcttcatttttaagtgagtatagtacctttcatgcagggctattgtgataagtaagtgagatcatatatataaactttcaaaacaatgcatagcatagaatgtgtgctatgtaagcatcactgctacggttattgttactgttctctggccatcttgttgggccaagtgttgaaccttataattttcacatagagagcttcttactgtagaagtttataatagtatagagagcaaggctttgggatcagatgactggggtttaaagcctcctcgctagttattttctgtatggctttgggtggcttccttattttctctgagctttaattttcataaccttaaaacagggctaatgataccatcacctcacagggttgttttgagaacaaattaaaacaccatatgtaaattgctttcgtggcacctggcatgtagtaagaaatcaataactggtagttattaaacctacaattcttctaatcagacaatattagctatgacttaaaacaggtgagcctgcaagagcttgaattacagcatgattctgaacaaacacagaaagtaatttctatcttcttttaaactcacctgtactacactgaaatctcactctttcacatatgaaagactttgcaaccaaggcactgacaaggatttcctttttgactatgaacgctttaggttaaaattctgaatctcatttatttttaatgggtttctttgcaaaatacccagcgtatgtcaaggacattggtaatcccatgttcttcaaaataagcaggaaattgatttcagccaatggggagaaaaagtagtttgatcctcttcctggagttaccacatagcatttattaatagctctgtaaacggtctggaacacagtatcagcttgctgttcaaaatatgacaaaagtttatgcaaagttgcttaggaaaaacaagatctagtcattagaaatctgacactggtcaatagtacatttattccaagtctccataaatcacaaacaaatgaaacttctattgtgatcactgttccagatctaaaagaccctcccccttactttggtagaaattaaatacattttagaaagcccaatattttttcctctacaaatagaggctaattacaaaatttcccaagaaataataaatattaaactataatcaacagatgtgacacaagatgaataagaagcacataacttagctttcattccttatgtagggcgcatgtttatctttaattatccccaacctgggaatggcataaatgttatctgttttatttattatttgtatctagagtgacatcacattttgattttgcccaggacagtctcagcttaagctgttgtcccagcttaattattaattactctccttttactccaaagtattctacttttgatggtaaataaggacttcacttgcttaaaattttattttattaaaaaaatgatagatttaagaaagccattggaacaagggtaaaagataggctaaatggggctaatgagaagaaaaaaattgaattaatattagaatcaaaggatgcagatagttactataattgagcataatgcaattctgaacttcctgacagccaagtaagaaaggggaaaatagcactagttacctatctttcgtgatgcaataaagggaagaaacctagtttttcagaagagatgaattttttctagtactaaactcaaagaggaacttaccatactagcctttctataagagttatcaggtaacggttagcgacttcaaaaataatgtttcaaaagatgcaacgacattttctggtagtttatttcaacccaatgtccacagcattaaaattatggttctgtaaactgtaagaggagagaggcaataatatagtccctttttgtagttttctggaggatctgacctgatcaaatcaacctgatttgttaatttttagaatgtgcctaatgggtttttttttatttttattttttattttttttgaggcagaatcttgctctgtcacccaggttggagtgcagtgaccccatctcggctcactacaacctccgctacccgagttcaagcgattctcttgcctcagcctcccaagtagcggggattacaggcacccaccaccccgcctggctagtttttgtatttttaatagagacagggtttcaccatgttggtcaggctggtcttaaactcctgacttcaggtgatccacccgccttggcctcccaaagtctgggattacagccgtgagccaccacgcccgaccccgtaattttttaaaagcatcttttattcgttaatcatcagttaacttgaacccgaatccaaacgctgcgaaagacctgaccattgttctccagaatctgcgaacgatttggtgagagctctagggcagtggttgttctcaactgagatgatttgcaacccagcagacgtctggcaatgtctagagatattttttgtcacgacttacagtaagacaggatcactagatgcacagtcctggtatctagtgagtagaggccagggatgctgttaaacattctataatgcacaggacagaccccccagaacaaagaattatccagcctaaaatgtcaatagtgccgagactgagaaactgtgccccagggtactgttagaagaagggatggagggccaggcgcggtggctcacgcctgtaatcgcagcactgtgggaggtcaggcgggcggatcacgaggtcaggagatcaagaccatcctgattaacacggtgaaaccccgtctctactaaaaaatacaaaaaattagccgggagtggtggcgggcgcctgtagtcctagctgcttgggaggctgaggcaggagaatggcgtgaacccagcaggcggagcttgcagtgagctgagatcgcgccactgcactccagcctgggcaacagagtgaggatctgtctctaaataaatatataaataaaagaagggatggagacatagtttttagctggagtcaaaagaaaaaatcctcatggggaaggggagcttgggctagattccttcatcccacccagtggagctggaggatgtctctccccaagctcagcaaatgtcaggaaaaaaatacaagaagaggcaatcatgtggaaatgcagtccacaaagggaattgtggataaactcatttaaccagaaaggaggaagaatccatgtagagcaataagaaagaaagccagatagcacagcacatgcaaatttagggcaaagagtttctgttttgatgttatgctccaatatcactaaatattgctggtattttttaaagccacacaaatcaagggcagcataaacttttatgttcccagagttcatctttggaatactggcttatagtgtatatgtggatatgcacatattttgcttcctctcctccacatcgttttttaccacttacataatagggattccttggaactcagttttatatcacattaaatttaaaaatgggtgcctactcaaaaagacaacctatcaaggcacagaaaattctgaaccactgctgtaatgaatacatcattggaatctccattaagaaatattattctgacctagttctctgtgtcatgctgcagattgtccttctcttgactcatggaatgctttgtgagaaagaactacaaagccgggtccctcgatattagccatctcacccttcaaagttcagccaggagtgggacaaaaccctcgtcaccatgttgacatgtttacttctggcgcaggaaaatactgctgttgcccaatttggtttcccagtccattcacttgcctggagacatatattttatgctttcctttgatgatttacaaataaattaacgtgattcactaaggtctgccagcatatatgcgttactggagaaatctgagatgttgaaaaagtattttaatttattgtatcccaatactttcttaagaaagtttcttaagaaccaaataaatatcatcagctagtttatatacctgacatatttattacggtattcccgctgagcacttcccattgtcatgtgttctcacacattgttttcacaaattgtgttttgaaagaagtcaagggaaattcaggccagagaagcaagatgttatcttttggaaaggatgagcccactctaatggaagaggataatccattcagaggtttgtgaggccaatatcccccagtgggtgtgataaatccacagcgtctgaatccagaattttgcactgggaccttgaagttgcatgaacaatttagtcatgttccaaataaacacagtgtatcattattattattggataaacatgaacatctgttaggtcaagtttgccctatttccttaaaggcaactggagtccctgaacacagttctcatatgtctatcacaaatggatctgagatgggtgtataatgccaaagcggctccttgaccatctctgtgtttggaaaccagattttaaaaagaaaaaaaaaagtcacctgctcatctgaggtgggtcacatgcctagagagcaccatagagactgcagttcccttctgaatcccatcaacagagctactgtcaaaagatgaaaatatttgaatcagctggccttcttcatttttaaagcaatgttgtacatattttaagcaattatttggggcgagaggactctaattgacaccattctcttgtcctaactcagcctggcacctttccagctgtcactcagtgggcacaggatatggaggatgatttctcaccaggctgaatcagcaggttgcagcaggttacaactgcaagggactttacaaagcttctaatcctacccctcatttttcagataagacattattgatacgatctgcccaagatcatgcacttagttagtggcagagctttacccaaggccaggaaataaaatctgtctttctggaacagcattcattggtttgcacttaccgagtaccttttacag

SEQ ID NO: 1180 - DNA, 5585 bp, Homo sapiens
cgtcgctctcccggcggccggcggggcgcgctagtgttggggtcccgccgtcctgaggctcgagctcttgcgggtcgatcggtcggcggggcctgcgcggggcccgggcccatggcggcgtcggcggctctgtctgcggcggcggcggcggcagccctgtctggcttggcggttcggctgtcgcgctcggcggcggcccgaggctcatacggcgccttctgcaaggggctcacgcgcacgctgctcaccttcttcgacctggcctggcggctgcgcatgaacttcccctacttctacatcgtggcctcggtgatgctcaacgtccgcctgcaagtgcggatcgagtgagcgccggcggcggcggcggccgcggaggcccggctggaggggcgacagtgtccccgcccgcccccggccgggtcgcgggcatgaaggacagctggatcgcggcggggggcggaggtggggcggcccgggcccctggactctagacctacgccgcccgggcacgaaggcccagccctggccctggccgcggtctcagcccgggaccccggatcgcgcagaaatgcactgaacaggcccctacaattgggctccagaaactacctgagctcggactacctgttgcctcacattggcaaaagagggggaaaccagaaggagggaattctgctgcggcgacttgactttccccgccccgagcagaaaggcattgacgtttgtaggcggtgacccgccccttctctggccttgccaagagtctcatccctaccctggggcacctctgaccctggacctgcttgggcagaggcagcgtgaagggcctgaacaagaggagaagaagggccttcctagtagaggcacagcatggacaaaggctcacaggggtgggggtgcccagtgatcgagtcctggcttgggagggaaggtctgagttccctgggaactgaaatcggctagcagcactgtgagagaggtgtatttccccctcctaatgacagaggaaaccgaggcttcggggagggggggatttgcccttgacatgcagataggatgaggaggaactgcgtgtgcccctgggcctgcaggctcccacacccctccccagtcttctccaagacctggcatgatgggaggagggaggggaaagtgaagagggaagcatagggctcctagggcaccaagggagaggggcccaagggtagggaatctggggatctcgctttctttggagcagtacagaagatcacaggaaagattaggacagacagctgagatggcagacaggagagatgggccccaggatccctggggagccaagctttcccccacagcctagcctccccaccccacctggagcttcaccaagggcttttcagcagtgaagtggcacaaacctcccagtttggtgggcaagtggggctgatggtggtgtcatggctcctggagacacgacataaccaggagggtgaagggataaacctggggtgggctggggctgagacccatggcatgaccccaattctctctcctcaagctcgacccccccgccatccccaggatcacacaggagaatctcatcctcacggcttggattggtcctgggggcccccggttgtgctgctaactggtgtacaatgctcaagagcagcccagaggggagccaggaagggaccctcgccctcacctgctatccccatttccgcatctcttgcactggtaccctgagggccacattctcagttcctgggattgaaaactgcagcagtctggccagctccagggacagagtgatccaaccacctaccacgtaccctcctcagcaggccactggacccaggtcctgaatgaagctgtccgcctgcctcaccccagaagaggctggacagtggctgcctcgtgccccctgcagtctcccacagccagggcccgatggggtgcctccttgtcccaagtctcctgagaacccctgaccttgctggcctctctcatccgccccaaccctgtccacccttgaccacctctgggggcctgtcagcctgctggtccccccaacagatctctgggggcagcctctgtgggacaagagtgatacagagctggaggagaagaggagtgaggggcctccttgtgtctgatgcacagatgtggccctttcaaaccctggtgtcaccctctgggtgactggatccctagctccagcctcttcctgggccagccaggaagggtggaggaaagttctttgctgattgcatgtgtgatacagtggggggtgcctgagccctccccatgcaaggggctcatcctgggactctggaagctgcttccctactgggagaaatgtgtgtcggagctgcaggggtccctaccctcagagacccccgactgcagggaacccaccccataagagggtcacggatgtccatgtccgcccaccccccgtggcttctgctgtggctatattggcctagaggggctgactggggaggagcagggctaagccctcagcatttgctcctgtccctgccttttcacccctgctgcctgaagtggtagccccgcctgctgcttctctacctcccctccccacctcttctctcccctacagggcccttgctgcgtgatggggtctccatgcactttatttatttgcagtctgttttctaggcggtggagcttctagacaccgaccggaatgacatacgtttctgtgtgtgattcactgtgtactggtcagcacaggctggccagagagatgttcttgtttctggtgttgtcacgtcttcttgttttctctaagtttaaaaaaaaaaaaaagtccttggtttaatacactaaaatcccaactggaggccttccgtgtctggtgggggtgatgcaatggccccaggtggagagaggccccatggtgaggtcaccggctcccatggcaaggtcaccggctcccatggccaggagctggcagggaaaagcctctgaggagtagggctgggggaggctgtggcagggaccgtgtttcctgttcagaggctgtgctgagaaccgacttgacccagaccactgccccatgagaagcaggcagcagcctggcctggccctgagaggtggctgcttgtcctgttgacagtctctgttcaaatgacccaaaacataagtcctcttccgttttagagtctggtgatcaaaagtgcctaagtcagtagaatcctgagggtggactagggtgaagtgaactgaaacagactccacgcaggtcatttcgtgtagcgctgagacccttctccctgcctgaggtcacctcccactgcctccctaccagccaggttactgcagaaccctggagaagataaaggacctggccctagaagcctccttcccttccccagccttggaggcaaactctgtcccatcagagtccccctccttagtggctcccacaggagagagctccctaatggctgctgtaagggttggcaagcaggcaaaaggtgggagagggaaggccgaggggagtgttagaggaagatgcctaggtgagaggcatcctgaggacacagggctatgctcagactcaggagtgcagtctgagtttaggggccctgggggcactcctgttgccaagggctacccaggggtcacagcaccctgataagaacccctccaaaagcactagtgccaacatcctatggcatctgccaccacaggagaaatggaccccagtccctgagcttccctcccctttgtctagatggtcctcttcagtccctgatggtcccatccccactccagggatcacgtgacttggcaaaccaagatgggggatgatacccccagagcctggctccaaggcctcctgaagaggcccatccttgcaacagaggaagggaaggcaggaaggccggttctgctcaaatgggaccccaggagaccaaagccctgagccgtgaatccagctcttccacttactactgtatggtgccaggcaaactgcacaacctggagtttttagtaaggttcctttgggatgcttgtcagcagcgaatacaatgtctgttcaacgtttgtcatcagctctcacctggagaagccttgttactgtggggaaagggaaccaagtgaagggaacggacatccgatgagagcctgccatgtgccaggcaccattctaggtgctttgcattcctaatctcatcataatcccacaaccacctaacctttatctccattttacagagaaatcaaggacaggaaccaagtctgaaatagaaccccaagcagaatctcttttcctgagctcccagtgcccctggagaggcagggaattgggctggagtaatggtggaatggaatagcaaaggtggaagatgaccctgttctttctgggtggggtccaggaggcagataagaaatccaggtgtgcctgggtgcggtggctcatgcctgtaatcccagcactttgggaggccaaggcgggcggatcacaaggtcaggagttcaagaccagcctgaccaacatggtgaaaccccgtctctactaaaaatacaaaaattagctggacgtggtggcgcatgcctatagtcccagctacttggttggctgaggcaggagaatcgcttgaacctgggaggcagaggttgcagtgagccaagatctgggcaacacagtcagactccgtctgaaaaaaaaaaaaaaaagaaaaagaaaagaaaaatccagggcttggatgggggacagacctgggagccctctccaaatggagctccccagtgggcgcagctggggccaccctgagatgggttcacctgtcttttctccatcctccctccagagattgattgggacctaagagattgagtcaggagagggcaagagagcagctaagcaggcagttccgggggcaccagagcaaatacattaagaagtgggaaatataaagagcatgcaaaacctcatcctactcctgttcacccacccacaagggaaactgctgcgtttggacaaatttctactttgtgttggtggagggaaggagaaagaacatactactttgaaaacttctcctcccacttcatctttatctttccatgttattaggtatttttctatatccaaagccacctagtagtctcttgtgtgaaggtatcatgcatttctcatgcctcttggttgtttccctttattgtttatttggggagtttggtttcttggttgtttggtttttttctgtggttttgtttttataaacattccagtaacagataagttggacctcatcaaaattaaaaacttttgtgcataagaagtcactatcaggacagtgaaaacacaacctgcagagtgggagcaaatattttaaaatatatatctgataagagacttgtatccagaaatataaaaagaactctagctactcaacaaaaaaagacagacaacccaatcaaaatatgggcaaagagtttcaatacacatttctccaaagaagtgatacaaatggccaccaagcacataaagatgctcaatgtcattagtcattagggaaatgcaaatcaaaaccacaatgagctcacctcacccacttcac

SEQ ID NO: 1181 - DNA, 5585 bp, Homo sapiens; identical to SEQ ID NO: 1180

SEQ ID NO: 1182 - DNA, 5585 bp, Homo sapiens; identical to SEQ ID NO: 1180

SEQ ID NO: 1183 - DNA, 5585 bp, Homo sapiens; identical to SEQ ID NO: 1180

SEQ ID NO: 1184 - DNA, 5585 bp, Homo sapiens; identical to SEQ ID NO: 1180

SEQ ID NO: 1185 - DNA, 5585 bp, Homo sapiens; identical to SEQ ID NO: 1180

SEQ ID NO: 1186 - DNA, 5585 bp, Homo sapiens; identical to SEQ ID NO: 1180

SEQ ID NO: 1187 - DNA, 5585 bp, Homo sapiens; identical to SEQ ID NO: 1180

SEQ ID NO: 1188 - DNA, 5585 bp, Homo sapiens; identical to SEQ ID NO: 1180

SEQ ID NO: 1189 - DNA, 3019 bp, Homo sapiens
tttactatttgaatctagaatattcttgaagtctgaaagatggatagaaaagagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccttgaataactgggagatgaaacaggaagctctatgacacacttgatcgaatatgacagacaccgaaaatcacgactcagccccctccagcacctctacctgttgcccgccgatcacagccggaatgcagctgaaagattccctggggcctggttccaaccgcccactgtggactctgaggcctctgcatttgcgggtggtctgcctgtgatattttggtcatgggctggtctggtcggtttcccatttgtctggccagtctctatgtgtcttaatcccttgtccttcattaaaagcaaaactaaagaaaacagaattgtttgcttattagctatctttaaacgctgtttgaaaggatatcgaatagtgtttgagggaaccctggcacgtccacacagctcatctgacatgtttaaatgtgtgttgggcttgactctctcataactcagccacgcttgccttgctgcttctcatacctctccagattgctgtagagtcagtgtgggcagactgacatttgagagaaacgtcgggcttcatctggaagcctctttccacacccaccctgatcgtggcctgtaaactgtggccccaagatctccattaaccttgggctttccactagagacatctgccatctctgctgcctccctcccctcacacatcctttactgcttcacttattcatcccataaggatttcttaggggcctgctgtgtgctggttctggagacaaaacagtggatgggaccaactcagccccggtccccacccagcacctctagccaagtctgagtgggctctgctgaagaagtgttgggtgcagtgcacagttcatcatggtcgatggctccatcccatttcacttagatgccccgatttcctaaatgctttcttgaactctgacactctgggactggcacctgaacagtctataaaacggtgaaatgtcgaagcattcctgctgtgtaatcccactctcttccccaacctcaagcaggacaatttgaccccctcctgaggacatggccagacaggccattagtagaagccttccagaactttctggcaatcttcacttttaagcttagcaaacatctaagaataattttaaatggccatgtttactcttttgtacttgttggaattagtttaccaataggccatgatggtgatcacaaaaccccctatgtacatgcacagtgttcattgcaatgcatatccaggtctcaacccaatgtccctttctcaaggagaattccctgagcaccatgtcgtgagagaaccctccttcctccccaccatttctctctatcttgtgattttattttattttattcatagacttatcattatcagcacttatcctgaatgttcaattatcatctgtctgtctctcactccactcccaaaaggcagactgtggtctgtcttatttcccggtctgtccccagcgtttgagatccgagcctcatcaacaactatgtgctgactgggttcatcctcttattacttctcaggcacaccgagatgctgagcagcccagtgctctgaccatgtttggtggataaggaaactgatctgagtctggtgaatggcctcactagggtgaggacccaggctttcctctgggacatcacccagcagaaaagggtgattgtgaactctctactgtctggacagtcaggttctcatcagaaaccaagctttgccctgctgatgaacttcctaaagtttatgtaatttgcccccatcctggaagataaagaccactgtgttgtggagggaaatagcctcagctgggcgtctctggatgctactttctccagcagaacactaagaagatcagatgagatgaacacaaagattccaccctgccctgagtttctgctggttctacctggctaggttctagcagaagagaaggaagtatacaagggtaacatgtgcaagggccgtgtacaagggtaacatgggcatcagggacagtcctcctgaggatgtgaggagccaggcccaactgtgggctggcaacctgccccaggggttgctcacactcacctaactccggcccctctggacacaccccttgcccaggtgcaaggggctccactgggaagaacatctccacccaagtgatcactcttcctctgcgtttttgagcaggatgaaaccacattctctacccatttcgcagtcttacccccaggattatttatgacctcaaaaagatggaagtcacaggtgcagggaggaccagacgtaacccatatgatgcctgcaggatagttagttcacaaggatattaggagaaagagcaaaagagaagtgaccacacaattctagatggttaaggcaatagttctgaccctggccagacattagaattacccagaggttataaaaaatccagacacccaggatccacttggaccaatcacatcagaatctggggattgagggggtgtagacatcagtattttttacaactctgcaggtaatttcaatgcatagccaagactgagaaacattggtctctcaacgtaccatccaatgtggtagctgttagccacagatatctatggaacctttaaaatgtggcttgtacaaccaagggactgaatttttaaattcctttttattttaaatttaaatatccacatgtgacttgtggctgccatattggactgtgcaggtacagaacatgtctacggtcacaggaagttctactggctagtgtggtccaggggaacctggagtcctataactgccgagtgaaatcctgctgatcctgaagggactttaag

SEQ ID NO: 1190 - DNA, 3019 bp, Homo sapiens; identical to SEQ ID NO: 1189

SEQ ID NO: 1191 - DNA, 3019 bp, Homo sapiens; identical to SEQ ID NO: 1189

SEQ ID NO: 1192 - DNA, 3019 bp, Homo sapiens; identical to SEQ ID NO: 1189

SEQ ID NO: 1193 - DNA, 1906 bp, Homo sapiens
ctgggggccaagagggaggcttccagaagacaacaaaagtccatgaagaacagggcacttctcagcaaccctcaaggaagcaattgaactaaagcttgaaaaccatggggtcactgagagaaggagcctgaagagagaaaaggatgaaggacccaaaaaagactaacatttaacagatgggatgtgaaacagaaccagaggatgcggctataaaacgccatcttggaagcgagactgggctctcagcagacaccaaaccttcatctgggacttcccagcctccagaactgtacagataaagatgaaacatccaattgcagatatgaatgacctaattcaatggatgagtctggaagaggaccaagttcatgggaaagatcaaaaattcagttttgaagatgttgatgagaagatgagacaaaaccatgtatagatgcggatgagctaattaaatatatgagtctggagctgaaaggaaatgccttgacaagagaagtaaatttgaggaccatcagtatacagatgtacttgaatccatctatgtaaatgcaatcaccctgggaggaaatttagagtgagaacaggactgcgtggaaagacattaaagaagttaaagaaagaagaactaacaaaggcaggagagaagaagaggacggagaggtaggagagaaaccagtaatgtgcgatggcatagaaattaaggaagtttccaagattgaagaaggagggagagagggctatggaagtcacaggttggaggtggtgcccagagcctggaataaacatttaccctagtgttcatcagagagtgaatgaggcctgggaatccaagacttgccaaagattattctgcctggaacaggtcaaaatacagcaaaggatatgaagggacactacaagatgggaaaatgggtgcctcattgttaactgatgtggacagatgatgggtaaccacataatcttctctacgtcatttttgatactaccaaaaattctgggttcttggcatcatagcaaaactcagatgtagagagaagccccacaattagatgaagtaaaattttcctacttgaagttgaatttcactgaagtgaaatcaggtcacagagtctaaaattaagttgatctaggaaaactgaaaaaaagagtatttattccacagttgaagtgtagaaaggaattaatctatgctataatagtaatagttaaaatttattgaacttttactatatgacaagaactttgataatatgtttatttgcattgactagttcatttaattctgacagaactttttaatatacttatacatcacttaacaatgaagacacattcttagaaatgcacttttaggtaattgtgcccttgtgtgaacatcatagagtgtacatacacaaacctagatgatattgatagcaacaagaaacagacaaggcagacatggatgggtccctggtgaaactcaaccttcaagccaagaacagtctaaagcctgaaaaccaagcaacagttacagatagaattcacggaccagaatgagaacttccatttccatcttacctactctctctctattggttctttctgaatgatgccttttagccaatcaaatgctcccttttccaagcccacccataaatcaatcagcatgcgttccccccattctaagttcataaaaccctggattcagcctcatagacggctacgctctttggggtcccctcttgctgttgagagcttttctttcattcagtaaattctactctgccttaccctgcctccagtgtccacgtaccttattactcttggccacgggacaagaacccataactcactgaactatgggagcaaaagagctgtaacattcctgttcactgagccgtgggcaggaagagtaaaagagctg

SEQ ID NO: 1194 - DNA, 6456 bp, Homo sapiens
agatgcgactatgggtttgacgagtgaaatgagcaactgaggcttaagtctcgatcatggaggtttttcttttttctatttaatggaaagcaaaataggagaaaagaaaataaataaatgtaaaacatcaattgtgatggcataaatggactctaaaacaacatgaattaaaattctccctcttggaagaatggagtctccctcttgtcacccaggttggagggcagtggcatgatcttggctcactgcaacctctgcctcccgggctcaagcgattctcctgtctcagcctcctgagtagctgggactatagacatgcaccaccacacccggctaatttttgtatatttagtagagatggactttcgccatgttagccaggctggtcttgaactcctgacctgaggtgatccacccacctcggcctcccaaagtgctgggattacaggcgtgagccactgcactcggctcatttaggtttttcaagccagctttagggttcacctgggaaaaacaccagccacagacacagctgcggctgtttctccaaagagcttttcaggaggcttcctgttggcgcatttccttaagcggggccgggggcaggtaggaagaggggccagcaggcaggaaggctgaaggctgcattcctgtgagacgttcctcagtgcctaatttacactttccataaggtaaggcgaatgaccggcgagggaaagggagtaaaggaagagtcagttacacaggcgtctctgggtaggtggaggaaggagtctccgttctgtacacggaagatgagcgtgtaggggacacgatcagtgtggaatccacacacctcagcttcaggcgctggacttagactgtagacctgtagtcagcaccgaatgccctgtttatgggaggacagcagagaatttactcgtgattgatctgtggggcagccctccccagaaaccggaggcctttacctttccacggggatctggctggagcaggaagttagtaacagtaattcatttggaagaaggggctgcagtgaccttcccttttgcataagaagtttgggggtcctgagatttttataatttccctttacaggttcatattacagacaagtaactgccagaggttttggaaaaaaataagatgaaacaataataatctaataaataaacgttaatcatctattcacattttttatgtataatgatatgctattgtgattatgaaatatctgacattttctggtgcagagaatactttgagaagcattgctttaggcctagggagatacacagatatgatacagatattaatacgtaccaaactatgtaaatacatactatgcatgtgtgtgtatgtcatatatacatacatatgtgcacacatgttgtaatgtgtattgacataacttgttaaataaaaaattatcttgtctctggtgaaacatactaaatatccacgtaagttgtgacgggtttaatttcatcagtagatgagcggccgcacatggaagaactttaaaactgtcgtgacttgggtgcattgctatcactcagtaccttctagagactggaagcacgtccttcctggagcactgggccttttcgtgttggagatcttggtgattgactgtatttgcctctctgcctgtggagcccaaaacctgggttttaggctataagtttagtgtttctcaacctgactctgaagaggaagaggcagctgccatctgagttcttccttatgggcttagaagagaatgtttcaggattactatctgtccttgtgagtatgagtgtgagtgtggtgtgtgtatgtgtgtcatgtgtgtcatatgtgttgtgttttgtgcgttgtgtatggtgtgtgtggcatgtgtgttgtatgtgtggtgtgtgtatgtgtggcatgtatgttctgtgttgtgtgcctgtgtggcatgtgtgttgtgtgtgcagcatgtgtgttgtgtgtggtgtgcatgtgtggcatgtgttgtgtgcatgttgtgtgtgacgtgtgttgtgtgtgttgcatgtggcatgtttgttgtgttttgtgtgtgtggtgtgtgttgtgtgtgtctggcatgtgtatgtgttgtgtggggcaagtgtgttgtgtgtgttgtgtgcatggtatgtgtgttctgtgtgtggcatgtgtattgtgtgtggtgtgtgtgacatgtgtggtgtgtgtgtggcatctatgttgagtgtgcatgtggcatgcgtgtgtcattcacattgtgtagcatatgtgttgtgtggcatgggggttgtgatgtgtgtggcgtgtgttgtgcgcctgtgtgtggtgtgtgacatgtgtggtgtgtgctttgtgtcatgtgtgttgtgtgtgatacgtatttggtgtgtggcatgtgtggtgtgtgtggcatgtgtttggtgtgtgacgtggtgtgtgtggtgtgtgctctgtggcatgtgtgttgtgtatgtggcatgtgtggtgtgtcgtgtgttgtgtggcatgtgtggtctctggcatgtgtgttgtgcatgtgtgtggtgtgtgtggcatgtgtgtggcatgtgtagtgtgtgtgcatttggcatgtgtgtcatgtgtgttgtgtgatgtgttggctgtgtgtctggcatgtgtgttgtgtgtagtgtgtgtgtatgtgtgtgacgtgtgctgtgtggcatgtgtgttgtgtgttgtgcactgtgtggcatatgtatttgtgtggtgtgtgcggcatgtgtgtgttgtgtgcgatgtgtgctgtgtggtgtgtatgtggcatgtgtgttgtgtgtgtgacatgtgtgtgctgtgtggcatgtgtgttgtgtgtggtatgtgctgtgtggcatgtgtgttgtgtgtgtcgtgtgtgacgtgtgttgtgtcatatgtgcgtgatgtgtgtgctgtgtgggatgtatgttgtgtatgtgttgtgtgtgtggtgtgtgtttattggtgtgtgtggtgttgctgtgtggtatgttgtgtgtgttgtgtgtggtctgtgctgtgtggcatttgtgttgtgtgtgtgttgtgtgtgtgtgcagcatgtgtgttgtgcgtgtgttgtgctgtgtgctgtgtggcatgtgtgttgtgcgttgtgtgtgttgtgtgctgtgtcgcatgcgtgttgtgtgtgttgtgtgctgtgtggcatgcgtgttgtgtgtgttgtgtgctgtgtggcatgtgtgttgtgtatgtcccagttctctgtcttcaggcggttgggatcccctgtgctggccccgctgtgcaggtgcaggtgtgcagggcggggctgggagctcctggggacatggggacgcccttgaagtccgccctgtgccccgtgaggagtggggttttggggttttgggtttcgcgctgggctgcgtttctgcaggagccaggcctcttcatgctctgcggcgacagccgctggggtggggctacggggaagtcgcgctgcccctcgtctgagcgtgggccagggcccaggtggtgaccaaggcccggcgcagtggccccggagcgtggaggggcagctgctgggcggcctcccgggggagggtgacggcttcacccgccaacgctgcctccctcctgggattaggccggaggaatcttggatcgcccgaggctggtgctcagcctccttcccccatcccacctccaccacccggcgacccccgtagacttgattggcaggccctgccccgacccctacccctccaggtccccgcctcggtgcctcggtgcccggctccgggccactcctgcaggccctgcctagggcagccggcggtgcctggaggcgggctcgccccggctgctccacgcccaggccggtccctggcatttcagccagtgggagggcgtccccgccgcccccgtgcctctccgcaggggctgcgccgcgtccccgggcctctccctccgccgtggcctggtctgcctgctccagggcgcagctgcgcccgcttcagcgcctcccgggtctgcgtggcctgctcggctcagaggcctccaccacggtccgctccctgccggacgccgcgctgctgtggccgcggtggttctgtggctgtgagggccgtttctgtccgtccacaccgccttccctctgcagatttcctctgcagaggcccggagttaccagcaaggtctgacgcagcagagtgcagaaacggcctccctgtctgtcaaagtggcctcccgaggacacccagcgaggccaccagatcatcacgtggagtatcggtggccttattaaaacaaaaacaacaactccacagcccggcgagcggtatgtgtgcccaagtacataggtgattagaacagaaaggcctgggctggtcatccaagctcttccggtggccacctccgaggaaggtgggggtgtgaaggaaatgactaaggacttggagagttaagacaagcacgtgctcccaggtggtgggcatggtgagagaaagaaccaggggaggtttggggagggttcaaccaagtcagaatggggcatggtaggcggcttccaaaacggccccagtgaccctgcgatcccacccttgggggctccctgccttgtgtgtgggctgggcccagtgacggcctctggtggacaagatatggcaggagacaggaggtcgctgtgtctgtgtcacttcctacagaggcttaacgcctccttgtatttagacggctaatatacttggtcttaatccttttatgcctagcattccaataatggaaggttccaataacggaatgttctaataatggaacgctaggcatgtcggatttatatcctactgctcaaggtgatcaccaatgtctgattgctaccttaggcataaatggtttaattctaccatcttattgacttattttttatgttactattttcaacattttaataagaatttaaaaatattcagcaaaattgaaagtgttttataatttttaataaatacctctagtctatcatgaaccttttactgcacttgctttgtggcatttcttagcctctatctttttccatgcacatcagagcaaatgcagacattgtaaacatccccctaaaatctcagcatgcatattgtcatctagagttcagtatttgtttacatttttttcctttgaaggtaaatattacatgtaacaaaatgtcaaaatcttaataaaaccttctccgtgttttgacgaatgcacacctgtgaggcccaaacctttaaaaagacgacatagaggccgtcacgcggaggccgtcaccccacaaagctccctcatgggcctacccggccaatcctggcccccagcccccagaggcagccactcttgttttcatctgttttacttttccatcacaattagccttgcctgacctagaacatcatgtcaaatggggttgtggagtgtaagcattgtgtagacgtcttctgctcagcaggatgtttctgggattgagccgtgtcactgcgcgtggcaggagctcccgtctctccattgccgagtgcaggtctctccattgccgagcgccgctccagcctaggggcacagcctgtgctgtggttcatccatcctcccatgccagacctggcgctgctgcctgctttggctatgctggggggagcacagcacaggtggttcatccatcctcctacaccagacccaggctacttcccgctttggctatgctggagggagctgctgtggacattcacatgcgggtatgccatggacacatattcactcctcttggatgacattgctagaaaggcgtgtgctgggcactcaggcgagtgtatccttaacattttcaaaagttgctggaattttttctccccaatagttgcaccatttcacatgcctagcaaataggtaacaatttcaggggaggagagagtgagggggtggtgagagattggtcaagggtatgaagctgtggctggatggcaggaataagttcaggtgttccattccctagcagggtgactagagttagcaatggtgtattactgctcacttcaaaattgctggaagacgttttggaatcttctcatcatcaagaggtgattagtgtttaggatgatagatatactgatttccttgatgtggtcattacatgatttatacacatgcggaatcatcatgccgtactctgtaacgtgtgcctcacatcctcagcaacacctggtgttgtgggtctttttaaggtttagatattctgagaggcgtgtggtgatttcatactgtggatttaattggtgtgtccctgatagctgatcatgttacacgtttccttgtgctgacgactggccatatctttctctcctaagtaaatgttcaattttttaaaaattatgttatctttctaatatgcagttggatgatttctctatatatcctggaaactagtgctttgttagacacatgcttttcagatattttatctttctc

SEQ ID NO: 1195 - DNA, 32743 bp, Homo sapiens
ggctttataaggctaagtttcctagcacaagttctctttgcctgctgcaatccatgtaagatgtgacttgttcctccttgccttctgccatgattgtgaggcctccacagccatgcggaactgttgaaatacacactacctgaagctggataactcatgaactctgttgacaattatattctttgtctttttaattaactcatttggagttggtgtcctgaggacctaagcctaagaatcttcaagatggaagagtagagtgaacaatgaatgagccagagggctcttgtcctctgtgtgcagctctgggcagccagcaggtggatatgggacttggcctgctggaggggccctggcaagaggagctggcaggagcagatggcaaagatgcacatgaaatttggtgccgtgactcggattgggggacctcccttgggagatcaatcccctgtactcctgttctttgctccgtgagaaagatccacctatgaccctcaggtcctcagaccgactagcccaaggaacatctcaccaattttaaatcaggtggagtctcgcactgtcatcctggctggaatgcagtggtgcaagccgactcactgcaacctctgcctcttgggttcaagtgattctcctgcttcagcctcctgatttgctgggattgcagagcaaaccagtgaaaaaatggccttcgcactcctgagagacctttcaccgggctttctacttttgaattctctccatagctggtttcctcttaggcctcgatagagcagtccctgaatcacacaggtatgctgactacgtcttttcctggtacaaaccatcatgggggaaacacacagcaagaagcatcttcaggtcacaagatagactttgggaatcacccaactgatggaaagaaccaggaaaggggtcaggatctgcaccttggcaaactttgaagaacacccaatttgatgaatgaaaactcctcacttgtgctctggtggtgttttaggacaatgggcccctcctgggtaatagttattgatgcagtctctatcagtaaccaccccaagtttgagatcctttacaagggaaggtcatatttccaaaactgaaaccttgaccaagtatcccagagagataggaaggagataccactcaagtgtgtcatgggcctgtcccagggcctgggagtcagcagttggtggcctgggatccaagggttaacagcatgacctgttctggctggcaccagtcacatggtgtgcccaacctcactgttattatctgtttcgggtgagtcactgagaacacagacaggaaagacccatgaacttagctagtttcgccccagggtgtgagactccacacaactgagtctgggccactggcagtgactcatggcgggcctcatgggattgctgacgcaaggttggaagggcacgtggttcttccccccaccgctgggtagaatccccgccaaaacatccaggctggaaatccatcttggtccttggggagagagaaaataaaaaagaatcatttctgatactatagcaaagtatacaggtggatttggcaggtccaactgacgagtcttccacattctgaaagaattggctttctcacaatgttagagtctctaggagtactggggagtgcaaattcaactgttataactggcatatgcagagaaaacggccctcctatctcttttctatgacttgtgatgtcttcctcctactcctgaccatcctctttgggcccctgggggttcctggctgatttagcctcacctgagctcttggtgtcactagagacaatcagtgtggctgtgagtcccattcattcacttcctgaccaggctatcactctgccctgttctacctttgctgttggagttcaggacaggctgctccaaaatatggccccttggcattttagaaaacagcagaagcagtaaggacactctctgacctcctcttgcccttctcccctaaagcagactatcaaacctagacagaattttctgaccacctgaaagagaccacaagatcctcattcaagaggtgccttcaggccgggtgcagtggctcatgcctgtaatcccagcgctttgggaggccgaggtgggcagatcatgaggtcaggagatcgagaccatcctggctaacaaggtgaaacccctgtctctactaaaaacacaaaaaattagccaggcgtggtggcacacacctgtagtcccagctacttgggaggctgaggcaggagaatcacttgaacccgggaggcagaggttgaagtgagctgagatcacaccactgcactccagcctgggtgacagaaagagactcagtctcaaaaaaaaaaaaaggtgccatctctatacctagaggaaaggaacatccttatcctcaaagacacagaggccaggaagaatctgaacaaggaggtcttgctaagttcccccaaggttgttaccatcagatcacacctttttgtcctccaatcatatttctccatgactatccactcttcatcaacccaagcataaaaataaacaagcttctctctttctttgggtcttcgtttccaaaggcttccatccacataaaacttacattaatacatttgtatacctttctcttgtaaatctgtctttcgtaaggggcaccttacccatgaacctagcgatggatgtgcaaagaaaaggaacctttcctcccctccaccggtgagctggactctcagccacatttaggtcctgactcaggcacacagggacccagggaacctcacgagagttaaatctcaagaactcccattctgctgcccacctgctatacacaaatggggtctcaaaatggggaacaaagtcaagagccactatctgcccttggtgtttcttttatttatcatcattttctcttcttgatgaatttctattgccattcattcaaaagacctattaagtacctgctatttgacaggcttaactgtgacctcatccaggaagttttccaaaaacttcctgaaatgtctcttcctgctctgtctttccagggcactttattcctacctcctattctgcctctcacatatattgcagggatctgtcactcccctgttctgtagacctcccatgttcctgctcgaaaggagaagcagtcttattcagcttctcgccaccagcgcttgacactctgaatgtctgttgataaaaaatgaataacgaaaggaaacagaggcgcaaacttaagtatagaaactcttcatactcagagaggcagcatggttttgtggttcagggcacaggctctgaagtcagaccgccttggttttaatcctggctgtaagatttagcaggagtatgagcctaggcaagttatttaactgccgtgtgcctcaccttccacatttgaaaagcggcaataataagtacctgcctcatagtgtgctcgtgtggattaaataaaataatctatagtaagcattcagaataatgacaggtatgtagtaaatgctcagtaaatgtaaactattactgtttgttcttccccagtggatttgagtctttatggtgaaatgcgtatgcacttagatgaacaaatggatggatttagggtgtgatttgagttccattttcagttaaaaacagaggggaaaagtcaatggattttatgctttgccgtcagacttccccaggtagatgggagatacatctaatttgtattctctttgctttacatggaatctaatgcaacaagaaggatgaaggggcatagcaaagtgtagctgtgtgtaacaaagaaaatatagttggagggcaaaatttgtcatcaaagaaggaaaaaagtatgcatttttcttactgaaaaaaaatgcatagttttttcgttgtttgcttcagcagtacatatgctaaaatgggaatgatacagagaagattagcattggcccctgtgcaaggatgacatgcaaattagtgaagtgttccatattttaaaaaaatcatgaaggtaggatttgggaccagttccacaatatgaactgctaaaaacccataagataaatggttacttttagggagctggcagcaatccctggtctgaaaacatgtaatttgagacaatttagttaatcttgaatttgaacaagctcctcaataaactctttaaaaagtgtcaaatgagctttctctaaggattcccccaacactcacctttggtctggtagctctcactggtgtctcacctctctgttcaatgtcacaactttgctagaaagtatagtggtgcccccttatccatggggaatatattctaagacaccccagtggatgcctaaaactgctgatagtaccaaactctttatgtgctatgtgttttcctatacatgtatatatatgataaagtttagtttataaattaggtgtactaagagattaacaacaataaactagaatagttgtaacaatatactgcaataaaagctatggaaatgtggtctttctctctctttcaaaatatcttgttgtactgttctgcagggtagttaaaactgcagaaatcaaaactgtggataaggaaggactactgtagtcacagactcttccagaaacagtcagatgaagtcttgaaaaagtgcccatgaacatgggaaccacttgtagcagatcatggagaccacagaaagttaaaacacacaaaatgctgcctccagttcccagagcactgaaaagaagagtctcacgctaggttggggagttagggaaaacgtgctaagcaaaatgaggcagaaaaacacacacacacacacacacacacacacacacacacacaaacacacacacacgggaaggtgaccaaaagtgcagggcagcatgaggggaatttggagcacaccagggaagtgaagtacagacttgctcacactcctgcaactccctcaccctcttttcctggatctctggctttccctggatttcccgtaataggatcttccattttcacctcttcttttactccccttcaccctctgtctcatttacttatgaactgaaactggccttcatcggctggagacaagaaagatgtttagcccagtggttctcaaggtttgctgtgggggagtcagaggctgggcagtctccatttgtcctgcagagccactcacggtccttctcaccatgccccatgccctagggggctgcctcctgtgtagcaaaactacaggctctcttgcctctggcttctggtttgcagaagattggcaaagtgaggttggtgtccttatacccctattgggccatcaagcactggctgagtccctccatggcaaaattccaagcacatcctatcttatggcccttcccacagtccctctgctccagattccagtaacccatttgccgcgcgtgcccctgcatagctgcacctaggctgttaacagcgcacagcacttgtgacttctccttaccccgactacctctctgaaatggtccctttattaaaccctcctaaaattatcctaatttgagtgtgtcatcagtttccttcaggggcactgacacaacagggagcttgtctaaacttcagattcctgggtattgactgcagaaattctgaataaataggaggtcctgaggggatctacatttttagcaggtgcctaattctgatgctggtggtccagggatgattttgagagagatttgcctacaccttaactgttacagtggacacagttcagattgagtcaaatagtgagaataacgcagccctcatagttcccattgttccattgtctctcctgagaagtccacatttctgggtgggatcattgtgagccaagttgggaaaggcagggagatttctgaaccaagccctggaatctgtgggagggctctggtagccagaaaagtagaattacagagcatcagagtatgtgacatagagtttctcaacacctcatcgatttatgctggcacagtttacctatagccgagggcccctgaagtttatttgtattgattgcaacatcactcacagaatggggagatgtaatagatggcatatgctcgaacatgaagttgaagagtgggatctatgcaagccagccatgcatgccactggtctccccaatggttgttactaacacagtgtgaaaaggaggcacttggccaaagagaaaagaatcagaaaatgaactggtgttagggaaacaacaagcaccaatcaggcatgcagagaaaacccaaaacctacttgcatcttgaagtcctatggacagaagcctgtcctgttttgcaagtatcaggtgtattcctggaagatgactatttcaggtatttggagtaatacttgtttaggtaacagggcagacagcagaggtggttgaagaagaacaatgcctcttctgggaactgcaacctcctgctgtttgtctgtttcccttcttagcatagtaactcagaaggtagaggggccagctcagattctccttcacaaggacatgctgtagatgtcaggccccaccactagtgcctgccttgaaggtcttcaagcaagaatctggtcatagacatccccttaaagaaaatctaatttaaatcctctgctattgctaaatgatgtgccagaagagattacccaaataaactaatttgcaatgacttgaatgaagtacacgttcccctggcattctgcttcccaccatagcacgcctaggtgtgatatgctattaatcccttggtagctctagaagaagaagatgggctgtagtatctaaaccctggattcaaatcttggctctgtcacctgctttggaagggttatttaactattctgattatttgtttcttaacaaaactgaaaaagtctgggaacctcataagaagatgaaatatttcatcgtattgatgtatctaatcataacacagcagctgttataaaggtgtcaaatgagagtggtcattcttcttactcttctagatgctccagtgaagccccatatcacctttttccttcctgtttgccatagctccaggtaagagacactgtagtcaaaatgacaattttgatttcaatcttgaaatgtgcagcctaaatataaagctcatctatttggtttgaggttcagagacctgagcaattcattctgagagatccaggttctaaagtaacttgatccctgcacaggaaacagtctcaacaatgaccttgtcatctcccattcattctaatttcctgggcaccaaagacttctactacctcagtggagagtcagatcagaagctatagactccatccactaaaactcaatggccctctcccagcctgccccctgtctcaggtgaatccaggcagcctgtgagaagatgaaactcccctgcatgaatttttttggtgagaagttttaaaatcactaattcaatctatttacttgggtgttgtgccatgtgtaacacttagaatcatccctggtgctctcctcttatgtatttcctgcatgaatatgaaaacatcctgaatctactgaacttaatccctcaaacctgccatttcaccaatgacctaccctaaatcactagctgggcccatttgacactcatgagcctagattatttttcacctaactctactagcaaagaacttgtgtcctgtgactagctattggcattgacattcctccatccatccatagtaatatacatattattgggttcactaacactacatgttagtgccctcttaaatctggaagtacttgggtgagtatgaggaaatttggtctattgaaagaagcattgaagtgttggattgaggattaagcacttgaccttggtagcctatatctgtccccaaatagccagtgtccctgtggaaggtagactccatccaactccaaaccaagcccctggaaatgcatcccttgttcttattggtggtaacaggcacctccttgaacctctccccagcctggcctctcaaagcaccaaacaaacctgaaattgtctcaggggagcccctgtctctctgacaccagggtattaagaaattggacagaagccccactaagcagagtcaaatgtaactctcagcctaaacctgatagtctctttcttcccacccagatacaaggtaccttgacaacaatcctttaaaaatcaaataaagtcccccttgttctgtgttgatttttaaattttcacagatttctccttttgctaaagccaaatgtagctgcacaactgcttttacgttctttgcaaaaaagctattatattaaaaagaaaatgagaacgctaggctgtgctgcccagtggctcctaatgcctgcattacacagacagaaaactgggattggatcctgcccatttttcctaaggggatgatggtatagaatctgtttagtcaagagcagagggtaagagaggataacatttttctccaaacaaaggaagggcatgtatccgccaaaggttcctgcagccaggcctaggaatatcaccagtgacctggcttgcttccagtgggcctgtttggttttgtcctagcatagaacataaacagcatcccatagtctaggacagccagaggctaaagtgcctgagagattctcaaccctttctgtaactatacatttattttaagttcactccatggacctcctctaaacccataattttaacctgagtatcttttctactcgttttgtaggtttatatgtcactgctgttttatgctacaaagttaattttcctttaattctctttatgtcatgatgaattacttacatttaggatcactgtgtttttctttctttagacagagacagagcaccttaagtagttattcataacattgggaccaaactttggtagttttcctttctgacatcacaacttggttcagattaacaaagcagtggtccctgcctcagaaagatgattaaattcccaatgacagcaaagttcacacaaagcaggtctaacaagaagccacagtgtctagcggcagcctgcagttatatgtgacaggaagcaaggagagggctggaaactccagctggagcagtgcctgacatgcctttacagccagaagtctttcatgtttattgatgctaaggaaacaattataattagttatggctaactaggcaacatgaaatacctttccatttattcttaattctgtttctgctcttactaccaccaccactaccattgatagaaactctatggaaagaggaagaagggagagtctgtgggtagagggagggatggaggatattgggcaggttggagctaatgaaggtagtctgaggaacatcacactatcaacagtctgttcagaagggaaagtgatgacaacagtgaggacctttgtggagtgcttgctctatgctgggccctgttgtaggttcattacctgtattatttcactaaatcttcactacaacactatcaggtaggaaccattatgatcccttagagtaaatggattgctgccacattgcatgtaaaagggtgatgttacatatacaaagtaatattgcatacagattgaaatcacatgtaaattaagattgatattgcatgtatgcagatcataggtagaaggatgcattggaatcaaggccgtttgtcaagatggcagcactcattggaaactcttctttcctaggggttactatttaaaccagtggcctagtttagaaagtaactttgtgcctcttggaaaaggagttgggaacaaaaggaactagttgctcgtaggaaaaaagcaaacacagagaggttctgagatctgcccagaaggggatctgaaatcaagactaagtgtgtagtccttcacgaagcagcaggcaaggctcatcttaggaggaagaagaggaagccatcatctatgtgtcacaggtgctgaggtgtaggagaccccaaccctccaatcatcttccctatttaatttgctaataatgcgtcaacatagtagaccctggcacacattaggaactcaataaatgttacttttcttatttattgggtaagatccaagtgctttatccgtgaagtacacctttctgtaaatttagttatactgtccattctcaagaattgattttagggctgggcacggtggctcatgcctctaataacagcattttgggaagccaaggctaggagtttgggaccagcctgggcaacatagtgagacctcatctctaaaaatgtttaaaaagtagctgggcgtggtggtgggtgcccatagtcctagctactagggaggctgagatgggaggatcccttgagcccaagagcttgaggctgcagtgagttataattgcaaaactgcactgcagcctgagtgacagaacaagactccaactcacacacacacaacaaagtttttgctaaacagaagagagattttggggatatctggcaataaaaggagaaaatactccaggggagatggatatgggaaggacagagtgggacacctaagagaagccccacatgattttcccaatattgcctgggcagccctaggagctgagggatgggacaaggagataccagcagcctgcagaaagctgcagagctgaacttgcacacacaccatccacggacacctgaatgcagcccatgtttatgccatagcatgtgctctctcttataagcctcatgcacccgctatgttcctttagcaggaaagccatagattatttttccagtgagtggccatttggagggagatgtgcaggtattcggtttacaacctctccctgcttgttgcacagcataggaaggtgtggaatgtatgatggcacaaatagtagaacctcctcaaaatactctgaaaccttcatcctttgcaaacccagaggctccttccatcctccactattctctttcaaaagtcaattattttaatcatagcaaagctttcttgaccccatatgtgtcccaacaaccaaatgacagtctcaacaacatttacctgttagctatggattctagtctaaaaggactcatgttgctttcatcttcctagatccagtgcctggcacagtgaaataattcaaaaatgtttgttgaacccttcggtgattttactatgtgcagaaatgtatatcaaaatattcattgaaacatctcagccctggatctaagagtgggttaggtgtaggaagaaagggtagtgtaccaaaaaaaaaaaagtaatatatggtttctgtcttctagaagttaaaagcacatattcaaaagacaggtaagtagcaacaggcatggtatggttaaacactaaaattagtcatttacatattatctgtttttctcataccctcactgtgcattagaagctttgtaaaaactacagatgcctgcagttcacacacagagattctgattaggtctgtctagtcagagtctacatttttaaacagtccacaggcgattcacatgcgtatccaggatatgaatcactgtaacaagtgctagagaacagaattaaaacagctaccagcaagaaccagagtggggggaggagtctcacggcacgattggaacctcttttgaaccctgaatcatacagagaatttggattgtagggatggagaggggagagccttctggttgggaggaagaattgaagacattgtgaacaaaggaggttgaaaattagggagaattagggagctattgtttaaaggatactgaattccagataggaggaataagtttaagagatctattgtacaacatggtggctaaccacaatgtattgtgtacttgaaaattactgagtaggttttaagtgtttttgccacaggaaatgatgtgtgtgaggtaaaatgtatgttaattagcttcatttccccgttctataatgtatatatgttgtaccccatacatgtatattgttttttatttgtcaatgaaaaaagcaaattaaaaatgccaatgttaatttaaaaaaaagagttgaaagtcaaatggatacctatttgcttagtggcaaccacatctcagagtaaggtgcagaggtgcccatgtgaagatgggcactggttgaggtagcaccacctgcctacctgatggcagaaagaatatccttaatgaccaaaggaaggccacagagggaaggtaggctttggccatgtgaaaccaaagaaaatggctgaggtgactcaatcaatctagagatttattctgccaaggttgaggacgcacccaggaaaaaggaacacctgtgatttgtgctttttccaaagagggtttggggtcttcaacgtttaaaggggaaagagtaagcagttggggaaagaggaaagaaaaaataaaaagggaagaatacataaaagaggcaagcaatggcattcttttgaagctagatccgtgttcactgaatccacattttaaatgtgaaaagaggggacagaggaatagtcaactatgcattggctccagctcaatgaatctgcatttttaggtaaaataaagtaaacatagagtaaaggaagcattcaaatatgtatttgtctcaggtgagcagagggatgacttctaatcctgtctttgttctgtacctatgaagataagctgttgatttacattatcagggtgaaattcaacagaactctgttttagggtaaagatcttggggtgcacagagaattttcttgtgagtgaattgtgagggagggcccctggggaggcctgtaaccttctacctttgtagctatctatttaggaacaaaatgaaaggcagttttgggtgactcaagctttttttttcccctttggcatagtgagtttggggtcctgaaattttatcttcttttcacagccatagcctgggaagtaggacccctttctttgtacctgcaaaacagctgtggatggctacaaaaatggtcttgaaaaaatgttgagatagacaaagaaacacatgcattcccaatcacagatttcattattaactctatctcaagaaaggtgcttgagtttgaggtcccacattcttggaatggtgactactgggagcttcaccttaagggttgaggatgtgtttccttggcttccctcaattcccagattatcaagtttctttctttcagtgactcagtgacaaaagtcttttgcctttctacttcctttctagggagtaataaagaagaggggtatgagtgggactcagggataaatggaggtagagaggaggttcaagagatgaaccaaaaacatcttaaataaaaaatgctcccagcagagggtcaggggtggatgtgcctgattctgaatgcaagtcaaatatgcatttgtctcaggtgagcagagggatgacttctatctctgtctttgttctgcacctatgaagataaactgttgaatataagatgttcctacctgttctagggcaagacaagatagttaaaaaaaaaaaaaaagaggtgatggtagatgctaccccaaatggaaaggtgaggggttattgatggcacacaccaaatttagtaagctcacttatgacacccagtaaggactgtttcattgcatgaagcactttttgtgcaggtgtagggacagatcagaagattctggaaaaggcagatcaccaaagaactcaagatgtactgatattttgccagtttccttcatcaacaacttgtcttctttaccaactaagggcaaacaaagagaacaaactaaaaaaaaaaaaaaaagaaaagaaaagaattaaataattaaacaaagaacttaaataagaaggtaagaccccccccccaaatctcccaagatagtgagaaatgtatttgcgtcatgtctgcctaacaatgagctattattaggatggtagaaaatagcagcaagtaaggactacagatttcacccagaggcagagcagacaaaagagacaacagtttcctgggaaaggaagatgattccagtttaattcatccaacaaaactcttccaagaatgagaccagaaaccctaactgcatcttggagggagctggaggctttcccatcacaatgaggccaactgctaccatgggtgccagtgccagagccactgtctgcaggcactatcatgtctgtgtgggccaaggagcaatctaaattaagatgatcatctaggtcctcaggccctcagggtgagtacatattgcagcagtttcagcctgtttcatgccctccatctgcagatctacaatgtctatagccagattcactgacccccaacccctcaacttcagatctcaatccccagaacaatgtgggcttaagacaggaaatattgaagcgggtttagcacttcctcctcctcccccaacagcagtggcatcctggtgttgagtcattctccagattaggttgaaccagctgaccactgggctccctgtgtgtcacctgagtcaccctcactcttgatttggcctaggggtcctcagtgggcttccgcccccacccctgggttgcaactctctagtcgaataacattcccactgtaattacaaaactcctatacccaaacttcttcctgggaaacactgaagagtgttgcacttttccttctttctttctctctttcttccttcctccctccctccctctcttttctttctttctttctttctttctttctttctttctttctttctttctttctttctttctttctttctttccttctttctttctttctctttctttctctctctctctttctttcttttcctttttccttccttccttccttctttctttctttcttcctttctttctttctttctttcttttctttctttctctttctttcttctttctttctttccttcaaaatggagtttcactctgtcacccaggcttgagtgcaatggcgccatctcggctcactgcaacctctgcctcccaggttgaagcgattctcctgcctcagcctcctgagtagctgggattacagacgtgcaccaccatgctcagctaatttttgtatttttagtagagacagggtttcaccatgttggtcagtctggtctcgaactcttgacctcgtgatccacccacctcggcctcccaaagtgctgggattacaggcatgagccaccgcgcccagccatgagttgcacttttcgaccttggttctcatctcatccttggttcaaccatcttgtcttgctcttgattttcctgaaatgggagagttccctgacccccctcacagaacatgcaacaggggtgtggcttgtctgttcagctgccttacctcccttataggagtgggagcatgcagacgggcaggtgcaagagccaggacaagcacttttgggctcaggctccatggtagcatctaggggtgggtgcctgcaactcccaaagcccaggtgggtgtgttacagtgctcttttagctctgctgtctgcagatggcttaagtgttaaccagctcagtgccctcttggtacctgagtccttgttcagtatccaggacgaattaggtcacatggacgaattgaaggttggcaaatgcaggggactttgttgtcagatggagatggctctcagctggagggatggggagctgaagaggggatgaagtaggaagaatgatcttcacctggagtttggctgtcctgcagccagtctcctctccaaccatccccagatgaactcctcttgatgttcagatattccttcttttctctccttctctgccaggcccacttttctgcctctgctcatctacttgtggagcatgggatttggggtttatatgggtatgagatagtggggcatggtgggccagaaggcaacatttgggtgcaaaaagagaaatgcctgtttctatttagggccatgggtttccaggcttgagggtggggcctttgccagggaactgccttcttctacccagtatttccctgtctcttgtccatatcagtacctctctccttatctgaggttaagatcaggggagtctttagctctgtatcttagtttagtgttggggtctggatttctggggaacaaatctgccagaggctggcaccctgccctgaattccaaaaattacctgcccccaattttcagtgggccctgctcatgttttggcataatttgcaattccacttggagcacctggtgccagctacttagctgaatcgctatgtggaaggctgaactccttgcacctgtgccttctccaacctctcctgttagcttggcctgtcccactctgaagggcatgtctagtgccaagtctcagtccctttcctgcctacactgtcctgctcccaacaaacctccacacctcctgataaatcctggcacaagagaagaatgtatgggaaagtgtcagcctcagaacttcttgggaattgagagtgagggagttgctggggaggagggctggtcccagatcctaatgcccaccttgcttctccttgaggattctggttgataaaagatacacatattgttaaatgaggattgcaacattagttctgtttgactttctgtaacaattagaagactagagaatatagctgggtttctgacctcccactcagaattatagagagccaagtcttccctacaaggtggacttatccacccagtcccaggctgagaagctggagatcagtcctccctgctctgaggtggtcccaccaaggggttgacccacagagactgacccattgctctgaaataaaggctagttcaagaagaatcaggaaatgggggagcatgtaggagaagtgagtgaccttgagtttttaccctgcccagtagaggaatagccagtgtgtctgataaccaaagtcattcttctctctttggagtgggaaaggtataggaatgaggtaggtcctgaaaattcccactccatcccttcccccaaatgaagaaggtgttgatggaagcaccttcctttctgagttgtggaggagatgattcagctgagccaaatgacatgtgaacaatagaaacagttctacctcccatgaactgttggcttgctgtcttcttcatgagtcagttttagcagagtgtggccaagaaaatccccatgatggagactgggtaaacagtcaacctctgtgggtcacctcccttccatcctctactcagtgcaagtcaaagctgcccatcactgggcactgggcagtcaggggactcctgatgactgactcagagcagagtgacgtagtgacaatcaggcacagaaaatcaagttccacagaagcctgacaaatgagcgcttttctctgctctcaaatccttttcagtgaggaagctttctccagcattcaggtggcacctaatgctccatcctgagaccacagagataactaagatgtgccaaagtttttgaggagaaggtgacatcgatgctctgtatctcagttcagaggctaactgtatgtgtcacaagtagcatctgtggataagtggtggagaacttgggaaaagacaaacatcttgggaaaagaaaacccttcccttgcagccacacaccagagactattcacaagagtcatcttcagtagtgggcaatttctcacacatctgcacagtttatggctaaccttggaaataagcaactaggctggctgagttccagttcaagagcaatcaggtagggcatgcagcctcaaagacaatttcctttatgatccttgtcttgattcttgatgaaatgggaactttaaaaaagctactataggtgtaaggagatctgacttcattttttacctttgagaagttatttcctgtaatcatccaaagcttgcctggtatctctcattcctggatgccagtttcagctttatgcagtggagtgcttctttctactttctgcctccttcctatggtgtagtcttcaaaatgaatctctgctcttcagtggtttctctcgtcccgtggttctcactcaaagcgtggtccctggaccagcagcatcagcatcacctgaaagtttgctagaaatgcaaattctcaagccaacccaagacctactgaatcagaaactctcggggtagagttcaataatctgtgttaacaagccctccagggggattccaatgcatgctaaatttgaaagccactcttctggggcaaatgatccttttgattaactcctaccactgatatgctgggccagagaccaaatgatgatccaattctgttaaatatttaatcaataaacaattaatatttaagttatttttggaggctgctctgatcactggaatccatggctaaagccaagttgtctgaaaacttatttgtcacaagccctcacagttacattttatcttcttcatgtactctagattctataaagtaatttggtatccttggcatagttttctttgtcaaataactctctgctgctataataagatctactgagagaggcatcaaatgctttgttaacgatctattccattcacactaatgaaacctccattgtccaccaaaattggaatggtgtcaaagagtcatcaagttttcctgaaaggtttttttgttccccttacgtgccacccagggcttacctatttataccctatgagctcagtttgattagctttcaatgcgttgtctcacaagtgatattagatgaatgaaagggttgtttcctttaggctccatcatcaatgagtttcttcctgtgttagagacctcaagtaactttaatgtgtcttcaggcaaaagatgtcaggaaaaacctggcaggaaggggaaaactgtgacttgtcccacacttttgtgtatcttcctacctataccttctggttcctgacttggcttgacttggaattgcactccttttccaaatgaaaactggttattaaagcccttttgcatgaatttctgttagcagcccacttcccagggttgtctctctctctctgcctccaaatctcagataaaatctgataccatactcacctcatgattctatttcagccaaatttgattattctggcttagctttctcaaacttcagtgtatatctgaatcaactggaggccttgctactacacagattgctgggctccactcccagagtttctaattcagtagatgttagatgggcccaagaatttgcatttctaaaaagttcacaggtcaggctaatgctgctggtccaaggaccacaatttgagaacccctgctgtacactggcacacggcaatacctgcattctttctgattattgcagtcctgatgcccttccgttcttattgcagtgtttcatgtcttcctctgtttcattcattccctttagagcatcgtatttcttgcaggttgccaggcaactgtgatctattgcttgggcaagaaaaggtaatacaaacctcaccattttcccataacttttatttggtacagtggagtgacctggctccaggaaaacaacttacttctttgctaaaagtaaagtccttggagggtgttaaagccacacagtatcttttagaaacttaatgtaacccatggtatttactgatagacacccagacatatgtaataggattatagatcagcctcgtttaagataaagtttgctgggggagatcaaaattactccctgtgggacctaaattaggtacaaagcaattaactttaagcaaccaaaaaattggttctataaaaattccatttcaaatcagctctaaactacaagctcattaccaggtaccttcactacataagagacaaacaagtctctggagatggaaaatgcgaactaaattttgagacacctcattgaatataaaaattgatgaagtcttagatctaatctcttataagggtcagctatttctacagactttctgacctttcgaatcacttccacacccagaaagacaaatcttctcattcctgaaaacagatacgtttatgtttcaattccattgatggttcagttggtgcaatattaaatacacttgatttcattccatttctttttgagtgtgagaattttaaacaacttttattgagagccaacacatcagctcaatagacctttattttcacaatgtgtttctttgcttggcatatggtaagaactttataagtgtttgtcaattaaacattaatagataattaattgttgaatgaataaattaatgaaagttgttgacttaatatatgattatgaaattaatgtaagtgctttaaaaattagaaaatacagaaaaataaaaagaaataaaatagtcatccataatctcacaacctgaagctaactactattaatttttgaaacatttttcccatcacatatgcctatgtgtgtatgtaggtatatataattattaccatattgtatataaaatgtgacattttgtgaaatttacttttatactagaaatttgtagcaacatagatggagctggaggccattactctaagagacttaatacaagaacagaaaaccaaatactgcatgttctcacttataagtgaaagctaaacattgagtgcacatgaacataaagaagggaacaacagacactgggaatgggaccgttagttgggggagggaggaagggggtcatagactggagaaccacctatggttactatgcttactaccggggtaatgggatagtcgagaccccaagcctcaccatcatgctatttatccatgtaacaaacctgcatggatatcctttaatctacaataaaaatggaaaaaatttttaagtcacattttgttaatttactttttttttttttttttttttttgaggcagagatttgctattgttgcccagactggagtgcaatggcacaatcttgggtcactgcaacctttgcctcctgggttcaagcaattctcctgcctcagcctcccaagtagctgggattacaggtgcccactaccatgcccagctaatttttgtatttttagtagagatggggcttcaccatgatgaccaggctggtctcaaactcttgacctcaggcgatccacccacctcggcctcccaaagtgctgggattacaggcgtgagccaccatgcccagccttgttaatttactttgataatgaaaatttcctgaaatcattagcaattcactgaaaacatcattttgatggtcatgtaatattccagtgaatgaatattctcaatttaatacttctactattactggatattagggtatatctaatattatttctatgtgcctagataaatatgtttctagaaaaatattttatgattagaatttcttaaaataaaatcattggatgaaaagatagaaatatttttaaagctcttgatacctattgccaaattgtttttcagaaaggttgtacctgcctacaagattatcaacaccatgtgagaacatccactttgctgaactctttctcacatatcacctttagagatgttacatggtatgcttttaattatcatttaatcctttgctagttagattaaacatggcaagtttcactaaccgttagtacttcctttttatgtgaaatgtctgttcatgttctttgtccatttttcaatagcatcttagaatatttattgttcacttgcatatgctctttatacattaaagatatcaacccatcatatatcgtctcctattctgtcaattgacttttaacgttattaatgattttttaaatatataaataaattttgttctatatgtttttcccatagcttttaaacctagaatgtatttcctcagccatagactagataatgaaactctatttttaaataaagatttctaaattggtttacatgttaaaattagcattttaatttttctaagaaaatatttggcataagaagtaaaaactttgctttcccaaagagacgtgaccaactgtcattaactttggatgtttttcctggaggaggagaatgtgcaggaatgagaagaaaataccatcagaatcatgtggacccacattcatcccttacttcaccccttctgggaaggaacccagcaggctcaaagatatggaaaatgccaccagaaaaacagtacctgggacagagggtagagattcctatggcaggaatgagactacttttaatctttcttccgtcatctcagcttttaaatttctccctagagaacatttgggtagtaagattcagaggtgcatgttagggtgtcaggtgcaccctgtgtcctggaagtagatggtacaggctcctttgtctggaggcaaagcggggccagagtgggcagggtcagtttcaaggctttgggaaagcagtggtctggcagtactcttctggctcttggaagcaggaatgcaaacttgattcaggctgggagcaaacacctgtttcatctttcaggaatatcaggagtatagcagcaggtgacagggtactttgcagaaccagcagaggggtgtcacctcacaccccagggagccatagtgtcccagtgtggaggcagaaaggtagaaaggggtcattggagtagcttagagtaatcttgtgagctttaggcttaaatcagctgactgagcagggtcttctcttccactgttcaggatgaggctatgcctggggtcaaaaagaaaaagcctccaactattttacattggcagctatgaggatggaaaaaatagtagtgatggtgtttgttttttcattaacaggttaacctgaccattgtgggaatgtcattaaatatttttctaagatataatttttactgactaatgcttgtgccattacttaaaccattaccttaaattgttttctaatataaataattctgagatgagcacctatgaatatatattttctcccatcactgaagtgagattgctgaatcaaacgatggaaggttttgaagactctggatacagttttctaagttcctttctagaaaattgtgttaacaaacgctcccaagagcaaggcagaagaagactgataaatttgttcttgtgactttctcaggatgtggactttggagaagtaatacctgctgatcctggacttctgagaatgggtgtttatgggataagatgggaaggttttccagcctcctttagggaggtcattaccttcaaatgaaaaattgaggtcacactagatatacatacacatagaaagtacaatgaggaaatgaacttcaagtaggaaatcaagcaggaaataagtcaatgatggactaatctctcaaagtaagttgttctgggagctctgagagaaggcataaggggtgtgtatccagcacctgatgccaagacaagctttgctcagatgaagacaacacacagcctttccactccttttgggttgattgtgtcccatttcttcattattcttttcttcatttaacattaattgagcacatggtgtcaagcactgtaaaacaaaagggggtgcaaaagtgaggagttctcagttcagtgtgtctttgagtaaagacgggactaggagtagatcccagatgtgctaacaacagttccagtatgataccgtatctctggagatcaaagcaattatcccagcataaatttaggaaagacttctgagatgaggacacttgaaagcagtggaggccaaatcatctttgatcacaaggagaaaaagagagagggcattccagaaaagcacatgctaaagcatggagaagtcaatgagtcccacatgtttgtgattgtggcaacatagatcatggtaaaggtgggggcaagaggacaaaaaaggtcagaggcacagtgacaagaagtgaggctgtaaaataagtcagtttctattgcaaagtctttgtattccattcaaagggcttcagcctgtcctacaggaatgaggaagccagggaatgtcttaatagatgccatttatataaacccatatttctggtataactggtggcagaggaaatgggctggaaaagatgagagcctggaatgggaaatgactaaagtcatgacataaagacatcgacatgcatagattttgtggttaaacacattttttaaacagaggcagaaagaagaaagtgtatggcagaaatgaccagagaccgcagatgagctcatggtggacagtgatgaagtttgaagccagggtagctgtcattgcagagaatgaaacatggccaagaacttcctaaatattagactaatgtcattattttttccttacctatgacagctgatgagccagtgtgatctatgatctttctgggtattttattaagttttcatcactgtgctgcctttgcaatccactagcctcagggaacatttgagacttgaatttgaaaatgacattcacaaaattagatattcttcatgtgtgtgtggtgtgtgtgtgtgtgtgtgtgtgtgtgtgtgtgtgtgtgtcctttttttttcttttcctagctccaaactgtcttcaaagggttataaagaatggggtctttgagtcctttaacctttagctatgagatagctaatttttgttccccaagcaaacatgtcagaaatgactccctgtttctttattatttgcaaatatatgttcttttattccaccccctttccccttgggaatgaagggcctccttggatgggccttaggcccaggctctcagaaagttaagaaggctttggagggtgttctgagggcagataaatggacaaaataatggtgcaaggagaccgtgttggagaaaattcagttaggcaagaagcaccgaggagttcgacccgggaggaagtccagtgagagctctggcaatgtgaaaccaggaagtgacctttagttaatcaagtaccgaagatgagagggcagacataagactcagacaaaaaaaaagtgataaaaatcattctgaaaagggaaattctagttctttgttctctcttcttatcatataatttctcaggctctctctgtatcgccggaggaacatgaaaaatttaattaatgactcgaacattttcatgtaggcagaggtttggtttcctgtagataagacatctggttaatcaagtgaactttctccttttcatccgtgttatgacacttgtatattatgtggccacatggtatttactagctcacttccatctctataatttgctttgctccgtgttatttgatctggaccagcaactttaagacatcatgtctacctcatcagctatgtctgctcccaaccaaaaccaactgtgggcctctgacaccttcatattgttcgtagcttgagactctagcccctccctctagccagccttatgctttcttcctgctttaaattcttgctttcaaccttgcccacaattgggattttgctgtaggtcacactaagaccacaactcatgatgtgctgttcaatgagcagagtttcctgtggtctcccagatgacacttgagcatgtctcaccatgccatggatgatttcccaaatccaagtcggggacatttctagaacctcatgacataggcagaccccctactgctggctcttccaattgtaaacatgtaagtcatgccacaacccacttagcaaatatctcagtggcctcagggctgtgcccttgaatggattacactgctcttggatgttccataggataaaaaaatcacaagagaaaaagaaaaagtctggagacttggagaacaaaatgccatagaaacaagtctcttcacatcaggagctctatagctgaaatctgcttccttcaactcccaacccaatgccctatcctcagctgccaatccagcaagaacacatttgtacaaatgtgatgtgggctcactccttgggtggaacttgctagaaatctcaagcagtgaacagtttctgaaagcttaagaatacccattttaactttacctcaaaaaggttaaatgatagagtaacacggacagagaacagactctaggaaatgtgcaagaagtaagctctctttctgttttattcagatatgagttttcatttcaccagcccccagtggatctgatccaatgacctagagattcatgaggctgaaattaccttggtgaacaacatgatctttctaggattccaggcattcctggtactaaaaatcctcctaagctattgacaatttttttttaattgtgggtaaaatacacacaacatacaactcaacaatttaactatttttaaatatacagttctgtggcattaagtaatttcacactattgtgtgaccatcactgtcattcatttccagaacttttctatcttccctctaattctccatttccttctcacctctcagcccctgcccaccatcctgctttctgtctctatcagtttgactactctgggtacctcacagaaatggaatcatatagaatttgtccttttgtgactggttgatttcactgataattcttaactattataacattttcctcagtcaacttgtttttatgtcacatagatccagatatactcttggtgttactgagggtccaaacatcccttttcaacaatgtagtacatcagtaaataatcaagtatttattgaattcctactatatgtttagccataaaaaaataagaattttgaagaatagtcattatccctccccttaagaaaattctaattttgtagatgtggaggcaaagtgaatgcaataaaatagtagtaaacagcatatatgcacatgtatgcagacaaacacacacctattcacatgtagacatctgacctcattacttttatgtggtcatgatgatgatacagaattatctctgtacaggcgatacagagataattctaaaaaatctaatctatcttgggtaagtccaagagcatcttgggacacaatacttagcaaattggcttttgggaattctttacttgggtcagtggtttgggggaaacctttcacttattttgtaggaggttagtggtctcgctgtattatccaagttggtcttaaactcctggcctcaagcaatcctcccacctcagcctcccaaagcactgggattacaggcatgaaccatcatgcctggaaaattttcattaaaaaaaatctaaataaatattaactatccagggattttttttgaaacaaatgggaagtaggaacttagctcacacatctctctctcgatgtgcctattcactttagatatttcactgaatcctgctaaaaagcagtcagctatttgccatctgtacagaacagctgcaatttccttcctatccaagcacaacattttattatagagaaattggcatattgtttttgccatgtgctttttacatattcctccccatggctagactaatcagggaagaaatatcttcatgtcccagctcctagctaggtcaggtgaatacaagtgacatcatgtgtatcctcttcaccaagttagcattaagttgccttgccaaacccttgaagcttcttatgtgagacatctgtgcccaatgttatttatgaataggagcaaaatgtataaatatccatgggacttcctgttaaatgtaccacattgaatgcaaatatttatctctgctgcttctgaaactttattaaaatgagagtagaaaaaatagaaggatacaaatcaacaaggaggaagagaacaagaaagatgatcccaccaaataagaaatgccaacaaaattttggaatctggaaatagacgaatgactggtaattatttatcagagcccagaaagaatattgaggagggaggcacaagaaatgagttaatgtcaatttcagaaccctgtaaacatttagaaatttggaggcagtaggtactctgaagttagaggaagtatggggcttaaaataggattcgttaaaaaatctgtgtaaagaagagttagatttccaatcctctttctatctctgaccaccagtcaattaacccttcttcacctaggcaggagaatggaggctcttcttcggggaaatttaacctggaaggctctacttgagcacctagtcacggaagatagtgggggaaatgccaggctggaaatagggacaattaagtgacaattatggtgagccccctggttcccagaatactcactgccaatcttatactcccccagaaaatgattagaagattgctccttgtagaaagagatacatgggcccagcatgcttgcagatactggtatgtgtggttctctcataaaatgactgtatctatcttgtcactctatgataaagccagctgaaccaaaaatccccaactcccaccctataaacattcttagagatcttaaatccatttttactctctgtctctcctcagaatttgttttattatacacacagtattatgtttattttaagtaatctgaaaattatataaaatcatgaagaagaaaatatcaactgtatttccatcttttataaacaataatggttacatatatcatctaggtgttttctatatatgtatatttcataaatattttcaatagatctctattttgatacaatcttctatcacattttttgacttaataatgtatcattaacatctttacttgtcactaaatatattgcaataacatttttccctatagctgaagcgtatttcttaggtgggtataactataatttatcttgttagtcccttgatgttagacatttgtattgtgtccattcttcagtatcctaaacaacactgaaataaacatagatctctgcaaacatgattatttctttaagattattagaagtagaattgctggctccaagggcacactatttttcaaagcttcactgaatttagcttaattgttctcctgaacatctttctcaatttatagttctatcagcaatgtatgagagtatccttttcccatccttgccaatatttggaatcatcactaaagaacacccccaaaaaacagacaaacaaaaatccttaacaatttgatgctaaatatgacatcctattgtttacatgtatactttatcactattgtaacattttgaaatgttgctaactactgatattttgaaaattggttatctatagcatttatttatttttattgggacagttgtcctttcttattgatgtcttcatgacttttagatatgtaaacatggaccattattgtatcatatataagaaatattttctctgtttggtaatttttctttttaactttgtttctggttctagtcttatttttagtgactcactcttgaatataaagagagaaccaagaatcatcagacatgtggagaaatgatgtaacatgaaaagtaatatcaaaacaaagaaacaaaaaaaggaagaaattgagaaatgcaatggactgaatgtttatctctccccaaattcatatgtcaaaatcctaaccccaatatgatggtgttaggaggcggggcctttgggaagtaattagatcatgagggtagatccttcataagtggaattagtgcccttataaaagaaaccccagagagctctctcctcctttttctgctatgtgaggatacaagaagatggcattctccaacccagaagagggttcttgccagaacctggccatgctgacagattgatctaggactttcacctccagaactatgagaaattaatttctgttgtttgtaagccacttagtgtatgctactttgctatagcagcctgaacaaagacagaaagaaactaagaagatgaaagacaggaataaaatctcatgaaattatgaaattatgggtctcagagttaaaagatagtgtattaatgaagaaagagatgctataaaaaacagagaatatgatatagagaagataagaacatgaaaaattctataccgtacattcaagagagcagttgaaagattatgctaataaaagcataccagaaagcggaagaaaaagaaaaatagaagagaaaaagcagaaaatttaactaataggagttccagaaagagagaacagagaaggcagaggggagttaattatcaaagaaacacacacacacagaaatttcatgagattgaaaggctttgccaagaactctgacataagaagcacacctgttttttgattaagtacatattatcagctttaagacaacagtcagtagataagtaattgctttgcaatggaaaaaatatcactttaggctaacgcctgttgaaccaactacactactccagaggctgagacaagacgattgcttgagtccaggagttcgaggctacagttagccatgaaagtgccactgcactctagctgggtgacacagtaagaccctatctctaaataaataaaaataaatcacttggtttttcttaactagattatgaaactctgtgtctggaagctgtggagttaggggctcagaagataggacaatgttcttcattcattgccttcatctatatcaaacatttcctattctctctttcttctcacattgagccccaccttcatcctaactaatccaatcattgtatctgaagaactatgtttcttaccagtcgtgataaaaaacaatgctccacaagtttaaaacaaagacaacatgtgattggaaaaaatgatgaatttctttttcttcctctttgttttgttttcatagattactattaatatagaaagcaaggctgggcaccatggtttatgcctataatcccaacactttgagaggccaaggcaggcagatcgcttgagcctaagagttcgagaccagcctgagcaacatggcgaaactcagtgtctacaaaaaattagctgggcatggtggcacgcaccagtagtcccagctacttgggaggttgaggtgggaggatcacctgagcctaggaggttgaggcttcaatgaaccatgatctcacagagtgcagcctgggtgacaaagcaggactttgtctcaaaaaaaacatatatatatatatatatatatatataaactatattttaatgttacgagcaaataatgtgcattctttttaccctagggatataaaaaagtgtaaaataagagaagcgagtgattagccaaggggagtaggtttgtgtacatttttcaagataaatggaatgctggtacactaaatagtatctacaaactattgtaaactgaaatgtttatagtataatttgtaagattaagcaaacattagttgaatacaaaaatagcaaacaacaattagaactgctttgagaaatctactgccaataaagcttttttttttaagtctgtggaatggcagattgataatggttttatttagtgaggacatatcaaccatgctatgccattttccttagaaaaacccatatctgctgaagcttattaactcattcaatcattgtgtatcacctaataatagacaaactgatttgaaagaaacttgatgtaattatggcaatttttctagatcaaaaaatagaaaaaatcggcggggcacggtgtctcacacctgtaatcccagcactttgggagactgaggcaggaggatcacttgaggccaggagttcgtgaacagcctggctgacatggtgaaaccccgtctctactaaaaatacaaaaattagccagatgtggtggcacgtgcctgtaatctcagctactctggaggctgaggtaggaaaatcacttgaacacgggaggcggaggctgcagtgagctgagattgtgccactgtattccaacctgtcaaaaaaaaaaaaaaaacccaaaagaaatagtcacttaatgacactttacatgtctaataaacaataagacttagctaatattgcagacacatttctttaaatctaaagcactaaatggaatcaccactgtattgtttgagtatatcaatagatcattaaaaaactgctggtatgcacatttggcctttatcattgaagatcaataaaaccgctgaaatggctttctttcttcttttttttgacctttttagccagactgtaattgggcttgtcacctgactctcaggtgaaaataatcataaatcagattcatcaaataatgttaaagaatagctcacaccaacagagctaggaaaaccagtccctgccagtcaccatccagctccttgggaatttgagggctggttatctcagagatgttatatcaactattctttgcttttgtcccccatggagccagacccgataatgctttgaaagaagtgcagagaacacagaaaagagtcagtagaaaggagattacagggtgaggggaaaagaatacaagcagcttgtgtctgttaaaacaaatcacccaagtgagtcatctctcctgaatcacttctcccttctgggatgaggctctgtgagtacctggctccagaacccagagaggatttacagccaggcaaatactaactgaggctatgttggaacctgtgtcacccaatctcctaattacaggtgtctgtggttaaaatttggagctcaccaatttggaagatgttatgagtctaagttctgtaatagctgagtcaggtttgataccaggcagccctaccacctaaacacattatattctgaattcaaatggaccccatttactttccccatgccaacaccttttccccagccccaccctactgctacctcctgatgacttctgtcttctcttcctgccctctatttggcctagtgaagggagcataggtctgtatacattgttagcattcctttaagaagcaaatcctgaaaacaagaagaaataaaggggtatgtctattttctttaaacatttggattgagtaaaagggaagcaaagttctta

SEQ ID NO: 1196 - DNA, 6660 bp, Homo sapiens
ctttataaggctaagtttcctagcacaagttctctttgcctgctgcaatccatgtaagatgtgacttgttcctccttgccttctgccatgattgtgaggcctccacagccatgcggaactgttgaaatacacactacctgaagctggataactcatgaactctgttgacaattatattctttgtctttttaattaactcatttggagttggtgtcctgaggacctaagcctaagaatcttcaagatggaagagtagagtgaacaatgaatgagccagagggctcttgtcctctgtgtgcagctctgggcagccagcaggtggatatgggacttggcctgctggaggggccctggcaagaggagctggcaggagcagatggcaaaggtggagtctcgcactgtcatcctggctggaatgcagtggtgcaagccgactcactgcaacctctgcctcttgggttcaagtgattctcctgcttcagcctcctgatttgctgggattgcagagcaaaccagtgaaaaaatggccttcgcactcctgagagacctttcaccgggctttctacttttgaattctctccatagctggtttcctcttaggcctcgatagagcagtccctgaatcacacaggtatgctgactacgtcttttcctggtacaaaccatcatgggggaaacacacagcaagaagcatcttcaggtcacaagatagactttgggaatcacccaactgatggaaagaaccaggaaaggggtcaggatctgcaccttggcaaactttgaagaacacccaatttgatgaatgaaaactcctcacttgtgctctggtggtgttttaggacaatgggcccctcctgggtaatagttattgatgcagtctctatcagtaaccaccccaagtttgagatcctttacaagggaaggtcatatttccaaaactgaaaccttgaccaagtatcccagagagataggaaggagataccactcaagtgtgtcatgggcctgtcccagggcctgggagtcagcagttggtggcctgggatccaagggttaacagcatgacctgttctggctggcaccagtcacatggtgtgcccaacctcactgttattatctgtttcgggtgagtcactgagaacacagacaggaaagacccatgaacttagctagtttcgccccagggtgtgagactccacacaactgagtctgggccactggcagtgactcatggcgggcctcatgggattgctgacgcaaggttggaagggcacgtggttcttccccccaccgctgggtagaatccccgccaaaacatccaggctggaaatccatcttggtccttggggagagagaaaataaaaaagaatcatttctgatactatagcaaagtatacaggtggatttggcaggtccaactgacgagtcttccacattctgaaagaattggctttctcacaatgttagagtctctaggagtactggggagtgcaaattcaactgttataactggcatatgcagagaaaacggccctcctatctcttttctatgacttgtgatgtcttcctcctactcctgaccatcctctttgggcccctgggggttcctggctgatttagcctcacctgagctcttggtgtcactagagacaatcagtgtggctgtgagtcccattcattcacttcctgaccaggctatcactctgccctgttctacctttgctgttggagttcaggacaggctgctccaaaatatggccccttggcattttagaaaacagcagaagcagtaaggacactctctgacctcctcttgcccttctcccctaaagcagactatcaaacctagacagaattttctgaccacctgaaagagaccacaagatcctcattcaagaggtgccttcaggccgggtgcagtggctcatgcctgtaatcccagcgctttgggaggccgaggtgggcagatcatgaggtcaggagatcgagaccatcctggctaacaaggtgaaacccctgtctctactaaaaacacaaaaaattagccaggcgtggtggcacacacctgtagtcccagctacttgggaggctgaggcaggagaatcacttgaacccgggaggcagaggttgaagtgagctgagatcacaccactgcactccagcctgggtgacagaaagagactcagtctcaaaaaaaaaaaaaggtgccatctctatacctagaggaaaggaacatccttatcctcaaagacacagaggccaggaagaatctgaacaaggaggtcttgctaagttcccccaaggttgttaccatcagatcacacctttttgtcctccaatcatatttctccatgactatccactcttcatcaacccaagcataaaaataaacaagcttctctctttctttgggtcttcgtttccaaaggcttccatccacataaaacttacattaatacatttgtatacctttctcttgtaaatctgtctttcgtaaggggcaccttacccatgaacctagcgatggatgtgcaaagaaaaggaacctttcctcccctccaccggtgagctggactctcagccacatttaggtcctgactcaggcacacagggacccagggaacctcacgagagttaaatctcaagaactcccattctgctgcccacctgctatacacaaatggggtctcaaaatggggaacaaagtcaagagccactatctgcccttggtgtttcttttatttatcatcattttctcttcttgatgaatttctattgccattcattcaaaagacctattaagtacctgctatttgacaggcttaactgtgacctcatccaggaagttttccaaaaacttcctgaaatgtctcttcctgctctgtctttccagggcactttattcctacctcctattctgcctctcacatatattgcagggatctgtcactcccctgttctgtagacctcccatgttcctgctcgaaaggagaagcagtcttattcagcttctcgccaccagcgcttgacactctgaatgtctgttgataaaaaatgaataacgaaaggaaacagaggcgcaaacttaagtatagaaactcttcatactcagagaggcagcatggttttgtggttcagggcacaggctctgaagtcagaccgccttggttttaatcctggctgtaagatttagcaggagtatgagcctaggcaagttatttaactgccgtgtgcctcaccttccacatttgaaaagcggcaataataagtacctgcctcatagtgtgctcgtgtggattaaataaaataatctatagtaagcattcagaataatgacaggtatgtagtaaatgctcagtaaatgtaaactattactgtttgttcttccccagtggatttgagtctttatggtgaaatgcgtatgcacttagatgaacaaatggatggatttagggtgtgatttgagttccattttcagttaaaaacagaggggaaaagtcaatggattttatgctttgccgtcagacttccccaggtagatgggagatacatctaatttgtattctctttgctttacatggaatctaatgcaacaagaaggatgaaggggcatagcaaagtgtagctgtgtgtaacaaagaaaatatagttggagggcaaaatttgtcatcaaagaaggaaaaaagtatgcatttttcttactgaaaaaaaatgcatagttttttcgttgtttgcttcagcagtacatatgctaaaatgggaatgatacagagaagattagcattggcccctgtgcaaggatgacatgcaaattagtgaagtgttccatattttaaaaaaatcatgaaggtaggatttgggaccagttccacaatatgaactgctaaaaacccataagataaatggttacttttagggagctggcagcaatccctggtctgaaaacatgtaatttgagacaatttagttaatcttgaatttgaacaagctcctcaataaactctttaaaaagtgtcaaatgagctttctctaaggattcccccaacactcacctttggtctggtagctctcactggtgtctcacctctctgttcaatgtcacaactttgctagaaagtatagtggtgcccccttatccatggggaatatattctaagacaccccagtggatgcctaaaactgctgatagtaccaaactctttatgtgctatgtgttttcctatacatgtatatatatgataaagtttagtttataaattaggtgtactaagagattaacaacaataaactagaatagttgtaacaatatactgcaataaaagctatggaaatgtggtctttctctctctttcaaaatatcttgttgtactgttctgcagggtagttaaaactgcagaaatcaaaactgtggataaggaaggactactgtagtcacagactcttccagaaacagtcagatgaagtcttgaaaaagtgcccatgaacatgggaaccacttgtagcagatcatggagaccacagaaagttaaaacacacaaaatgctgcctccagttcccagagcactgaaaagaagagtctcacgctaggttggggagttagggaaaacgtgctaagcaaaatgaggcagaaaaacacacacacacacacacacacacacacacacacacacaaacacacacacacgggaaggtgaccaaaagtgcagggcagcatgaggggaatttggagcacaccagggaagtgaagtacagacttgctcacactcctgcaactccctcaccctcttttcctggatctctggctttccctggatttcccgtaataggatcttccattttcacctcttcttttactccccttcaccctctgtctcatttacttatgaactgaaactggccttcatcggctggagacaagaaagatgtttagcccagtggttctcaaggtttgctgtgggggagtcagaggctgggcagtctccatttgtcctgcagagccactcacggtccttctcaccatgccccatgccctagggggctgcctcctgtgtagcaaaactacaggctctcttgcctctggcttctggtttgcagaagattggcaaagtgaggttggtgtccttatacccctattgggccatcaagcactggctgagtccctccatggcaaaattccaagcacatcctatcttatggcccttcccacagtccctctgctccagattccagtaacccatttgccgcgcgtgcccctgcatagctgcacctaggctgttaacagcgcacagcacttgtgacttctccttaccccgactacctctctgaaatggtccctttattaaaccctcctaaaattatcctaatttgagtgtgtcatcagtttccttcaggggcactgacacaacagggagcttgtctaaacttcagattcctgggtattgactgcagaaattctgaataaataggaggtcctgaggggatctacatttttagcaggtgcctaattctgatgctggtggtccagggatgattttgagagagatttgcctacaccttaactgttacagtggacacagttcagattgagtcaaatagtgagaataacgcagccctcatagttcccattgttccattgtctctcctgagaagtccacatttctgggtgggatcattgtgagccaagttgggaaaggcagggagatttctgaaccaagccctggaatctgtgggagggctctggtagccagaaaagtagaattacagagcatcagagtatgtgacatagagtttctcaacacctcatcgatttatgctggcacagtttacctatagccgagggcccctgaagtttatttgtattgattgcaacatcactcacagaatggggagatgtaatagatggcatatgctcgaacatgaagttgaagagtgggatctatgcaagccagccatgcatgccactggtctccccaatggttgttactaacacagtgtgaaaaggaggcacttggccaaagagaaaagaatcagaaaatgaactggtgttagggaaacaacaagcaccaatcaggcatgcagagaaaacccaaaacctacttgcatcttgaagtcctatggacagaagcctgtcctgttttgcaagtatcaggtgtattcctggaagatgactatttcaggtatttggagtaatacttgtttaggtaacagggcagacagcagaggtggttgaagaagaacaatgcctcttctgggaactgcaacctcctgctgtttgtctgtttcccttcttagcatagtaactcagaaggtagaggggccagctcagattctccttcacaaggacatgctgtagatgtcaggccccaccactagtgcctgccttgaaggtcttcaagcaagaatctggtcatagacatccccttaaagaaaatctaatttaaatcctctgctattgctaaatgatgtgccagaagagattacccaaataaactaatttgcaatgacttgaatgaagtacacgttcccctggcattctgcttcccaccatagcacgcctaggtgtgatatgctattaatcccttggtagctctagaagaagaagatgggctgtagtatctaaaccctggattcaaatcttggctctgtcacctgctttggaagggt

SEQ ID NO: 1197 - DNA, 695 bp, Homo sapiens
gacagcaaaccaaggggttgtgctgtctccttgtctcccagggataaacccacatgacagtttacaaaaacaggtaatcataagaagcaaatggcccagatgaaacacagcaaaagaatgagaagtggtaacactgggagtgaaatttgaaccaagcgtaaatggagtgatcgtagaaatagctgactgtggaatgtggacactctctgtatctgcagcctgggaagcttaaagaaggtgaacttactgacaccagttagaaagtgactgtgatgaaacgatgaagatgctccagaggaagtgacaccagcaataggaaaaaaaaaacaaacctctcactgaaggaactctcggagatatttcatgacacagaaggcacaaaggatacaatattggcaactaatcgaaacttagaaatgatatgacagctcaccaaggcatagaaaaagatgcttgctctatcataagttatagaatgagaagaagggatggtgtttcactatgctgcccaggcaggtctcaaactccgggactcatgtgatcttcccaccttggcctcctgaagtgctgggattacaggcttgagccaccacactgggcctataccattttcaaatagtggagccatccattacatatttgtaacatatgtgttgattaacaattaatactcttagttccaagctccatttggc

SEQ ID NO: 1198 - DNA, 695 bp, Homo sapiens; identical to SEQ ID NO: 1197

SEQ ID NO: 1199 - DNA, 1445 bp, Homo sapiens
gttcactcacagacagcaaaccaaggggttgtgctgtctccttgtctcccagggataaacccacatgacagtttacaaaaacaggtaatcataagaagcaaatggcccagatgaaacacagcaaaagaatgagaagtggtaacactgggagtgaaatttgaaccaagcgtaaatggagtgatcgtagaaatagctgactgtggaatgtggacactctctgtatctgcagcctgggaagcttaaagaaggtgaacttactgacaccagttagaaagtgactgtgatgaaacgatgaagatgctccagaggaagtgacaccagcaataggaaaaaaaaaacaaacctctcactgaaggaactctcggagatatttcatgacacagaaggcacaaaggatacaatattggcaactaatcgaaacttagaaatgatatgacagctcaccaaggcatagaaaaagatgcttgctctatcataagttatagaatgagaagaagtatatcagaaaactcaaatataactccacaactttttcaagagtttctttttgttttccaatggtaacgggagagaaaataagctgtcattatcggaatgatcaaacacagagagaaaagaggcagaggtgagaagatggagaagatgaatacatttgctttcagcaaaccaatggaagtccatttgcatgatctgaaaaggaaaatgagaagctaatttttctatacaaggcagaatttaagaaatacaattcctaaggactccagtggatacagctctggttcctggacttcgtgttttggcttggtctttctgctttttcaattttgtcactggtgtgatccagagaacatgcctttcactgtgaaaaccagcaccttcaaggccaggcgcagtggcttgcgcctataatcccagcatattgggaggccgaggtgggtggatcacctgaggtcaggagttcaagaccaacctgaccaacatggtctactaaaaatacaaaaattagcccggcatggtggcgggcgcctataatcccaggtactcgggaggctgagacatgagaatagcttgaaccagggaggcggaggttgcagtgagacgagatcacaccattgcactccagcctgggcaacagagcaagactccatctcaaaaacaaacaaacaaacaaacaaaaacaccacacaaaaccagcaccttccacagtgtctagcatacgttagtcaccaaaacaggtttgctaaatgaacaaatgaatgaatggcattttatgtgtcagtaaatatgcttcaaaatcatgatgtatgatgagtaagcaactctatcaaataaatataacgtaatttgctgtgagcacataatttgctgtgttctagtattgaacagttggactatttccatattttaatttttactattatgtttgaggatgatatataaatctt

SEQ ID NO: 1200 - DNA, 4868 bp, Homo sapiens
tgtcgctgtcactcttccagaaggcacagagcagctcctgccgtggcccaggcatcacgtcctgtgggcagatgggggtggtcagaaaggttggcctggagctcactcttaggtcctgggcttgggctgagtctaagagggctgctttttactagatgagtattgaccgagcgcctactgaatgtaacaggtttggagacacagcagtgaacagggcacacacaagtacctacccttgtgaggttgacataagagtgggagaggtggccaggcatagtggctcatgcctgtaatcccagcactttgggaggctgaggcaggcggatcacctgaggtcaggagtttgagaccagcctggccaacatggcgaaaccccgtctccactaaaaaatacaaaaattagctgggcctggtggcaagcacctgtaaatcccagctacttgggagtcctgggcaggagaatcgcttgaacctgggaggtggaggttgcactgagccgagaatgagccactgcactccagcctggatgacaagagtgaaactccatctcaaaaaaaaaaaaaaaaaaaaaaaaaaaaagtgggagaggcagattatgacataaacctaacgaataagtaatgtagatagtgcattagaaggtggccagggatgatgatggctcttgcctgtaagtaattccaggactttgggaggccaaggtgggaggatcgcttgaggccaggagtttgagaccagctgtggcaacatagcgagacctccatctccattaatttttttgtttttaattaactgggcatagtagtgcacgcttatagtcccagctactcaggaggctgaggtgggaggatcactggagcccaggaattctagaccatcctgggaaaaatagtgaggtccccgtctctatcaaaaataaaaaaattagctgggagtggtggtgcatgcctgtagcctcagctactcaaaactctgaggctggaggaatggttgagttcaggagttcgaggttgcagtgagctataatcgcgccactgcactccagcctgggccacagagtgagaccctcctgtctaaaaatataaataaataagaaaagaaagtctgggagtggtggctcacgcctgtaatcgcagtactttgagaggccaaggcgggcagatcacctgaggtcgggagtttgagaccaacctgaccaacatggagaaaccccgtctctactaaaaatacaaaatcagcgaggtgtggtggcgcatgcctgtaatcccatctacttgggaggctgaggcaggagaatcacttgaacctgggaggcagagattgcagtgagccgagaacgtgccactgcactccagcctggacgacagagtgagactctgtcttaaaataaataaattaattaattaaattaaataaataaagtaaggaaataaataagtaatgaggttggggaaggcccaaatcagaaggccagaaacataaaagactgagtcacgtcgggaaagagcatcccagagagaggcccagcatgtgcgaaggccctgggttatctttgaggaagtgagcagagtgagcagagaccttggcaggagggtctcttcccgcctccccatcggaggactcaaggtgggagaaggcgaaaaggatgggggagttgagttccttggtgttgttgtggctcagaaagatggagttgacggcagagaggcgtctgagttggacaccacggatgctgctttcatatatctcctccagttcggcttgcttcttggaatgcaggttcaaggaggcattggccagcaatgtcgtcatgttctggatggagaggatgcccgccacggcggggcctggggaacagacacactcgctgcctactcccgttgtcctcctcccatgctctatcctccctcccaagatgacccagctcaggctcagccagtccaccacgatgacgccaggagcccctcccgatgagtcagtttctagttgttccttgtttttttttttttgagacggagtttcgctctttcgcccaggctggagtgcagtggcgtgatctcagctcactgcaacctccactccccaggttcaagcaattcttctgtctcagcctcccaagtagctgggattataggcacctgccaccactcccagctaatttttgtatttttagtagagatggggtttcaccatcttggccaggctagttttgaactcctgacctcgggtgatccatctacctcagcctgccaaagtgctagggtgctaggactacaggcatgagccactgtgcctggacttttttttttttttaagacagggtctcactatgtcgtccaggctggagtgctttggcgtgatcatagctcacagcagccttgacctcccgggctcaattgatcctctcgcttcagcctcctgagtaactgggactacaggcacgtgccaccacacctggctaatttttgtattttttgtagagaccgggtttcaccatgttgcccaggctggtcttgaacttctgagctcaagcgatctacccacctgggcctcccaaaatgctgggattgcaggcgtgagccaccgcgcccagtcagttgttctattctgaacctcaccctggccccatcccagcacctccatctctctcccacgggctccccctccagaccaccgctgctacctggatcctcggctccagctgccacagcccaattcagcttcatgcgtgcgctgctctgacccatagtgacgttcttgtccccccgctcctggatcatcagggtcagctctgaggggagaggggcagttgtgattagggaccccaggtaccaggtggggcccagggttggggcagggcaggccaggccaaggcctcacctgtgttcgaaggggaaatgtaggtgaaggggcctttaggcaggctcttggccaggatcctcatgatatcttcaaggtttgagagcagctgggtggctatgaggtgccggacaggtggcgccagggcctctacgtctccaggagcttccatcagttcatccaccaatttgatgacattctagggggtggcgggtgacagaatcgctggagcatcagaccacaggggttgcctgaaggacctggatgtcaccccctaccaggggacacactggagacccacaggcacaagggaatcactgagatgatgcagtaaccagaaaacaagcgacggattgagtatttgcctgcatgcacgtatgaatcacagcgcttaacactggttgggcacgggctgcctgccaggctctgttttgatttcctgttcttttttctttctttttttgagacagggtctcagtctgttgcccaggcttgagtgcagtggcataatcagctcactgcaacctccacctcccagactcaagcgatcctcccacctcagctttctgagtagctgggactacagaagcgtgccaccacacccggctaatttttgtaattttttttttgttttgttttgagatggagtttcactcttgtcacccaggctggagtgcaatggcacgatctcagatcaaaacaaaaaaagcaaaaaatcattccatgttaaagtggttaatacgttggatctattaggttaaatgcaatcttaactttatttatttatttatctgagactaagtctcactctgtctcccaggctggagtgcagtggcgcgatcttggctcactgcaacctccgacttctgggttcaagtgattctcccgcctcagcctccctagtagctaggactacaggtgcccgccaccatgcccggctaattttttttgttattttagagacgggttttcaccatgttggccaggctggtcttgaactcctgacctcaggcgatctgcctgcctcagcctcccaaagtgctgggattacagacttgagccaccatgcccggcctgcaatcttaactttaatttaactttatttttactttataaagtgtagttattagacaacaggcacggtggtgcacgcctgtacttccagtgcgtttggaggctgaggtgggaggatcacttgaacccaggattcaagaccagcttgggcaacatagcaaggcccccatctctgcaaaaaatgaaaaaatggctgggcgcggtggctcacacctgtaatcccagcactttgggaggccaaggtgggtggatcacgaggtcaggagatcgagaccatcctggctaacatggtgaaatcccatctctactaaaaaatgcaaaaaattagctgggcgtggtggtgggcgcctgtagtcccagctacttgggaggctgaggcaggagaatggcatgaacccgggaggcggagcttgcagtgagccgagatcgtgccactgcactccggcctgggcgacagagcgagactccgtctcacaaaaaagaaaaaaaaaaaatgaaaaaattaggcacagtggctcacacctgtagtctcagctcttaatacttgggaggctgaggagggaggattgcttgagcccaggaggttgagaatggagtgagctgtgattgtgccactgcactccagcctgggtgacaaaacaagaccgtatctctaaaactaactaactaaataatctagctactggaaaagttaaaatgatgttaagtggctcacatcatttttctactgtgctaaaaacatatgggaaaactgttttttttttttttaagacaaaatcttactcttgttgccctggctggagtacagtggtgcaatcttggctcactgcaacctctgcctccgggttcaagtgaatctcctgcctcagcctcctgagtagctgagattacaggcgtgcaccaccacgccagctaattttttttttttttttttt

SEQ ID NO: 1201 - DNA, 4868 bp, Homo sapiens; identical to SEQ ID NO: 1200

SEQ ID NO: 1202 - DNA, 4868 bp, Homo sapiens; identical to SEQ ID NO: 1200

SEQ ID NO: 1203 - DNA, 4868 bp, Homo sapiens; identical to SEQ ID NO: 1200

SEQ ID NO: 1204 - DNA, 4868 bp, Homo sapiens; identical to SEQ ID NO: 1200

SEQ ID NO: 1205 - DNA, 667 bp, Homo sapiens
ataaaccagggacggaacaaacaacagcagcagcggtcgcagggaaacagaatctgtgttggcgtgcagggagcaggcagcgtctgcaaagtagcgctggcaaccacaacagagaggccagcaacaggaggagcaggaggagctagccaatgaagcgtgctgtggaggacaaagagcagcagaggcaggaagcagtgacaaggagtgagctgggaaattccagctgccctcctgtcctacttacaaggaatagcctggaacaagtacagttgactctgaacaagtcaggtttgaactgcatgggtccactcatatgaagatttctttcaacgaaagctaccccgagtgtgcctgcctttcctgcctccccttccacctcctgcacctctaccatccctgccacccctaagacagcaaggccagtctcttctctctccccctcctccttcagcctattcaacttgaagatgacaaggatgaagagctttatgatgatctacttccccttaatgaacagtaaatatattttttcttccttacaattttcttaatagcattttcttttctctagcttaccttattgtaagaatacagtgtataatacataaaacatacaaaatatgtgttaataaactgtttatgttattggtaaagcatctggtcaaca

SEQ ID NO: 1206 - DNA, 1700 bp, Homo sapiens
cacggttgtcttagaaaccagaccccgaggcttggcagagcaggagccctcggtggcagtgcttgggtgtcgaggctctgaggctccggcctcacctctccacggggtcgaagggaacgtctccggatgccaggagtcgcaaagggccgaccatgatgatgaaaccccaggcagagacgggggaagcagcacgggatcccagcctcaggcctgcacggacggtgttggttgggagacgaggtctcactatattgaccaggctggtcttgaactcctggccttaagcgatcctcctgccttggcctcccaaagtgctggagttacagatgtgagcctctgtgctcagtccatccttggctgttcaagtgtagagaaattgccactccctctccagccctcagcaaccaccacctcgatcagtcactagctatcaacattgagacaagaccatccagcagcaaaatgatgatgacttactgaaggcccagatgatggttagcagtttttggcaatcacgtattttcaaaggacacggcttcccctgaacgcggatcctagaggccaggcagaagcagcatgggtttccactcacacggtaggcggctgtgcaatttcgtctggagtccccagacccctcctcatccttcccagggttgctctgaggccattccttgtcatctaggaggggtctacataaaagcatttataaacacctccaaatgggagccaggcgtgcccacctttggagcacttttctctactgcaaatttatctactgctcgtgaaatctctggatttaactctgatgaaagactggaggctgaaggagaacttcaatatcatatattttaaaggttgattcacagtttggagcaagaattaaagaaccacgaacttcaaggtaaaacgggcaacggcgttggggcaagcctctctgcatctgcgtgtccagcctctcctgcgtgccagaagttcccaggcaggagtgtggtgggacatccggctggggtaaggacaggcaccctcccactgtgtcagggcccagagagtgggtggagaagctctgcaagagacctgtgcaagggcgccttgcaggagcctgcagtccccacaggtgtgtttgtggataacacttggggagccctggccttttggggtcacggagggcttggcctctcacctcagagctgcagagaagccgcttctacatcaggacatcagaagctggaacaggatggccggcgaggggcctcttgttggggtcacagagatgggtcgcagagatggcccgtgtggaaggttggattctcaccccacctctgcccctagatgtcctggtgaccctcccctctgtagtcttggttttttgcaaaacagttatgacctcctgccatactgggtactttgcttatgtattgtgtttactctttactgtgtgtctctcctgctaaggtctacgaagaagggtctttgtgggtggggttcttagaggcatcccaagtaccagaagcagtccctggactaaggggctcaataaatattttttatttattattttttctttttgagatggagtctcgctctcttgaccaggctggagtacagtggcacaatcttggctcactgcagccttcgcctcctgggttcaagtgatttccggctaatttttgtatttttagtagtgacggggtatcaccatg

SEQ ID NO: 1207 - DNA, 6235 bp, Homo sapiens
agtgggcagcagacaggctgagccctacaccactccctgagcatgaggctacaaaacccagttcaatggatgcccatcccacacacgatggggcccagagggcccagaagaaagggctggaaaccctgagctgaacaccgctggggatggggacacggggtatggcggggccctcttcgtggaagtcatcagggctcggtttacacgagatgggaaccaggcaggagcacagacgggcaggccccttgctccgctccctgctccgacctcttactcccaccaccaatgacaggcaggtcctgctcctgccctcagcgctgggaacaagacacagcctgggccaggagcccgagagatggggaacctgccgaccccatcccaagctcacagccatactgcccccttccccttctctgcctgtcccctcccccagccctggatgaggctgcagagagagaacacggccagagcaggatgtgggaagggaacgacagcttgaggctgacacggggcggagggggcagaagagggcggaagagggcagacggggcaatttcctgttcaggctgagcagggtccagacaggagggctctgaggagcccccagtacagactggactccagcccagcagggaactgttaggagcagcttcagctggaggaaggggccctcttcccgggtccctgggcctgcaggggggctctgctgccctcctggcccgctccagagctgggggctgtgtcaccatcccgtaactcctgaaccccttgtggcctggtccacccccagcagacagctccgaggtgagaactcactgaggcccaggcagggtgacaagggccagctcaccctctcctagggcagggagttgctctgcacagggccctgaggatggtggatgcaggcggggcccccaacagccactgctgctccccctcccttgccctcccaggctcctgccggtgactctccgccagcagcccccacagcgggttcctggtacatcctcccaaccccaagcctccccaagccctcggcctgctgcagggaccctgtgcagccccaggtccagccctcaacacctgctggcacctcaaacccaatgtgccaaaaagagcccgatcgatctgccctgtcctccctcccactcattgtggcctgactccggggacccctgcccctgtaccccctgggtttgaggctgtccctccagcctgcacacaaccaggcccattcccagacccctcctcaccctgctgactgccccggccacctgagggctggggttgggctgggatcaccgagccctccctttcaaccacatacccacggtgggtgaaccccacaccctggcaccctcgagtcctgggaaaggccccagagggactcaccgacacagtgtcctggctcaggtacccggagaggctgcccgagccatagtggatgtcaaacgaggtaccattcttcacgtaggtgctggacttgtcgctgttgtacttgtggtggatccctgccccgggcgacaagggggcccgccggtcatcccgcagcccacgccacggccttagccctcccatccccctacaatctaccatggagcccgcaccccccaagctgcctccccagggtgggatttggaggggatctgaggcccaccatcatgccagagccccgggactgtgggctgtgaccccgggcctccctcccagccacagccggctccctctgtggccaccccagccccagccctgctgagagcaagaccacagctggtggttcacccagaaagtcagtggctggagcagggtggagggctggcctggctcacggggccaagaggcaggagaattgcgttgcccaagtgattcctgaggcagccctgcagcgacatcccggaagggcaggacctgggcgacggggccagggttcgtgactcacagcaagcgatgtccagcagtttgcagtggatggaggggacccacaggttggaggagcccgtgtcgaagacgactgtgaagcactgggggggcgtcccgatgccaatctccccgtagtactgggcctggcaggggacagggtccgtcagggatgggagagggggccccatctccccactgggcctcagaaggcccggctgtccccagagccaaggcccatactggagggaggggcatcacggggcccacagctgccaacagccacccactcccacctgctcagcctgcagggaagatgggccaggtccccagccctcggtcctaatgcccacgggtacttggggtctctagacccctggcttctgtcacctacccctgctcaatacatggtgaggctgaggacttccccacggaaaagacaaggccagaggtcaagccagggtggggacagacgtggccctcagcctgagccccgggtgcaggaaagcccggcctggaagactcccctggtggcccgcagtccaaggtctgagaaaggaagtgacttcctccccaggttggggccatgtcaaggtctgattctgggtgtctcagtgcctgccctgccctccagggtgaaccccaggcttggagggcttccaggcagaggggttcagctggtcaaggggagaaggtaagccttacaatcactgcctgcccagcaaccctgccttaatggcccagggcctcagtttccccgtgtgtacacagggatagcaggcgcaggtgggggtgctgactcagggatcaggcaagtacaaggggtcccatgccgccgagcctctcaggaggcagagagtaagagggtcctggagtttggggtcgcctgggcgcccgcttcccccaggattggagcctgggccaccgtcagccaccagattcctggcaccagcccagcccaatgtttctccaaccgcctggcttcacggagcagcagcagctgctgactcatggccccacagaagtgaccactggcagggggacactcagcaaatttccatgtgtgtgtgtgcatgtgtgcgcatgcgtgcatctgcttgctcgcgcgctaggacaatcaggaactggccagtcgggaccaggcacacggcgcctggttccccccagggcccccctggcccagtcacatgcctgtgagtcttgggcttcctgtcacagccaggactcgggccaagcaggacagagggcaaggctcccccacagtgggccagagccccgaggctggacagtaggccctggcctcgaactgaccccatagagctgggaccaggctgaccaagccccagcttgctaggtggcttccagagtgctccaccttggatcctgcttccccctgaaggagtagtgggcacaggaggggctgttgcgagaggaagaagatggggaggggctggggaggccacgagtcaccacaggcctcccagcaggacagcagtgaaaggctccaggtcagccggccacactcaggcaggcccaaggaccgccccctcaggcgagctggcaccaaggcccgaggccactcccaatcaccctcccaggccctagcaggaccaagaccctgcaatgacaggggccagtggcaggaggttccagaatggggaagaaaggagtgtggctgagccgggacgccaccgtggccaggtgagccactcaaactgcgctgctgagaacaggaggtgggaatgttccccatactgccacggagctctcctgacagtggctccgcttgcagcagggctaagacctcatactcacgtccatgtagttcttgagcacctcgggaatgggcccctcggtcacggctggcaccgcctgggagtactttgagacggggcctttggcaatcaggtcctccacagagcccccaacctccgacatggtccggcggatggacgtgaacttgtgcagcgggatcctgtcaaccacgggtcggggcatatcagggaggccctcccgcctgccggccgacgctgccaatgctgcacatccacctggaggcccctggggaatctcagagtcgccacagccaaaaccaaactcctgcctgtcacctggaaactgctggcccagctcccccaagtcagtgaatggcaacccattgccccccgccaggttgcacaggccacagtcctaagaagtggtcacccgccacccacctcagccccacacacccaacctgggggccagtgtgcccaaccctcctctcctcagccattctggaggctccaaagcccccaagggtctcccgtcctccctctgcacctgcgctggtctcttccaggatggtggccagcatggctgctcagggtgctggcgggtacctgtcactcctgcccaaagtgctctgaggcagcccactgtacccagcccccatcacacctgctctccacccccagacacctgcacgaaggtggccccacctccaggctggcactggcagctctgcctggcctcctctggccatcagatgggccctccacaccacctccagaagccctccttgactacctgtcctcctccacatggaccctgtggctgcccagtgccctcatcccacatctgtttctgggcatccgcacctctcctcactccatgcggctccacgaggtccaggactgcacctggggccttagaggcttctgtgctgccccccccaccgccctgcctcctccgacagctgcactcagggtacccctccagagtcctgtcacccagcacaccgccagccagggtgcaggagggagctccagactgagatcggggtcctgagttctaaacccaggaagcgagtaagagagagaggggtccctgctcctcccccagggccactggccttccccttggtgtgaacccactccttgttccaaggaagctcccctgggcttttaatcacttaaataaaacctcttccctgccccagggacttgagagtacaaggtcatagctggcttttcctggcttgtcaggggcgtgatcccggaagatgagattattgcctaagagctggtgggctggaagagctccaggttttgtcctgggggagggacacgccctccagggaccaggaagcaggtgtaatagtatcagtcgcacaagagctggaatcgggtgagggcttggattcagctacccttccctccaagaagccccaggatcgtttcccctctgctgtgtctgtcctccttggagaggggaggcctgtggataggctggcaaggtcaaggcaggctcaggcttgtggctactcccccacaacgactttaattggggctacccgcccccgggccattccccacagcctttggtgaggctcagtcctacccagctggcccagccagctccagcccctgcagccttctgacctcacccacctgccaaaaggcagtggacccatcgcagatcccaggtctcccacaaaggcccagagcaagggtggggcaggtgcccaatgggatgggtcagcatacccctcctgggaatgcgggctgccttgcaagggctggggagggggtcaagaaagcagactgcagcatggccctcctctgcccagctggtcaggcatggccgggccccatcccatccaggcccaatcggtggcctcacctggcacaggggatcggcctgaggagcgtgtgggcctcactacagcacaaccccaggcccggggtgggtgagccgacccactccccatgcctcctcctctctcagggacatgggaactcctagggtctcgaggggtctcccagcccagggcctgtgataagagccgctggagcaaacttttaaagcccccagttcacaggtggtaaaggggtccctaaggaaatggactcgcccagactcgggggctctgaggcctgacctaggtctccagcaacaagggcgctcagtacagaccccaattccacctgccccgaatgagcactacctccccccgccccgccccgtctccagggaggctgcggtcagtctgcagtcctcaaggtacaacccagggtggcatatgggggagaggcatctggcgcctctgccccgggtcccctgcacctccggagcccggcgccccgtaggcgggtggtccgtgcaggaggccgcgcagggcggcacaggtgcattccagcgcggggggcgcaaggggctcgtgggggccacaggggagcgcgaaagtcaccacaggccccgggacctcggcgccgcgacccctgcccgtccctgagccccggcccctgaggcttcacctgacgagcgcggaggcggg

SEQ ID NO: 1208 - DNA, 6235 bp, Homo sapiens; identical to SEQ ID NO: 1207

SEQ ID NO: 1209 - DNA, 2165 bp, Homo sapiens
ctggctgccacatcggcactgccaaccggtggggtgcagccctgctgaagccccagagctcagcccagtgctgggcacatagtaggcgctcaggaaatgattgctgaatgtggaatgaaagtccccagcaggcaaaaggctgtgacttctgttagtggggtggtggtcctctggggcgagtgtatggagaacttcaaggcctcctcctggctgcccaggaagtagagggcgccaaaggcgacgtgccggccgccagctccaggccgagccccgagcgcctgcaggaacacgccccttcacccggcgcgggacgcagagctgcgagagaatcttgttcagcgcggactcaacgccagggcgccgcctagaggttggtctctgtctcggcctcacccgccgggagaccacagagctgcttccccagccgcccgccgccagaaattggaaaaaaaaaaaaaaaaaaaaaaaaaatccagctggggtctaggaactcggcttctggcacctctgaattctccgagactgtctcctccctccccgcctgtaatgaaccctgtgaagggagacaggccaggaagtcccagaaatatttattcttgtgactctcacaaaatggaaaagggtctcaatttttgtttctttaaggaacttgtgttctgcgtctgtgtctacactgcctcctctcaccaaccaaattgtctagcccccctccagttacgctagaactctgctttatcttcaaggaagaaagggagtggggagaagttacctctaaaccctccagcatggccatcaattttctgaataatttggaggtcaacatgcttttggaaaagtgtttggaaaacgtttgggggtgaaaagaaatgttgcctaactggcctttactcacggagtgaccatcatctcagctagttagtgtatgagcggcaccagcaccccggccatgggtgtctgtgctgagcctctgaaagttgacttatcctttggggagccctcggaaagacacagctggtatctatgggaatggctttggggtgtcctttggcaccatacagataattttgtttttttaattggaatccatggcctgggttcttgggatgggggtagggggaagccacaaagcccctggaaatgtatgcaaaacatatgggtgtgcaggtgcatcatcctaaggctatggcctcttcagtttttccaaagagtctaagactataaaaggtttccatctccttttctcagccagggagccacagagacccaggccagcagtaggctgggagccagcacaccggcccccaccaggtgcccggtaggggatgggtaataacactcttgaatggtctggaaactgctggcccctcagtcctgccgtcctcccagagggaaatcctaatagaagaagtgacagccagtagctgccatctcagtattttgaatgaaaatataacatgataaagagcaaatgagggaggctggaggggcctccccatgcaaatactggaatatgaatgttggccagaaataagatacttcctgccctccagctgttaaagagctccccaattcctcccttttggtgctaggaaggggccagagggcactgcccccagaccaccacccacctctggagagctggggccgagtgggactgcctgcagcagagttaacccttcagaaaattcaaaacctatactgcctagtattttccctgcccgtttattttttaatcagatttttaaaatatccagcagcactttggtgccttttcttggggttggggagtggggttatctatgtgtgtatctatgggaaggtgggtgccttcagtgcactaaaccccctcttgggcctgcagctggacctcactcctgtacctgaacactctgcctgagcctgagctaatcttagccatccattgtgtctcaaaactgttttggaggtgaataactgtgaggcaggatggagaaccttttgctctcccatccagaagggcacctaaccaggcccctggagcagacaaaaggagcaggaagtcaatcacttcgatcccagttctctgaagcccaagaagaaaacggattttccttcgttttggttcggaggcctagtagagaatttggattccaccaagttctcttttttcaaaaaaagtaaacggt

SEQ ID NO: 1210 - DNA, 2165 bp, Homo sapiens; identical to SEQ ID NO: 1209

SEQ ID NO: 1211 - DNA, 3123 bp, Homo sapiens
ctcagaaataaagagaagagcctgcaattccaggatagcacgctaacgaagggccaaaacgcaaaggcgtcctgagggctaagatggaaagtgaaactttcaagctccttctctaaccttggccaaggtcgttccctctgggttcatagaatagggaggaacccatgtaaggcacagggaacagaagaaaggaggcaggtagagggacaaccttcagcctggtgcagccatcccggtcgaacaaccccaggcaggagccgctcggtggccgaggatggcgggaagtcgctgggctgcggctggggcgggaggtgggcggaggagggtccggcgctctctttctccggattcggagccctaagtgtggatcagtcgcctcccgcccagggtgtgagcgccccctccccttctcagcctccttcggcctcgcccctccctctcacatttccaactcccaaggataacttgtcgctcgcttcagacgcccatggcttctttcagcccctgggactcagctttctcctctacctcttttgtctatttgtgcatttgatgtttctctgggcgcgcccttggatctgcttctctcttgccttttatattctcatattctcatattctctctctctctctctctctctctctctctctccctccctccctccctccctctctccctccctctctccctctctgcctctctccctctctctctcttctctctctctctctcttctctctctcttctctctctctctgctctctccggccatctgggcgctgctcctccgcgcctctggcctccccgcggcgcgccaggcccatctcctcaccagccgctctgggatccgacggcgccgtgggtgggggcaggtgagacggccgagccccgcccgggcggaggcaggaagcgctctcgcctatccccctcccggaccctgtcctcgcccgccactcaccggcgccaggggaacgcaggagcgtgagccccttcgcgcccccagcgccgtcggcgtcgctgccccagacacagacactgcctcgagaggcctcacagaggcgggggcagaaggcggcgacccagagccgccacatcccccgccttgggcgccgtcacagtccccagacgccctggactcctgcagtctacgaagacgcgcgggggacggcgtggttccgagagagggcgccaaaggcgacgtgccggccgccagctccaggccgagccccgagcgcctgcaggaacacgccccttcacccggcgcgggacgcagagctgcgagagaatcttgttcagcgcggactcaacgccagggcgccgcctagaggttggtctctgtctcggcctcacccgccgggagaccacagagctgcttccccagccgcccgccgccagaaattggaaaaaaaaaaaaaaaaaaaaaaaaaatccagctggggtctaggaactcggcttctggcacctctgaattctccgagactgtctcctccctccccgcctgtaatgaaccctgtgaagggagacaggccaggaagtcccagaaatatttattcttgtgactctcacaaaatggaaaagggtctcaatttttgtttctttaaggaacttgtgttctgcgtctgtgtctacactgcctcctctcaccaaccaaattgtctagcccccctccagttacgctagaactctgctttatcttcaaggaagaaagggagtggggagaagttacctctaaaccctccagcatggccatcaattttctgaataatttggaggtcaacatgcttttggaaaagtgtttggaaaacgtttgggggtgaaaagaaatgttgcctaactggcctttactcacggagtgaccatcatctcagctagttagtgtatgagcggcaccagcaccccggccatgggtgtctgtgctgagcctctgaaagttgacttatcctttggggagccctcggaaagacacagctggtatctatgggaatggctttggggtgtcctttggcaccatacagataattttgtttttttaattggaatccatggcctgggttcttgggatgggggtagggggaagccacaaagcccctggaaatgtatgcaaaacatatgggtgtgcaggtgcatcatcctaaggctatggcctcttcagtttttccaaagagtctaagactataaaaggtttccatctccttttctcagccagggagccacagagacccaggccagcagtaggctgggagccagcacaccggcccccaccaggtgcccggtaggggatgggtaataacactcttgaatggtctggaaactgctggcccctcagtcctgccgtcctcccagagggaaatcctaatagaagaagtgacagccagtagctgccatctcagtattttgaatgaaaatataacatgataaagagcaaatgagggaggctggaggggcctccccatgcaaatactggaatatgaatgttggccagaaataagatacttcctgccctccagctgttaaagagctccccaattcctcccttttggtgctaggaaggggccagagggcactgcccccagaccaccacccacctctggagagctggggccgagtgggactgcctgcagcagagttaacccttcagaaaattcaaaacctatactgcctagtattttccctgcccgtttattttttaatcagatttttaaaatatccagcagcactttggtgccttttcttggggttggggagtggggttatctatgtgtgtatctatgggaaggtgggtgccttcagtgcactaaaccccctcttgggcctgcagctggacctcactcctgtacctgaacactctgcctgagcctgagctaatcttagccatccattgtgtctcaaaactgttttggaggtgaataactgtgaggcaggatggagaaccttttgctctcccatccagaagggcacctaaccaggcccctggagcagacaaaaggagcaggaagtcaatcacttcgatcccagttctctgaagcccaagaagaaaacggattttccttcgttttggttcggaggcctagtagagaatttggattccaccaagttctcttttttcaaaaaaagtaaacggt

SEQ ID NO: 1212 - DNA, 4914 bp, Homo sapiens
ttttgcattccctgaaacaaacgacactatggtgtattttcttttggggggcagtaaataaaagtcttttatgttgacaatgataatattatattctacaatctatttgcatttctctatcctgtggattttattgcttagtataaatccccaggctgaggtgcattaagcttcactcagagagaaacaatgcattttatcatagggccggacagctatatgcacaagatgctacctgcagagattggtttttgcccagatgtgcaggagagatgcacagagaggaagaaatgcatacatgtgtgcaggttttggcgtgtgcacaagaagcctggaaggattttctttggatctacagtcaaaatggatttccgagaggaagctgtctgaaaacacacctcttccctgtgctacatacggtcccatctctgccagccaggttgtcaggaaagtgatcagcactggcttcaactctggctagagctctttggccaatgtgatgggcagaaaactggaatgaggacagaaaagcacctcagaggtttgaagagtctagtctctcaccaccttgctgctgagacttatttgaatgcctgtttcatatggagcttttaagtgtaacagttgtgagtgaaattgccccttttcaagcgctccgagtttgcttctgcatggaaggggaagatggactagagctgatacctcctgcaccctggtgaagaaatgcaccctgaggccagaaaatagtacaaacccatctggctgcaacagtccagcagcatgaagatcaaagtcacgtagtagagccagagagaaatttgccctgggcctaatattcatgaagcctttccaattcagactcggtattattgccaagtcggtgtgtttgggagaaatcagaagccaacacactagaaaagttgcaagagattcctaggggaacccacaaattcagttccttgccagaaacctgctcctccagatgaatctagtgcatcagatgggctcagaagcacaggtggcgcaggcagacctctactgagaagaacaacagtggaaggcagatgaaactcacattttggagtctgagagccatgcgggcccaccccagttacgtctacccctggtcggtgaccagagaatcctttagcagcaacagcagtgatgtttatttcactggtatgtataaagcgactgattgaaaacaagctgtatgcccaacaacttggaactggttaaatgatttttggttcagccgcacagtggaatatcatgcggccattaagaataaataaaaaatcctatactttccatgttcaactttagactgcaaacaactgaaaaaacaccttcataattaggcttcctcagattagaacgtgaagtcaaatcaacgtgtgtcagaaagttaacaacagctaactgtttgttgtggtgttctgagtaacttgtattatttttcagtttttttcccattcctaatgtgcaaatgtactatttttattgtaaaaaaaaatacatgtttgtaaagagcaataacataaatctctgcataggcaaattgaaaggaaatcagacaaaatgataccttttggtagtggaattctaaatcatttttttcttcattagagtttctgaattttctgcatttgatatgtttacctttataaagggtcaatcatatttaagatgattttttaaaagacaagtggacagggaaagagaggtctgctgttgcaaaaccaaagctggaggctctccgaagcccacttatgttagtcaattgatatttcatgaaactctagaatgtgcaaatcactttccacggggattgggggggtgagaaatacagagatgaaggagatgcaaacactttaatcaaagaaatccgtctggttgggaagagaaggttctgcattatataagttgcaaggtcttatccaagaggttagtctgtcaagagtaatagcaataattacacaacaatatgtcagagaggctgggagctccagcttcaaagccaccttgcctggggagaaacttaaccatattgggcctgagcctcagttacctacctcttctgtaaatgtaaactacctcttggggtccttgtgaggattaaatgaaacttgagcctaaaggggctgagctaggtgctttgcaaataacccaaccttagcatgaggcacgttatcatcattacggctgtggtgtttgtggtcacctatctgcaagtcacgctttcatagatatggctgagctgggatttgaacccacattgatctaattccaaagccaatgattccaccccaaccagacactgcatttactctctatgcctaactgaaatttgttctaaacctcaccctaaggtcttgccagaaagaaaagctaaattttcattaaaagatgaaaggagaaatgaatctgtttcaaaggacatgagaggaagaaggaaatatcccttcatgaaggattttgcaactttgtccatgcttctgcagggtgtaaaagtaaaaatcctatacttcccatattcaacgttagattttaaacaactgaacaagcactttcacaattagccttcctcagattggaatgcgaagtcaagccaacgtgtacctcttactgcagaagatttctgcactgtgaatgtgataggatttgcctccttaaccagagggtgctggtttttcctggctggagggtagaaggtcatgaatagaggacaaagcacagggaaggggcagcatgtcgggaagagccccaaggatctcagtatgaaaataaagaggtgtgagccaactgcccataggtttgggctatgagtctggggaaactgtttcaaaatcaatggaggcccaaaggcagagggaaaattctgtgtatggacttccatgtcattcagaaatgttaactccttgaaaagagttaatatatttttttcttttttaaacatttcaataggtttttggggaacaggtggtgtttggttccgtgggtaagttctttagtggtgatttctgagattttggtgcacccatcacctgagcagtgtacattctacccattgtgtagtcttttatctttcactcccctcccacttagaataatgttctccaattccatccaggttgctgcgaaggacattatttcattcctttttatggctgagttgcattccatggtgtatatatatataccacaatgtctgtatccactcattgattgatgggtatgcaggctggttccatacttttccaattgcgaattgtgctgctataaacatccatgagcaagtatctttttggtataatgatatgttttcctctgagtggatacccagtagtgggattgctggatcaaatggtagttctacttttagctccttaagtaatctccacactgtttttcatagtggtggtactagtttacatttccaccggcaatgtaaaagtgtttcttcctgtccctctggtcatctgtttttttaagggatctacctaaactcaaccataacccattccatccacctcatcttgcctcaagctaagaaataggagtgcagagaagaaaacagtacagataagaatgctagaaggttgtgtgtttgaataagaaggaacatggatcaggtttcaagtacagtacctgaggcaggtatgaggtagtagctaatggggtgaggtaggcagaaaaggcttctaaagaagcaggtacttgagttgggtcttcaaggccatagtgagtggtttcccggtggatctgagaaaggaaggtgagtttagagaaagggaagagcccgcagtgaggcatgaaaatgtacactgtgccttcagcgagcttggtgggtggcaatgtctggatccaagtgcgtgtggaggagactttgcacaataaggccactaggcaggtaggacggcccccagagggttttggctgacaagctgagggacatgctataagggtaggggccaggggaagagatggctccctggcagtgggtcccctgtgtgctcggcagctcatggataacagaggataacaggcctgtacctccatattgcccaacatgttatcacatcttcagtttggagagaagaattaaattcgtctaagtttataatttaccagatgactttggataagcacatatttggaacctcagataattcatccattcatttgctcattcagaacagttcttgcgcatcactttatattcagtgctgctgaagtttctttgggggctacacaggttagtaaggcttggttttcatctcaggaaccttatagccagaatgagggagaggtgagtactaactccacagtgttatcccagtcgctactcatttcccttaccaccacgccttcaaacacttcagtgtactttcagctctcaggaaaaatgcaaactttcatctgggcctaagaatctctatatgaactacccctgctcacctccggagaggcatccccttccaccaccctcccctccttcttctctatcctcattgctcctttcaatggtcctgacaggatccctttcagccacaggcccttagcaaatgctgctctcacggcccaagtcatcttccctggttcatgcctacttcggattaaagttacccctccggagagtgttcccgatcaatctgaattgaccaagtccttattacacactctcaaactccatgagatgtccttcatagctctcatcccagttataattagtttgcatttatttacacaatggctgtattaatttctgtattctccaccagaatgagagcttcatgagagccaggatgtgtgttttctcaaaatctgctttattgtggtctaatttgtgtataataaacacacccatgttaggtgtacccatcaatgaatttttagaaatttattaaaaat

SEQ ID NO: 1213 - DNA, 4909 bp, Homo sapiens
ttttgcattccctgaaacaaacgacactatggtgtattttcttttggggggcagtaaataaaagtcttttatgttgacaatgataatattatattctacaatctatttgcatttctctatcctgtggattttattgcttagtataaatccccaggctgaggtgcattaagcttcactcagagagaaacaatgcattttatcatagggccggacagctatatgcacaagatgctacctgcagagattggtttttgcccagatgtgcaggagagatgcacagagaggaagaaatgcatacatgtgtgcaggttttggcgtgtgcacaagaagcctggaaggattttctttggatctacagtcaaaatggatttccgagaggaagctgtctgaaaacacacctcttccctgtgctacatacggtcccatctctgccagccaggttgtcaggaaagtgatcagcactggcttcaactctggctagagctctttggccaatgtgatgggcagaaaactggaatgaggacagaaaagcacctcagaggtttgaagagtctagtctctcaccaccttgctgctgagacttatttgaatgcctgtttcatatggagcttttaagtgtaacagttgtgagtgaaattgccccttttcaagcgctccgagtttgcttctgcatggaaggggaagatggactagagctgatacctcctgcaccctggtgaagaaatgcaccctgaggccagaaaatagtacaaacccatctggctgcaacagtccagcagcatgaagatcaaagtcacgtagccagagagaaatttgccctgggcctaatattcatgaagcctttccaattcagactcggtattattgccaagtcggtgtgtttgggagaaatcagaagccaacacactagaaaagttgcaagagattcctaggggaacccacaaattcagttccttgccagaaacctgctcctccagatgaatctagtgcatcagatgggctcagaagcacaggtggcgcaggcagacctctactgagaagaacaacagtggaaggcagatgaaactcacattttggagtctgagagccatgcgggcccaccccagttacgtctacccctggtcggtgaccagagaatcctttagcagcaacagcagtgatgtttatttcactggtatgtataaagcgactgattgaaaacaagctgtatgcccaacaacttggaactggttaaatgatttttggttcagccgcacagtggaatatcatgcggccattaagaataaataaaaaatcctatactttccatgttcaactttagactgcaaacaactgaaaaaacaccttcataattaggcttcctcagattagaacgtgaagtcaaatcaacgtgtgtcagaaagttaacaacagctaactgtttgttgtggtgttctgagtaacttgtattatttttcagtttttttcccattcctaatgtgcaaatgtactatttttattgtaaaaaaaaatacatgtttgtaaagagcaataacataaatctctgcataggcaaattgaaaggaaatcagacaaaatgataccttttggtagtggaattctaaatcatttttttcttcattagagtttctgaattttctgcatttgatatgtttacctttataaagggtcaatcatatttaagatgattttttaaaagacaagtggacagggaaagagaggtctgctgttgcaaaaccaaagctggaggctctccgaagcccacttatgttagtcaattgatatttcatgaaactctagaatgtgcaaatcactttccacggggattgggggggtgagaaatacagagatgaaggagatgcaaacactttaatcaaagaaatccgtctggttgggaagagaaggttctgcattatataagttgcaaggtcttatccaagaggttagtctgtcaagagtaatagcaataattacacaacaatatgtcagagaggctgggagctccagcttcaaagccaccttgcctggggagaaacttaaccatattgggcctgagcctcagttacctacctcttctgtaaatgtaaactacctcttggggtccttgtgaggattaaatgaaacttgagcctaaaggggctgagctaggtgctttgcaaataacccaaccttagcatgaggcacgttatcatcattacggctgtggtgtttgtggtcacctatctgcaagtcacgctttcatagatatggctgagctgggatttgaacccacattgatctaattccaaagccaatgattccaccccaaccagacactgcatttactctctatgcctaactgaaatttgttctaaacctcaccctaaggtcttgccagaaagaaaagctaaattttcattaaaagatgaaaggagaaatgaatctgtttcaaaggacatgagaggaagaaggaaatatcccttcatgaaggattttgcaactttgtccatgcttctgcagggtgtaaaagtaaaaatcctatacttcccatattcaacgttagattttaaacaactgaacaagcactttcacaattagccttcctcagattggaatgcgaagtcaagccaacgtgtacctcttactgcagaagatttctgcactgtgaatgtgataggatttgcctccttaaccagagggtgctggtttttcctggctggagggtagaaggtcatgaatagaggacaaagcacagggaaggggcagcatgtcgggaagagccccaaggatctcagtatgaaaataaagaggtgtgagccaactgcccataggtttgggctatgagtctggggaaactgtttcaaaatcaatggaggcccaaaggcagagggaaaattctgtgtatggacttccatgtcattcagaaatgttaactccttgaaaagagttaatatatttttttcttttttaaacatttcaataggtttttggggaacaggtggtgtttggttccgtgggtaagttctttagtggtgatttctgagattttggtgcacccatcacctgagcagtgtacattctacccattgtgtagtcttttatctttcactcccctcccacttagaataatgttctccaattccatccaggttgctgcgaaggacattatttcattcctttttatggctgagttgcattccatggtgtatatatatataccacaatgtctgtatccactcattgattgatgggtatgcaggctggttccatacttttccaattgcgaattgtgctgctataaacatccatgagcaagtatctttttggtataatgatatgttttcctctgagtggatacccagtagtgggattgctggatcaaatggtagttctacttttagctccttaagtaatctccacactgtttttcatagtggtggtactagtttacatttccaccggcaatgtaaaagtgtttcttcctgtccctctggtcatctgtttttttaagggatctacctaaactcaaccataacccattccatccacctcatcttgcctcaagctaagaaataggagtgcagagaagaaaacagtacagataagaatgctagaaggttgtgtgtttgaataagaaggaacatggatcaggtttcaagtacagtacctgaggcaggtatgaggtagtagctaatggggtgaggtaggcagaaaaggcttctaaagaagcaggtacttgagttgggtcttcaaggccatagtgagtggtttcccggtggatctgagaaaggaaggtgagtttagagaaagggaagagcccgcagtgaggcatgaaaatgtacactgtgccttcagcgagcttggtgggtggcaatgtctggatccaagtgcgtgtggaggagactttgcacaataaggccactaggcaggtaggacggcccccagagggttttggctgacaagctgagggacatgctataagggtaggggccaggggaagagatggctccctggcagtgggtcccctgtgtgctcggcagctcatggataacagaggataacaggcctgtacctccatattgcccaacatgttatcacatcttcagtttggagagaagaattaaattcgtctaagtttataatttaccagatgactttggataagcacatatttggaacctcagataattcatccattcatttgctcattcagaacagttcttgcgcatcactttatattcagtgctgctgaagtttctttgggggctacacaggttagtaaggcttggttttcatctcaggaaccttatagccagaatgagggagaggtgagtactaactccacagtgttatcccagtcgctactcatttcccttaccaccacgccttcaaacacttcagtgtactttcagctctcaggaaaaatgcaaactttcatctgggcctaagaatctctatatgaactacccctgctcacctccggagaggcatccccttccaccaccctcccctccttcttctctatcctcattgctcctttcaatggtcctgacaggatccctttcagccacaggcccttagcaaatgctgctctcacggcccaagtcatcttccctggttcatgcctacttcggattaaagttacccctccggagagtgttcccgatcaatctgaattgaccaagtccttattacacactctcaaactccatgagatgtccttcatagctctcatcccagttataattagtttgcatttatttacacaatggctgtattaatttctgtattctccaccagaatgagagcttcatgagagccaggatgtgtgttttctcaaaatctgctttattgtggtctaatttgtgtataataaacacacccatgttaggtgtacccatcaatgaatttttagaaatttattaaaaat

SEQ ID NO: 1214 - DNA, 4909 bp, Homo sapiens; identical to SEQ ID NO: 1213

SEQ ID NO: 1215 - DNA, 1733 bp, Homo sapiens
caggctgcctgagctagtagtggcaaccagcttgcgtccgtttccatgttgtgggagatttgttctttcgctctttgtggtaaatcttgctactgctcactctttgagtccacactgcttttatgagctgtaacactcaccgggaaggtctgcagcttcaatcctgaagccagcgaggccaccagcccaccgggaggaacgaacaactccagacgcaccgccttaagagctgtaacactcaccgcgaaggtctgcagcttcactcctgagccagcgagaccacgaacccaccagaagaaagaaactccgaacacatccgaacaccagaaggaacaaactccagacgcgccaactgtaacactcaccgcgaggatccgtggcttcattcttgaagtcagtgagaccaagaacccaccaattccggacacactaaaatagctgctgccccactcctgtgccaaaatctgctccaagggatcctatcctagtcagaaggctgtactctgaatgctgatattagctacaacaccaaggcttcccactatacaaactggatcctcaaagtcatccacaccaaatgaactctctattctttctcccagtagcctgagaactgggtttaccagccttggcccttcctttccttctagcctcaaaacaggatgggaacagagtctttggctgtgagaatgggctcaataacaaaataaagatgacagaagagtcagtgacttcaatgacagagcgatagaaattaccaatataaacggagagaaaagagattttttaaaaatgaacaaatccccaaggacctgtgagacaataactgtgttaggttttctaaacttacaagtgtttttatttatatatggtaagcaactatgcattatttgtgtcagaattattttttgtatatatttaaggtatacaacatgatgtctcaacatacttatatgtagtgaaatggttactacagtcaccacacttattgtctcacaggttattgtcttcagaaggagagtaaaaagaatgctgggtagaagaaatacctgaagaaataatggcccaacctcaaatttggtgaaagacataaacttacagattcaagaaactgagtgttccccaaacagaataaactttaaagaatccacactcaaacacatcataatcaaacttctgaaaactaacaacaaagaaaaacttaaaatcagcaagagagaaaccacacattatcaactgatgaaaagtgactcaagtgacagcagatttataatcagaaacttgaaggacagaaggaagaggcaaaacattttgaaagccctaaaaggaaagaactgtcaacccagaattcgacatccagtaaaaatatccgtcaagaatgaatatgaaggaaagctaagaatgaatatatcttctatttctttgctaaatttttctactttttcatttgatgtaagagtgtttataagtgcttatggagcatttttatgatagttggtttacaatccttgtctgagagtagctatgtgagatgacgtatatagtaaatggtgactgtagtaaccatttcactacatataagtatgtcaaaacatgttgtacaccttaaatatacacaaaaaatagctctgacacaaaaaatgcatagttgttattaccatgtataaataaaaatacttgtaagtttagaaaataaaatcattgtctgataattatctaaataataaagtcca

SEQ ID NO: 1216 - DNA, 1168 bp, Homo sapiens
aaccaggctgcctgagctagtagtggcaaccagcttgcgtccgtttccatgttgtgggagatttgttctttcgctctttgtggtaaatcttgctactgctcactctttgagtccacactgcttttatgagctgtaacactcaccgggaaggtctgcagcttcaatcctgaagccagcgaggccaccagcccaccgggaggaacgaacaactccagacgcaccgccttaagagctgtaacactcaccgcgaaggtctgcagcttcactcctgagccagcgagaccacgaacccaccagaagaaagaaactccgaacacatccgaacaccagaaggaacaaactccagacgcgccaactgtaacactcaccgcgaggatccgtggcttcattcttgaagtcagtgagaccaagaacccaccaattccggacacactgttattgtcttcagaaggagagtaaaaagaatgctgggtagaagaaatacctgaagaaataatggcccaacctcaaatttggtgaaagacataaacttacagattcaagaaactgagtgttccccaaacagaataaactttaaagaatccacactcaaacacatcataatcaaacttctgaaaactaacaacaaagaaaaacttaaaatcagcaagagagaaaccacacattatcaactgatgaaaagtgactcaagtgacagcagatttataatcagaaacttgaaggacagaaggaagaggcaaaacattttgaaagccctaaaaggaaagaactgtcaacccagaattcgacatccagtaaaaatatccgtcaagaatgaatatgaaggaaagctaagaatgaatatatcttctatttctttgctaaatttttctactttttcatttgatgtaagagtgtttataagtgcttatggagcatttttatgatagttggtttacaatccttgtctgagagtagctatgtgagatgacgtatatagtaaatggtgactgtagtaaccatttcactacatataagtatgtcaaaacatgttgtacaccttaaatatacacaaaaaatagctctgacacaaaaaatgcatagttgttattaccatgtataaataaaaatacttgtaagtttagaaaataaaatcattgtctgataattatctaaataataaagtcca

SEQ ID NO: 1217 - DNA, 784 bp, Homo sapiens
gcacagcacattcctgaaggaccttgacctagattctcccaccgtagttggttattgtcttcagaaggagagtaaaaagaatgctgggtagaagaaatacctgaagaaataatggcccaacctcaaatttggtgaaagacataaacttacagattcaagaaactgagtgttccccaaacagaataaactttaaagaatccacactcaaacacatcataatcaaacttctgaaaactaacaacaaagaaaaacttaaaatcagcaagagagaaaccacacattatcaactgatgaaaagtgactcaagtgacagcagatttataatcagaaacttgaaggacagaaggaagaggcaaaacattttgaaagccctaaaaggaaagaactgtcaacccagaattcgacatccagtaaaaatatccgtcaagaatgaatatgaaggaaagctaagaatgaatatatcttctatttctttgctaaatttttctactttttcatttgatgtaagagtgtttataagtgcttatggagcatttttatgatagttggtttacaatccttgtctgagagtagctatgtgagatgacgtatatagtaaatggtgactgtagtaaccatttcactacatataagtatgtcaaaacatgttgtacaccttaaatatacacaaaaaatagctctgacacaaaaaatgcatagttgttattaccatgtataaataaaaatacttgtaagtttagaaaataaaatcattgtctgataattatctaaataataaagtcca

SEQ ID NO: 1218 - DNA, 2254 bp, Homo sapiens
ttttaaattgccaggttttattaagataattggcaaaatttcaacatacaccttacctgaatgaacacttttaataaaatatgaaggatcactcatgactacaactgaactcaaaagtgagatgtagagcagatttgtaaattgataaatttatttggtaagaaattattcacttcattcgcttcactccatagagaattctttgcagagaaatgttatgaacaagagaacaaagcctgtctctcaccaaagagcacctagagtaagagtttacaatgatgtatctggattatctaattcatcaaagtttatttccttttcaaaaacaactgctgtgtcagtctggagttccctatttcatgttttctaattattacaataaatagtcttcaaaatagaagataaaatgctgctttaagaagtaacagttatttttcaacaccataccatttgtctggaaaatcattgtgttgtaatactggtggtatcttactttgttttgcaagagacatttaagctatttgcagatcagaatagaagagtgggcatttgtcctttaacatcacgtgattttcaaaggtgaaaaaaatttcttttgctaacttacgattcaaagaaaaatggtctcaaattaaagtgtggacaaaactgtagtattcccttttatagccttgcttaggtaagaatgttcactgagtgaataaattaggtttaaaaattaaaacaataatttagatcattttcccacaaagccttatcaaggatttgatggggaaggaagcacttgaaccacagcagttttatctgtaaacactgaacttggccatgcatcattttcatctgcccactggatgttgcacttctcactggcacagtgtttcaacagtggagtgtggttgtcatgaaaatgcagtattgacactataccactataaatgtggtcaaaattagactcagtgttgacattgacattgttgccattgtccttggaaaaggtgttactttcaaggagcctcctaaatgcaacagtaactttaatcataataattcaaggacaatggatggcacttctaggtaaagaaaaggtatatacatatgtgtttctacccatcctctttagtacagacctaaatgggattaatagccccagtgtgtgttgctgtaatgttgcctaacctcatgtccctcaaaagtacacatctagaaagtgaacaaaggaaacctgtaaattagggactgactccctttgaaactcacagtgaatgtacaaggagtttgtaatgacttcagttggtgacctgaagtttgtttccctaaccaatattacactcttgtttggatttattttactatttcctattctaacttgtttagcaggcaaacagattgatgcagaccatgttaaattgaaaaagggatactgccactctttaaggattgagtgtagaactttcaccaccactaaattacacaatgaataaaaatacaaaacacataattcacagactatacctcagcattaacagtttatagatattatatagatacttttatatctgtctaatatttttacaatcaccaggtacaccatcattaaatacaagttacagaaatatgtagataccattagttagagggttacttattgcttacgtcagcaagcagcaaataagggcacaggatttgaactgaagggaactacttcctatcaccagtggcgttaagagagaacactgcatttcacaaagcactgcttttatctagtttatagaaccaagagcagcatatatcagaccaataaccactattttagtatgtattatagaattttaaaggatttaccttacaaatggtacctaactactctataaatacgcatgttgtgaacaaatgaatagttgctatttttcacaatattggtttataacgaccacactagaactactttgctttattttgtagagagctaatggcatgagaaatgagttaacactgctgtgtagtcggacctacaaaatccagacccctaaagatgggtctgtgtttgtcccagttctatccagccatttttttccccactgagaaagcctagcatgtgtagtaactttttccctttaccctctttattctgatcaaaaacattaccaatagacaacaatagaaattttaaaaagcttttttttttacttcgctaagcactttggactataatgtgtaccaatagtctgctgcctttgttttcttgttttcttag

SEQ ID NO: 1219 - DNA, 2013 bp, Homo sapiens
acaaaattcatttcttttcttgaccttgaaaatttctgttttccaaatacctaggaaaaatgaataccttctgcgttgaatccatgtagcaatctgaaaaaagaaatcaaaatggaatggtactgaaaagctaatttgtagcacataacggtatatagttctataccattaatactaaaacatgaatacagcatgcttacagagcccacccactcctaatactagttattaaagaaacgttactggctgggcgcagtggcttatgcctgtaatcccagcactttgggaggctgaggcgggtggattacctgaggtcagtagttcgagaacagtctggccaacatggtgaaaccccgtctctactaaaaatacaaaaattagcctggcatggtggcacatgcctgtaatcccagctactcgggtggttgaggcaggagatttgcctgaacccaggaggcggaggttgcagtgagctgagattgtgccactggagtccagcctgggtgacagagcaagactctgtctcaaaaaaaaaaaaaaaagaaatgttattgtctgactaaatttataagatatgtattggttaaaaccatgccatgttggtgcctctttcattagagcctttatgtcgtaatgaatttgactaaaattatcttagactttcattatcccaggcctaagaactcactggcatttgtttcaaggtaactgaacaagaagctgtttggaattggcagaagtcagatgaaaaaccaatcttacatgccccttcttcctctcttgagctgttgtttatattcaaattaaatacacattgtttctctctgtagatacctatgtacttaatagattctagttagtaaactgcacatgcccaataactttgaggaaatttagtgaaaatgaagaaaaagagaaaatatttctctttagacctgaggttatgtttaggctggcccatagaaacaggtccagataaatttctaaaaaagcaaagtagatatttatgaatagtattcaatgcctaggattaacatctaaaatgactcagtagtactgctagccagccaataaaatataaactccatttgtcttagttatatagaactgtgtttccagcttagaaaaagtcaaaccaatgacttttagaacaatctactctcattttttattcagcctctagaacatggaagctttaaaagtgaattggctaaataggcaagaccttctgaaagttaacatcttaatgattaaaaacagtaagtacaggttagtaattacctgggtaattaattgaagccttattctgttttcataagacttacttgcttaattcaagcaaaacaaattttggtctaaattacctagataattatgacagctttttacttgagaagtgtagaacttgcttcaggctacaaaactgtattattcctaaatggataaccaggtaggattctaactggcattattgtatgcttaagattgatttaacaacagctattcccagtaaggaaattttaaaaatcagatccagttacatgtattatgatttttctaccttatggactattttggagggataagctattaagactaagactatgaatgagagttggggaaggagcaggaagggaggaacctgcacaccacattggaacctgcacaccacattaacacaaaggcaatcttctggctcggactgttctttactactgttcttaaagaaaatgttcattctgctgcagctaactagcctccatcttctacaccaaatactattccatgccatggaagtgctatgcaataactctcccaggtagcaccttataccgcttaaaagcctttaaaatctccaatctgaaggtgtcacagtaaagaaatgtaaacacttaggaaaacaaaaatgtaattacctgatgaagtcatctatgtccatggaacgggcccgtttgtcactaaaacctgtgctggttaggatttgctgtattttatctgctatgctgaaatctt

SEQ ID NO: 1220 - DNA, 2016 bp, Homo sapiens
tggggccgtgcggacgaagattctgccagcagttggtccgactgcgacggcgggaggcctcggggagcccctcgggaagggcggcccgagagatacgcaggtgcaggtggccgccggatcccagccgcactgtgggaagacagatagggaagctggtcacccacaggcctaccgttttccaggaacgagggtgcccatttcccctaacacgccaagctggatctcaccacggcggcggcgcctttgcacaagttatttcccctaccaagagcatttctccgtgcgggcgcggtggctcacgcctgtaatcccagcactttgggaggccgatgcaggtggatcacttgaggtcaggagttcaagaccagcctggccgatatgtggccaatatggtgaaacgcccgcttctactaaaaataccaaaaattagctgggcatggtggctggcgcctgtgatcccagctactcgggaggctgaggcagaagaatggcttgaatcggggcggtggaggttgcagtgagccaagatcgtgccactgcactccagcctgggcaacagaggaagactccctctcaaaaaaaaaaaaaaaaaaaaaaaaaagggcatttctccccttgaatctcctgaatctcagtatggctggctcctcctcttccttccagcctgcctaaaataggaagcaccctattttatttccttgtgtatcattcatattccctacttagaatcttagcttggttgacactgtgcctggcacacaataggtgcttagtaaatacttgaaggaattaatgtatatctgatattcaggcagcctgagattccaaccatggctctgcttttcttctggcagtcaaaaacttacttgcttcacttatttatttatttattatggtcttgctgttacccaggctggagtgcagtggggcactcatggctcagtgcagcctcaatctcctggattcaagtgctcctcccgcctcagcctcctgaataactgagactacaggcacacaccatcatgtctggctaattttttttaaacatttttggtagagatggattctcgctatactgcccaggctgcaatgttctggcctaaagcgatgctcccaccttggcctcctaaagtgctgggattacaggtgtaatcccgagaaatgaagagtgccaaacccatcacattccagactactgagcctctaggaatcacagcccctcaggctggtacaagtgttagggagactggggagactggggtttgagggtgccttaacctagttgctaggcttagcaagggtgagaggtttgccggagtcacacggcacagatgggtttagggcgggctaagagtgtgcccctctgcctgccccctcctgggtcccaccacagcccagacctcatccagtgccctgcacccctggagcctccatggagggcacagagatggggaaaatactctcctcctcccctaacaagtcgctcgttgcatgtgactttagcagtgccttgacaagcgatttcatcagattcagaaccagctccagctggctctgcccatcacaaacttctatccatgcaccacacccccattgtttctcttggatcctggccccagcccaggtcagggaccatgcccacaccgcacgcccgaccccgtccccgggtttcccaggtgctgtgcacattcaggagggtccctggcatccctgtacctcagtttccccatttgcaacttggggacaggttataacctcccacgttgtgggtgcaaatcaggcatcggctaccccatcagacccaaggggatccaggatattcctacccagggcacagatggggcaactgaggctcaaaggtaggtctgggcttttcaagatgaggaatccctgattagatatgggggctgcttggggggtgggaggggatctctaagatttcacttaccttctggcgtgagtatccggactgcaggggccgggacgaggtcggtgttcgaatcttcccagctctgg

SEQ ID NO: 1221 - DNA, 1209 bp, Homo sapiens
tgtaaccaggccagccctctagaataacagagcctgaagtgaggaggagaaaggtggggagaaaaataagagctggaaaacacatggccctaaacaggcactggcgactgcccctggctgcctctctgaattcatgtcacatcacaacagcttgcctggcacttgtttcctcagttgctgtttcctggagctccttccatcagggtgggtctttctgacctgcaagtcccctccatacctcataagccttgggcagatgctcagtgagtatccacagtatggacgaaaaatgattcaacagcttcctgcacccaaaccaggtcagaccatcggggcttgaggagtattacagagtggcaggagtaataatagctaacattctccaggcacccccagtgtgtccagccactatactgaacacttcacataggtgctctcattcactcctccaaacgaccctgagagataggattgaggtttctgtttcacaagttcagagaagtcagataatttggccagggtcacacagctggtaaatgctgaagtccagacacaacccagctctgtttgactctagagcccagagttaaacatgtgatcatgggaaaaatggcaagtgtgcagttgagaaggctctggacactgcctcaactcaaagttactcaagcttaacatcccctgcaaggggtgaatggatgggcccccagtagactgccctgagaaggacttggcaccctgtctgtgattttcctgcccaaagtgcatgacttgaatttaatcatgaagaaacagcatcagacatggcccaagtgagggacactctacaaaacagctggtctgcagtcttcacaaatgtcaaggtcatgaaagacaaagaaagatgcaggaactcttccagagtaaagagacatggtgaccagatgccaggcctggtcctggaagggatggtggaccagaaaggactcgagagggacaattgacaaaacgtgaaggtcacctgtacactagctcatgtctttgttaagtctcctgagtttgtggatgtggttgtatgagaaaatatccttgtttttaggaaatacatgctgaagccattcaggttaaagggaataatcatgataacagcaatcatgatgggtataaatagatagagataaggcaaaagtggcaaaatgttaaattggtgaatctaggtgagaagtatatgag

SEQ ID NO: 1222 - DNA, 5009 bp, Homo sapiens
gacagagacagggacagagagagagagagaaagagagaaaagcacagggtcacaggaagactgacgggcaaagacacagttacagacctatgaacagagccacacgccaaacagggacaaaccgttgagttgggaagatgtggcaaaacaggacttatattccttatggcaacgatgggctgagctgagtgtctgcagcctgctttaggcagggcacggctgtgcagtctgtcatcgtccctcgtcactcccatcaatgctggcaccaacctcacttctatttatcgcctcatctgatcggctgtttcttatagcagaaacgtctgcaaggcatgtgaatttgtaaccatcaccctcctcacagggttgctgtgaggatccggtggactgatgcatgcaaagccccgagcacagtgcctggtacacggcaaaagctgaatacttctggccagccctaggaatatttccttgggagcagagggctcttctggaagcttctggaagatgaatggcatcttcgcacacctgctccgaacaggcattgtttgggactcagcgccctctggtggctgctctccccactcacacttagcctcttccttggttggggggacactttgaggcctcattcctgcccctccccttcctttcacatggaggaaagttctagaatggggtgggagaaaactttccacttgttctgcatttcctttacctccttcctgaccttaggtctgggcacaggaggaggggcttggaggtggaggctggagcttctgggggtcctggctgcatgactctaaggagggtggtgccttcgtccccacccaacccccaccgcatcggcccattctcctcccgaagcatccctgggccacaggttcccaaggccacctccagactgggcccgcgagtggggcggccctggtagcgtatccacagaagttattatgaggtaattttatttctttccattttaggtaaaaatagtaaatacaagataatcttaataaagggaggagaaactcccaggagcctggagagaatggctcggcacagcagatgcagccgtggtggccatggagctgaccagcctcttgggagtgagctggccacctgagcacggtccactcagcccacacaagcagcagcaccacctcgctgacaggagcttcgtcaatgcctgccgcctcctccttccataacgagggaccacctagcagggactttcacttttatttccacagagaaccttgtggttagaagtccaatgggtctaggctgtgggaatcttcttattaaccacaaacagatgtcaaaaggatctttcctaatactgtagatactgcacttggctcgtgtgggagtccactgtctgtggaaacattactcgtctatttttcaggtatggtctatacacataaaaggcagagatcttaaaggtacagtttgatccattttgacaaatggatacaccccctgtttttatcagatgcttcactgagcccccgtttcatggtgtaatttaagtgccatgacacctggatacccccaccttctatgatcagtgatattcacatgaatcagttacatactgcttgaggctggctggcctgacacttggccattgtttgagacctacaagtaggtaggtgggctgttgtctgcccctaaaccatgtcagctcaggggcagttcagttatggctgagcttcgagctgcatgctgggtgccccaggatgaagcagagggtcacccaatgaccaggctctttctgtagttccctgtggcccaagctaggagaacagaaacttcaatcatggatgaggctgtttctaggtggcaaatatttgtcataagtatctcattaattacctggcataaagtaatttgcttttcatctaagagtaactgcttaaaatagactggaaaacaacccaaacagtgaaaataatatagttggtaaacttcagtgtatatcagagacccttggtgcagttttccaaaagcagatccccagaccccactccagagatgctgattcattaggtctgggtggggtctgggatctgtagttttaacagctagttctgaggtggggaacactttgagaaacacggctgtcagttagatgctgagaacctcccactgagactggacagggccagttagaagcaagcggcggcagaccctaaacgcagtgtgcatctgctcagtggatgtgcaccatggaatgaagtacagcattggaattctgaaccatcctgcactcaagaggcatgaggttggctcaaggctgccattgctgtgggaggcagaggaatgtcccctactcccaagatgtccccgtcctgatccctgatgttctgcctgtgggaaacatgactgtttctcctcaaaggggaactgaggtggcaaatagaattcaggttgctgatcagctgcccttaacagaaggagattattctggattgtcctggtggaaccaattcaatcacatgagtccttaaaagtggaggaggggccgggcgcagtggctcatgcctgtaatcccaacactttgggaggctgagatgggcggatcacaaggtcaggagttcgagaccagcctgaccaacatggtaaaaccccatctctactaaaaaaatacaaaaattagctgggcgtggtggcacacacctgtgatcccagctactcaggaggctgaggcaggagaatcacttgaacccaggaggcagaggttgcagtgggccgagattgtgccgttgcactccagcctgggcaacagagtgagactccatctcaaaaaaaaaaaaaaaaatggtggaggaggaaggcagaagagtggggtcagagatgggacaatggaagatgaggcagggcaaatggagtgtgagggtgcctgatgcctgctgccagctctgaggtggtggggctgtatgcacagaccaagtgctggagctcagggcagcccagctgtggccagcaaggcaacagggacaggcctgcagccccgtggaaatgcactctgccgacaactgaatgagcaaggagactgagcctccctggagcctctggaaaggagcacagtgccctgacaacactgtggccgtagcccagtgagacccacagaacctgtgttgttttaaatcaccacgtgggtggaaatccagtcatttaccttcattgacttcgtcattttctctgtccacctgggctttcaggacgtatctttttatgagccgtttcatgattttctgaaatgccaagcaaggaagggatcagacagggctggcctaatgcagaggcagcctgcgtggtgtagcaggacccctccctcccttgaagagcctcagcaaccatggcgaccctcccatgcctggcgcctcactctggaggggtgccctgcacagtgcgggtacctggccagcctctgtttcgcctcccccgcaggatgcaatgtgcaactgaacctgggatgtaacaggaatacttcttaatggcaggaagctgagccaagcagagagagagacagagagaaagggtggagtgggcagtggcacaaatctctgctccaggggccttggcctggctctgccctgctcagtcaagtcatctttcctggacctcagttctgttttaaggatggagggctggggaagacttagcaggcctgcctgggtggagctgcctccctcagaggtcacagtgagcagtgtgcccttcatgaagagatccgctgggtacagaagtcaggatcaggcttggaggacaagtccactgtaccttggaaaattcctaccagaagcagaagcagacacagccgggcctctggggttttacagagataccacttcccacaggcctgacactgtactgccggagtcacactggagcaggatttggccctcaagttccatttattatgaagatactgaattcgttaagcaggcgaggcatgaataaacacttaagagacaccaagaatagagccaagtgtaggaaagactgcaggaggtgaactttggattttgccagctagttggtccagggttcctgcgaaatcacaggatttaaaaatactcgggtagccgagacttctgaatcttccaagagatgagcagtgtggaagagaggaagggatttccctgctccttggtcctcccttcttgtggccttctgacctgctcacacctgaggaccaagaggacagaggcagcattttccagtttgaagagacctgtagggacctgattctgttcctagctttgctacataggctgaggaaaagcatcttgcaaataaaaagtaagtgaactggatgcaaagagctgcaggatttactcattatcatcaattatggttctttccatccctttaaccatgaagagcttgccacagagatgcttcctggcctgtgattctaagacttcacctgaacccgaaaggctctctaggataacactgggtttagctcattcaggccagcactgcccctcctcagccctcgggctcatgggccaactggctgtgtggtttgagttgtgatctaatttcaggctgaagagttaattggcagttgccttcctgctgctccttctcagagaagcctgggtcttatcctactagcggttaaactgcagcgctgaatttctcatggacatagtctagtcaataaagtaagttatctaagttataaaaaatatatccctttcaagctaggtgcagtggctcatgcccataatctcagcactttgggaggccaaggtgggtggataacctgaggtcaggagttcaagaccagcctggctaaaatggcgaaaccctgtctctgctaaaaatacaaaaattagctgggcatggtggtgtgtgcctgtaatcccagctactcgtgaggctgaggcagagagcattgcttgaacctgggaggcagaggttgcagtcagccaagatcatgccactgcactccagcctgggcaacagagcaagactctaattcaaaaaaaaaa

SEQ ID NO: 1223 - DNA, 15379 bp, Homo sapiens
cgtgaacccgggaggcggagcttgcagtaagcccagatttcgccactgcactccagcctgggcgacagagcgatactctgtctcaaagaaaaaaaaaataatttcttattacaatgatttgatataatttaccatatctaataagcctatttatcatctctcttttggatgcttcaggagccctctgtaacatcccaaagttagtttgaagtcaaaaagacttaattttgattttgcactttgagttttggtaagcatgtcaaatatttcaaaggtttagcacacttgatcaaaataggaaaggtttaaaactcttgattgatataggaacatggatcactgtgaagtaataggcattcatttaaccaaagtgataattaaaaggtttcaaaaagcaaaattcttttctctttgatagagaagatactcagttttccaaataagcaaagaacttaataaagacagcatgaggctcacagatctgtttgtctctctctctctttctcaccctcccccctttttttgcagtttactccaaaggtgaataaaaatcttttttttttaaatcaatgctacatgaaattttgtttaaaagagaaaaccaaattctagttttgtattagtgtacttttaatactaaagctagttttaataaagccttataagccagtccatctaatctctgtcagcactgaccacacaaaataaaatttccataaactttcataatctcttacaattttttagttatcttcctttccccactgtttaagtccacttagttttatctataccatttttccttcattcatttattctgaaaaaacctttaaataatctctaaactattcaaaaatcattctctttctcaataaaacacatcctcatactttataaaatcttactttcctttaacactctgtatacattgtttcctatatctagtaattttaactctatttcatttataattttaactcttagcaaccccaattttcggtgaaaaaccttggaagtaagaaattttgaacaacaacaataagaaaataaaaagataattcataggctgagagaaaatatctgtaaatcatatatacctgatagaggacttgtatccagaatatacatgagacactctcaacactcaacaatgaaatttttaaaaaggtaaaagatctgaatagatactttatcaaaggaaataactgaatggctaataagcacatgaaaagatgctcaacaccatgagtcattaggagaacgcttgtttacactacaatgagatacaactacatacctattaatatggctaaaattaaaaagaatgaccatattgagtggttgtgaggatgtagaggaactggaaatcttataaatgggaatgtaaaatggtacaaccattttggaaaatagttagatagcttcttaaaatgttaaacctacacctaccacaggctcacagtcattttccccttgttacccaaggtaaaagaaagcatatgtttataaaagatgtgtacatgaaagttcatagcaacttaacttgaaatattcaaaatatctatcaactggggaatggataaacaaattgtggtctatgcatacaatgaattactactcagcaataaaagggagtaaaccattgacccacacatcaacaccatcaacactggcaaataccaaaataattagctaattgaaaaacccagttgaaaaatagtacatactgcatgattccatttacaaaaaactatttaaaaatgcaaactaatctatagtgacagaaagcagataagcagttgcttcagaatgaagagggggattacaagacctgtaaggcgacttccttctactcttatattttgtggcagggcctaagaattaaactgacataagacaaattgagaggagaaaaagcatacagattttatttaatatttttacatgcaagcagaatcttcagaaggaaaatgaggacccaaagaagccattagacccaaaagtttatgtacctttttacaaaaagaacaataaattgtaggtatgtgacaagacagaggggtttggactaggaacagtgaattgtagaacagtgactagaaaatatacggaggaaactaatggaagataagggttattttgtaggtttgtttgtataggtccatttcaactctcccaatctctggtgataagaatgttcttttcctggtacagggagggtacctttttcatgggaaattttgtaaccttttaggtagaaaagggatggtcagaaagcccttcctgcatctgttgtttctcaagggcgttcagctaaactagtcaatatgttcaagtagcatattttggaggggtgtgttctgaacaccttcagatgcaagaggaaatttgggggggtgttggctatattcattatcttgagtgtggtaatgatttcataggagtatcaagcttatcaaattgtacacttcaaatatctacagttgattgtgtgtcaattgtgtcgagaaggaaaagaaactttttatctgaggaatacaagcctcaatgatcagaccctgagagacattgaaatgtgacagcagccacatctcactccctcttgatctacttgaagccacttgctatgtgggctgtagaatgactgacgccaagtagctgtaagttaacctaacaatgccacatgctggactctataactcatattctatagttcaaccgtgtatagccaatcactaatcaatgttacttctgtaaaccattgagaattcctgaaaaacaacttttgtaatcacccccctcctgattcgccctttttactttaaaaactcaagcctctcctttgttttccggagcacttcccagtgcacaacctagtcccaaggttgaggactgcagccagtcctcatatataaaccctctatattaattttgcctcagttttcttatttagatcaacagcctcaataaggttggtttttaaaaaagaacaaactcatgatgcccccttttgagtctgggctcaggttttatacatggctacctttgaggcttcaggttggttatgatgatggaaaaaccaaattctgccaaaatacttaaagaagtttagtctgagccaagatgaatgatcgtggcctaggagaaacagtcttaagaagttctgagaaagtctgcctgatgtgatgaggttacagtttagctttatacatttcagggagataggaattgcaggtaaaatcataaatcaatacatgggaaatatacactggtttgacccaaaaaggcagaacatctcaaagcagaggcctacaagtcataggtgggtttagggattctttatttggcaattgtttgaaagacttaagctttgtctaaaaacttggagtcagtataaaggaatgcttaaattaagataaaaaggtctgttatctgttatgtgatgctacacacaatcaggttggaaagtaagccacaatataatgagtcaaaaaaacctgtttaacaagatttatggtttgtaaggcatgactccccaggccccttagaaaggaatttgagcaagaaaaagaaagggtcagagttcagtcctcagttaactgcttagtgtatgaaataccatgatttttgagctttcatcatagaaacatctttggtggctgaagacagccttccaaacatgcccaccctctcacttgggactgaacctacctgtagtcaaggctcctcgatcctttttcccatttttgccactgaggttccatttttgttactgcgtgatgccaccccagtttggcaacttcagaaagtacaagaaatcataagattatgagtcccatggagcagaaaatagccatcattcccctttgtgatcctggaagtgtcttacccaggaccaggtgtgtcaagtatatatttgtatgctgaaatgaattgagtggaatcacaattttctttttttttcctgtttggactagtcaagttcagtaggggaaagagtagaaaaaggaattcaatctgtaactgaccgtgaacaatcaattaagataactcactatcttcactccagcccacaatcttctaaactatggctattgtatttactaacagatttactttggcccagaattttttcatccaaataatatttttgatctctgtgagaactgaggtgaaatcaaggaaaccctcatgtattaaatctttaaatatattcttttaatgcaaagtaggggtcaagaggagaggcataggttgtgggccttgtcccagcaaacaaagccacaaaggcattcactttattcaaataattttttttctctatgataactgaaaaaaatcaaagaaagcttcatatattaaattcttaaaagtaagaattgttacattcttactttaaattcaaagtaagggtggcccagaattttataaggagcctgtaactcaggttacttttgctttcagatccaaggtgcatggtcccatcacaggtaaactatctactcaagttcctgacccttcgcaagtccatgacaaatgatactggaatgttttggcaactgagcgtgattacctagaatcttggccggcaccttatgtctcacctttctacactgcaaactcctaactctctagtttataaacctatagtcaggatagttttctggatcttcttacttccatccttaaactcccgctttactgctccctacatgcccaacatatgcttcttgactgtctaccagcaacttccttcaaaacaaataaaactaaactaaaggcagcacaggctaaaattactttttcgatggttctcaaccttggccacacaggaggatcatttgcagagatttataaaaaacctaacccccgcccccccacacacatattcagaacaattaaatgagaattcctaagggtgacccctgagcatcaggttgtttgtttaaagctccccagagtagtctaaggtgcagccagttgagaactactgttaggttgctgatcagtggtttttgtatggaaagtcagtgcttgcttaacatgtctggaaaaacctaattgactgcttttgttttcccttctacaattctacaattgcattttcctaaaaggctaagattcctcattggttatgtacaggttatggcaattataggaatatttatcctgtaattaagaataaaatgaaacaatttctgtgggaaattacattgtactgtatagtaaattatacttttcattgggaaattatgaaataagattttggcattggctaatatagtgtttaatttttgaaactacataattaaaagataattagttgaataggtaataccttggcaaattgcaatgattaaatgattgcttccataatgtaaattaccttccaccatagtcagtgatctaaaatattgtctaaacatgtagtggcattttaaacattagattattttatgagtaagtggcctatgttggttaattgactccccgtaatcaattgtcagctgcactcgagcagtcaaccagagttgcaagggtctgttgggatttctgggtctcagctgagcaggttggtgtcccaatcctaagtaacaatgcaggggctgcaaagacgacagtgaaggtgcttgggtctcattgttggtgtactagatattgtctttgtttctaaaaaaaaaacctccaagtctcagtttcttcattagtgagaagggggataataaaaccaccataccggattgttcatacaatatgcatagtaataaagctcttagcataatacctggcatataattagtgctcaagatttctttgcatcactgcttttttttttttttttttttttgagacagagtcctgctctgtcgcccaggctggcattcagttgtgcaatcttggctaactgcaacctctacctctcaggttcaagcaattctcctgcctcagcctcccaagtagctgaagttataggcgcctccaccacgcccagctaatttttttgtatttttagtagagatggggttttgccatgttggccaggctggtttcaaactcctgacctcaagtgacctgcccacctcctattgctttaggccctttatttggctggccatagagaagacctgtggagatacatgggcattggtaatgtcactggattctggatgacagttctcgagggtgcaagatgaaatggcaggtaggggcgaggcaagtttatcaatatgagttcctcctccattgaggagggctagggaactggagcaagtctgagtctgtagggagaggttgtccttgtattcacattgagagagagcctcaattccacaaagctaggtttatagatccaaacccaggaagtgatgccagcagatgtaacagtggaattcaaaccaatttaacaaatatccctatataaatttgaagtctattttctgctggctgtgtttttcttttttgcaaagtttgtgcttcctgactttccctttctctgacattacacacactaactgaaattgagccagatgctctgcatccaagcagagaagagtgaggtaccttattgttgtatcacagaatttcggactcaaaaggctcatctagagttgtgcttttaaaaatgggttcgcatctcctggattccacagaagagactcagaggctaacacagtggaaggggagaggagagcatgggatcaaacggacagggctccacatgccacccaccctcttcaaattaaggaattccactttgctctgttttttatgttagggtttttaaaaataaaattccacttgcaaataaggattctaatccaaaaagaaaaagaaaaaaaccttggcaaaccagagaattagttaactcttccgttttataaatggagcttagagtggtaaagtgccttgtttgaagttacacatttaaaaaataggagaagtaggactggtaattagtactgctgattttcagtctaaggacatatatctcttatatcatattgcctcttaaaaggtaaagaaaggcaggttggacccatgacatatcttctaggccacagctctgaacacattgcaagagaaatattcaagcaaagtgaaaggaaagcagcacattttcagcatcttaatagtgaagctatcatactgaaggaaaccatatgagaaagggatatagaaagggcacctcttctcttcatttccctctaacactggaagcttctattttactgtcggttatgcaacatgatttggaaagcaccttggaaaccatataaagatttgcatgtcattactagaaatgggtagaggaccctgtaccacatcagtttcatggcagatccttaggataatgttagaaagaaactcaagtagatacgtttctcagtactgaagcttagaattccttatttgtggtatctcccttgtctggtacccagttgtagtattaatgggcatcaatatctgccaaaagggtgtgccttactcagaggtgtttactggaatcctgtgcttcccaccaaccatactccatgctcttctcctttgtctataaccctagctttagttatcgtctaccctggtagtctcagctcaaattatgatatgatttcttttcaggaatcttgatttctagcttgtgaggtctctcttacttcagcatcctccaacatcaccccaataaacctaccttcaattaacatacaactaactaaaacagagtgttttgtccttgccattcccagttccaagcagactgctcttcataagtttctctgataaaaaaattttgccactgccaaagagaagaaatctgctatatttgtagtgcgggtgaaaggaatgggtgttgaataaaaagaacagggcaaagcatctgcacaagtaaaaagaaaagcagtcaatttaaacagagaaataaaacccgaccactgatgagttttgagtaatcaggactcataaaattatctcactctctagttcattatggctgtggaggtaaagccatggaatcactcctgggatggtattgctattggaggccagaacacatagtaaatatatatcctcattagtgccaaattgcattagggaagtttgcaggttgctactgctaaatctccacctagattattctttcttaattcaatgccactcaaaattattcttctaattgggaatgttagatattatttgtgtatgtgtgtgttttgtgtcaaaaggaataaaatacagacaaaaggcaatcatgttgtcaatgagaagtattcaatataatatggttttggttgttttaacattacaacctaactgacctgaccttggttattagaacagttgaatagacatatataactctgatttcacaagaggatacaagaatcattaaaacataaaatatgtgcatacatcatctaactacctctctgtagttaaatgtaattgcagttttccagcaaagaatttgtggagaattaaaatgaaaagaaataaaggcttggggaaaatagcaacaaatggatggaaaatatgaaattaattatctctatctgaaaaatctgtttcttataaagaattagagatctgttgcacttcagaattatttacatttgagaaaagttctcgccgtcagtggaagaacattacatgaagaggtatctttgggcacatgagccatctaacatagagttagaagagtccaaagagctcatcctgcctggtcgtctgtgtctaaccagatgactacctcaactacttgaaataaagtggttcttgtctactttgcaagatgttttttcttttccttttttcttctaaaaataagcaaacaacaaaacagagggtcaagatctgtttctctctttgattcctaagatttgtttaaagaaaactttgtttcagaaattacatatttcagacacagttttaggtctattttgttctattccacataatatcgatactaagacaatgattgggccagcagcattttactaaagttttcccaacgacattaaccaatcaattaaataattaattttttttgagacagagtcttgctctgtcacccaggctggagtacagtggcacaatctcagctcaccgcaatctccacctcctaggttcaagtgattcttatgcctcagcatcctgagtagttaggactacaggcatgtgccaccatgcctggctaatttttgcatttttagtagagatggggtttcaccatgttggccaggctggtctcaaactcctggcctcaaacaatcctcctgccttggccttccaaagtgctgggattacaaatgtgagccaccacattcagctcagacattaatttagcttgatatatatatatggattaattaaaggaggattagtcagaatagaaagcactgaaaaaggaaaattacagaagaaaatctgagtggtgctcattcagttgccatccagaggaaaaggaatcttagttgtcaggcctgaactactcagatcacattgagcatcttatgtctgttttgagaacagtatatcaggatgacttagcttgtagtcattaaacttgaaatttaattggtcccttgttctgattcaacactcaggttccaactgaggtacgaggggagtcggtgggcaagtggttggtagctgaaaaaacactcaaagaattgtagacagtttcaacatggctttactctctctctgggcacaagcgagccatatgtgcagcatcagcaaggtataccttttacagacaatagtggctctgagccaaacacgagctcatgtgagttgttacctaatgtgcctcatgtggtgtggttacataacgagcaaggttgtgtgcttgcactccaaacccactgagtcatgctgcaccagaaggctgcctcagcctactcctgactaaagcacagccatttcccttacactacaccccctaggctgagggcgtcctccaggcagggacacatgcctatatggcggagccctgagtccataacccacaacaacaatacagagagcaacagctcactactaggatctcagctatgatacttatgactattagggcccaatgtacgccagaacctagggatgctcaccatctctgcagggggttgacagtgaggctctcagtcaccttaatctcctggaagacccctttgcagggctgctgttatgttctgctgattgtcagggataaggtacaacattgtgttcctaaaagggcacaggtggctccttgggcagcagttatgtctaaggccacttggttttgcaacaccactttttgatctgatcaacctcattcattaacaggaggagggacactcaggtgtaattcagagcctgagcggtgtgctccgcaagagcagtaaattgtgcttctacagttttgacacctgctccagggatagtcattgccaaagggtagaaacaccagggggctcatcacattcgcaaaaactgagagcacagtgcctcccagttatacaggcatctgggcaatgtggggagaacagtagcaggtacataaggccacccccagatacaacatccactccagtttgctgataggaaaggctactgtgtcctcatagacccataagctcccaagaggcaaaaagtccattggggtccgaccttggtgaggccacttgttccaccataccttcagtgtggtgacacatgttatgtttgcacaggccgtgacaggtacccatcctgttaccccaatgttgctctgtgcactgcaatgcctgggcttgggctactacatgttcccctactagccagccccactcatcacgaatgctacggtccagccatgggtcttgctgtgtcctttgtccaaagcttgccacattgtgttccaggcatcagccatgggatctcaagtctccaggcatgtccagttctctgcagacacgggatgtatgtgtcagggaaagctgtctgcagctgctgctggaaaggcagtgcaggtccaacagttggaaacattggtcacctcagcataggtgtggggtcagtccacaatgcaattggagcatgttaacctacggttgaaatgacagagcaggcacaggtactaacagaggtaaatcacatccctcaggcaaaatataggctaactttccatccctggataacaatgcagccaccaagggcttttgccctgggtgatggtaccacaccttctcaaatctccatggttcctttgaatcctgtatccatgccaaagtcacagcgtagctcataataggcccatcagatagtacatatgtccctcagaggagggctccttccctggctgttcctctacaaacagtcaaccttggaagccatgtattgaacactcaaaaagtgacatgcaagtcatactgtaggccctccccacagggagctatgatggccaaccaccagcagtggagagcttggagggtccatggccacagccaggttttctgttcccctgccttcagggttgttggggcaggcaacaacaggttaccatttgtccccatacctgatcggaggaggtcatccttggtatgtatctccaattgaatgggggtggtggcctagtgaaacaaagcctccactggggccgggccacctttctgtggccattcatttaaggtttggagcaccaggtccagcctggaactccagctccgcaaagacaggggtttgacatgcaagcgtaatccattcttcaagatcccattatatcattcaataatacctcagcttgtgggctgtatggcacatggaatccccactttatgtccatttgctgtgcccatcattgtacctgttgtccagtgaaatgtgttcccctatcactctcaatggccagaggacaaccatacagggaacataagtgttgcagggcctggatggtgttctgttggttggccaccctgcaagggtaggtgaacaacaggcctgtggccatgtctacagccgttagtgcatgcgtataccctcgcgactttggcagcggcccgatgtagtctacttcccacctggtcaagggcactcaccctattgttacttgttgtataacaccgggcagctgcctctttttaggatatgtctgaacacatgccaggcatttctgacaagcctcacaaatgtcttgcttgggaagggacagaccccaacacttattgaattgttgcatcagtttaccccctgcatgtcccagtttccggtgtagccacaaggtcacatcttgtgttggtgctgactctgaccatctgaccttagccaaggcatctgcctcatcattactaggggtggccaaaggcatatggcctgacacatgataaatagttacctctttttgatgacctatttcccaaaggtcttgccatatggcttggcctcaaatgggtctgtggctcactagccaattctgtattttccaagtagttaaccacaaggttaagcctcagtagactgcccagctatcagtacagattaccacaggtgtcacctccttggtgatcaccatccacactgctctgagttcagcccattggctactttgtccgcacccagtttcaaaccatatggtgtcagtactaggttggactgcaacagtggtccaggcagcagtagcacctcatctactgtgtaccatgccccctcaggaatcctgggatgcccttccttaaatggtgaagactcaggatctaggggtgcctcaggccgcatggccttatcttgcattaggactacacgtcccaagacctcttgcaactctgctgctatgggacttgtactcagcttactccactgctgcaaggagttgccccattttgccaaagtggacatctgtgctatcccactccaggtggtcattacacatagacgcatccatcctgttattgggtaagttgtccatatgatgactgcagcctgtcctgtcatgctctcatgagcccgaaggccagcatatacagctgctagctgtttctctatcaatgaataccggagttcagctcctttccatagttgggaccaaaagcctactggcattcttaggcgctctgtgcattgccacaagcctcaaccaaaaccgtctgtggccacatgcacctccagctcaaacaggtgcccctggttaattacttgtagggcttgtggctgctgaatagcgcacctggctgccagtaaggcagtctcagccacaccatcccagtcccaggcaagagaggcattactgcttctaaatctgcaagagaatcagaggttaacataatatcatcaatgagattatgacatatggtgcagctgtgcatatagccctgtggcaacactgtgaaaatccattgtcgctgtcccataaaggtaaagtattcctggctctctggaaaagaatgcattagccaagtctaccacatagtggtattgttccaattccatcatcgagcagtctatcaaatccatgatagatgagacagctgccaaaccttgtgaaacactcacccccagaatgtattcaggagagacatacacagcgcataagcagggagccaaacggtgatgccaaggtatagagatacaggtttcactttcactgaccagctgccataactgtcaatgtaagcaggtttgccaagaaacttatccgggttcccataaacaaggctgcaatctgtgccagtatccaccagcacccgctgtacatcggtgggggactggtggatcactaattccacatgtggcctccagtcatttagtgtccccgcaagctgggcaccttggccagttccctaatcaagcaaaaaaggctctacatttccacttggctgcagcaagtcatctttgaactgaagcgcctgggtgggaccaggttacacagcaatgtccttctcccccttgggcattttctggaattgctcctccagagacaactgtctccacaaagttaaaagcacttcattgggttgcttatcaattttctctcagtcaacccggccaaaataaaatctatacatgtctgtgagtgtgtcactcgttggcgccccctttttaccatggggggaccccctgtgggtggggcatcttccccttctttacagcatggacccctcggtcctgccgatggccttctgcttccctgagagtcaccatagcagtggtcacttcatgtatgtggtaccctatgtacaggttgaggacagtagctagggagtcaaaggcactcaggggtgcagaacccaacacaagattctcccatgtggtagctgaagcattcatctcctggtccctgggtattcaggtcaaacatagcctgccgcatacccgtctcccgaatgacttgcaccaaatcacatagactggtatttactcacggtttgggtatttcaccagcgttgttccacacagtctgtatggctgtccatagccactcaatcaggatgtgatcactttgcccttgtgccaactgcttgttcacctgcaaccactgacagagggaggggtgagtcgtgatagaggccagcttttccatctcagaggcagaacaggagatactatctgctctcttgtctcacaaatgaagcatccaggcaggtagacattcccctggatgctggcggcactgcttgcctaattcccacaactcagttggggtataggcagtatatgaagtatgttgcattacggtgggtgggggggggtccctgagccttctcttggggccccaacagctgttcatgatctaccttctggtggaccactgggtgagcccacaacaagagttcttctttctctgtatcagaccaagtggggatctctggctgagacaatggacccatgcctacattcacagcagcctctaattccttttccaagctctgtagctgggtttccaggtgccccacctctgcctgaagggcgcttacctgcactgcatccctcagggactgggtgtgtgcttctcatagcacagtcaaaatgcccatccaactctaccagcaaaagctcactccttctcagtgctctgtgcttccagcagcttcagagccttctccatgcttgcaggggacccatctatcgccacccaggtttccaccaaagcccatccaaacagcacagctgctaccaggtaccacaacccacgctgcagcctcatggccgacccggaatcaggggggaccaaagggtcactcacctcaggatcctgttcatgagcccaattgtcatgttctaactgagatctgaggggagtgggtgggcaagtggcaggtagctggaaaaacactcaaggaatcgtagatagtttcgacatggctttattctctctctgggcacaagtgagccatatgtacagcatcagcaaggtagttgtaccttttac

SEQ ID NO: 1224 - DNA, 15379 bp, Homo sapiens; identical to SEQ ID NO: 1223

SEQ ID NO: 1225 - DNA, 15379 bp, Homo sapiens; identical to SEQ ID NO: 1223

SEQ ID NO: 1226 - DNA, 5397 bp, Homo sapiens
agaacactcaactaacaaggccattctgaccctgaaattctagtgaaattgaacttaacgctgatccaaaatgtaatactattccccaggaattttttttttaaacttctggatctttttggttaacatcgtaaccactggcttagatttccagtttctgcagaattctcatttttaatttataatatgataatgaagtatattttaaaattaattttttgataaactataataatatattatcatggcagacacagtgatgttatatgtacacagtgtggaatcatggaatcaaactaattaccatatccatcaccataaatacacatcatttataacatctcctcattcccccccacccaccagcccctggtaaccaccactctactctccgcttctatgagtttgatttagatcccacatggaaatgaaaacgtgcattttttgtctttctgtacctggcttatttctcttaacataaggtcctccaggttcatccttgttgttgctagtaacagaatttcattctttttaaaggcattttttgagtggcattccattgtgtatatatagcacattttccttatctattcatctgttaatggacagttagcttgattccacatcttggccatcatgaatagtgctgtgataaacaggagtacagatatctcttcgagatactgattaaattcccctagaatttatagccagtagtgggactgctgatcttcctttctttttcaacagcaatctgtctccaaaaaatacccaacctcccacttgtgctcaaggatagctgatactgctttaatgaggaacgactatttttcttgccacaatttgaggcaaaggaagcacacacactgaaattaaggtccaaatgactgatcctaggctcatatccaagtgcagattttgacagagaaagcaagaaggctgccatctacaagctagaaagtgatccttgactgagtgtggtggctcatgcctgtaatcccagcacttcggtctcagaaaaataaaagtgatccttcaccaaaaacagaacatgctggaaccttggacttggatttctagcctccagaactgtaagaaaataaatttttgttgcttaagcaaaaaaaaaaaaaaaaaaagaaaaagaaatcttcaaaaaagtacataactgggtggggtgagcttgtttgtacttcagaagatcccctctgaatcataaataagtaataattagttactgaggtcatttatcaaaagacaatgctttagatatctgttcttacaggacagtgaagtattagaaaatcatgggaaaaagaaaaccaccggcaaatatttttccattttaaaatgccactgactttaagacatgctagttttgagaaaaaaaagaaaaatcctgaaatagaatatgcacttcagaaatgaaatgcaaaaaaatgctgtctcttagaaatgagataattcaactactaagcaaataaaataaacctgtaacattcctccaatgagatggccatggacctgttttctctgttgactgtgtaaaaacactctggggacacaggtgagaaaatccatgtcaggcatatggagggttaacttggaggaatgatggcccactgacaccatacctgtgggtcatcatgctgcttttacaaattgcccagtggaaagcataaattgaatgtttaaaaactactaaacttgcgtatacggttgtgaggaaaaacgtccattcagtcctgccagaacacattaattttatctcgagtgtagccacggggatcctcgcacttctactatctgtatccagtgaggttgcaacaacctcaccatccatcaagctctctgtagaaggtggaaggttgagagaagtcccctgaggaagagtgacattgcgctgggtgactcagtctgacgcaagccacaaatgaggcagaacaggatgctgaggctgaggggaagagcttgtgcaaggcctcccctcatgctaactgcgcagcagcccataagatgcgggccataatggtcgttatgattctcctcccccaccagtcttttatttaggttcatttttgcttgtggcaaaaaatactctcttcatggttctcagatgttaatgaattgaatgttcaccgtccatcttcctgaattgcttcacaaaagaatcttactttaaaggtggaaagtcctcaaggtcatagctttctaatctattcctgaaaagtcatttccattttgtgctagttaaaaatggaatgcatttaggatttcatcttattgatgaaattgaccttaaaaaatggtcaattttgatttgtagctcggagtgaactgggcaatacaaaaaaggactattttgtaccgtaagaaatagatgtgaggaaggcacgatgatttccagtatccttcactgaggtcaatttttttttcacagaaaactaaaatgttcctgttctatttcctttaatttactcagaatactgattcccaagattttaaaagtgacttacactttaatagaatctcaacctatttaatttgtatagtgcttttgtgattctcaagcaaaattctacttcttcaacttttactttggattcatggaatacatgtgcaggttgttacttgtgtatactgcgtgatgctgaggtttggagtaccaatgatcccatcacccagataccgagcacagtgtccaataggttttcaacccttgccccactccttcctctaggaatcccaggtatctattattaccatctttatgtccatgagtagccaatgtttagttcccatttgtgagaacatggggcatttgtttttttgttcctgggttaatttgttgtttgtaacaggatgatggcctccagctaactctataaggacaagcttgctttcttttatatggctgtgtcctacacgattttagatctatcatctatcctcccggcataattggttagggagtttgtctcattattcttcccagccatatgaccttgtgcaaagatcaaactttgggcaaagagttcaattcaaacatcagctattactagtgtagctgggccaccctaccccactggaattatatgtcttgggtatcactcagttttagtacctttaacctggacacgttacccagatacaatttcaaggtaaacatgcctgcctgtcttcctagttttttttttttttttttgcccagcaggagtgcagtggcacaatcgcagcttcgaaatgctagacttaagcaatcctcctgagtagctgggactacaggcatgcgccactgcaccctgctgatttttaaatttttggtagagatgggtttttttgttgtgcagagtggtcttgaactcctgggctcaagcaatcctcctgcctcagcctcccgaagtgttgggattacaggcatgagccaccacgcctgcaggttttaacatgttaagcaaagcacacacccgcagcaagtgggaaatccagcttcaagagaatttccatttcttaccatctttttccactttgtccatctctccctgcagccctcccccatcaagcatccattgtatgaaatgcccatactacctttttctgtgtgctttacctactatgcttactcttgaaaatttcctcctgggccatcttagaaacttattattcagtctgcatttccattttgcttacctttctgtgacactcatccaatggcctatggccgtgtttacacggatttgatatgctttagaaggcaattacttttattcatcattgtctcccctgggcccagctagcatggcacctgttacataaaaaattcatgttttctgactgttcagtagatgccattttaagcaacaactcaaagggccttttttctcgggattattttaaaacatgtttcatttatcctctagtatttcagacgatgtcagaaaatgaaaaatggacatttacttttttacctaaagcctatcactttgcaggtcattactcttcgctgtgaatgaggaaaaaaaaaaacaaaaactctgtggtatgttaagagccaagaaactagtgatttttttctattaccatttacaactggtatgttttacaaacgatcacattttatatatcagcttaccttttatatgttatttatttatttatctttttgagacggagtcttgctctgttgccaggctggagtgcagtggcgcgatcttggctcacagcaacctccgcctccttgtctcaagcgattctcccgcctcagcctctcaagtacctgggactacagatgcacaccaccatgcccagctaatttttgtatttttagtagagacagggtttcaccatgttggccaggatggtctccatctcttgacctcatgatctgcctgcctcggcctcccaaagtgctgggattacaggcgtgagccaccgcacccggccacattttatatattattttgcatagccttcattgtcttagcaaagtcagaagaagtccaataacataatgtcattaaattaacaacaacgacaacaacaacaacaaaacaacccaggatgggggcagtggctcaagctagtaatgccgacacttaggaaggccaaggtgagtggattgtttgaatccaatttaagaccaaactgaacccctctatttaaaaaaaaagtaaaacagtaaaaaaatccttggttttctagataaactgcctgataccatcactgaaatgatatcattttgtgtgtgatattaatttaaaaaagacataaactttgggttctaaaaggtgactaaggaaaacaggttccaatatattcattttacaggagaggaaactgggcacacagaggttaagtaatttgcccaaggtcacataagaaataagagttgagattcaaatagaggtagtctagctacaagtatcatgtacttatcacactgcactatactatactggcaagaaactaagttgctttcttgaagaaatccctattcaaatggcatgcagacttctttcccttcattaaagacttctaaatataactcttctgtatcaaagaacttacaaatgtctcaagaaagtaatggtgtagcagtgtaagagaagtaaaagtctgctaggggaaactaatgaagcattttcctcattacacttttgggttgatatatttcattaagacagaactagttctgttttgctttgctttttagtgcttagtctgagaggcaatgcgagaaaccaaaagtcttaggagaaaaactgctttcataatttccagtgtaagccacaaagaagcttttctataaaggcttgaaagcttgaagaggtgacaagagcaagctgtattcaattagacagttcaataaatatgcaaaaataaaaaaacacttagcaa

SEQ ID NO: 1227 - DNA, 2413 bp, Homo sapiens
ggaagctgtgcagacaagtgactgtctcacagcattcccctgtcacgtaccgcctgcttgctcaaatcaatcacgaccctttcatgtgaaatctttagtgttgtgagcccttaaaaggaacagaaattgtgtattcagggagctcagatttgaaggcagtagcttgccgatgctcccagctgaataaagccctgccttctacaactcagtgtctgagaggttttgtctgcggctcaccctgctacatttcttggttccctgactgggaaacgaggtgactgacggatggccgaggcagccccttaggcggcttaggcctgccctgtggagcatccgtgaggggaactccggccagcctgagtgacgtgatccaaagagcgctcccgggtaggcaattgccccaatggaacgccttgccagagcagcgtgtagcaggcccccacggaagattaacacagtggctgaacaccaggaaggaactggcacttggagtccggacatctacaacttggcccaaccaccgagaccacccttaaacatcagtagactgggagctgtacgtggatgggagcagctttgccaacccttgcaaagtgactctgaagaagacgacaagccttgttccggtcacacccggaagctgactggttcacgcatggccgaagcatgaggaaactcatcgcgggaataattttccttaaaatttggacttgtacagtaaggacttcaactgaccttatgctaagctgcctgatcagtggacaggtagctgtgtaattggacaggtagctgtgtaattggcaccattaagccatctttcttcttactgccaataaaaacaggtgaacttctaggcttcctagtctatgcttcccgtgaaaaatgaagcatagccataggtgattagaaaataatgaatggccccctgaaagaatcatacaatactatagacccaccacttaggcacaagatggctcatgaggatatcgaacccccatctacatgctcaaccgaatcatacagttacaagcggttttagaaattattactaataaaaccggtcaagccttgactgttcttgcccggcaagagactctgatgagaaattttatctatcaaaatatactagctcttgactacttgctagcagctgaaggagaagtttgtaaaaaatttaaccttactaattgttgtctacacataaatgattaagggcaagtagttaaaaatatagttaaagatataacaaaactggcacatgtacccatgcaagtgtggcatgggctcaatccgggagccatgtttgcaaattggttcccagcaatgaaaaaatttaaaactcttataataagagtaataatagtaatagaaacctgcttactgctcctttgtctgatacctgtatttctccaaatgataaaaaactttgtcacgaccttagttcaccaaaatgctttagcagaagcatactatataaatcactatcaatctattgcacaaaaagacataagtagcaaaaataagactcagaactcccactaataaaaactgagagtctcaaaggggggaaatgagggaagagagagagaccctctcatattgttttatattgttttatactcagtacctcttttaagaaaaagtgacaaggaagtaaaaccaaagacaggcagcctggtgccaggcctgaaaccaggcctgggcctgtctggcctaaacccagtagttaaaaatcaactcataacttagaaactgatgttattcatagattccagacattgtatagaagaacattgtgaaactccctgccctgttctgtttctctctgaccactggtgcatgcagcccctgtcatgtaccgcctgcttgctcaaatcaatcacgaccctttcatgtgaaatctttagtgttgtgagcccttaaaagggacagaaattgagtatttggggagcttggattttaaggcagtagcttgctgatgctcccagctgaataaagcccttccttccacaactcagtgtctgagaggttttgtctgcagctcatcctgctataaaaccagctctgctcatgcttccagccccagctcaagaatctccctgccttgaagccttccctggcccctggtacaggtagtgttaatgcatgctgtgacctttacctcagcctgttgtttcccactggatagtgagctgctggagactcaagacctgagcccaggggaaatgatgggcaggatccctgtgggtaggggcaggccatgtgggcctgttgcacctttatgcgtggtcgggcctctctggtcagctctgagcagtgcagagctctgcaatgtcttgggtgtgctgaaggtccactgtgacacctgcccacctggccccagcaagctgtcatccggaaggtcagacttgag

SEQ ID NO: 1228 - DNA, 2413 bp, Homo sapiens; identical to SEQ ID NO: 1227

SEQ ID NO: 1229 - DNA, 2413 bp, Homo sapiens; identical to SEQ ID NO: 1227

SEQ ID NO: 1230 - DNA, 2413 bp, Homo sapiens; identical to SEQ ID NO: 1227

SEQ ID NO: 1231 - DNA, 4528 bp, Homo sapiens
ccgcggtggatctggagctcctagatgtccggggagggtatttctacaggctggggcaggcgcggagagcagaagccgaccaaactacccaccagagcagggccacggggctgctccgcgctgcggggcgctgcaccgtgcacagtcaggccgggccatacctccagacgctgtatgccgccgactccccgcctagccgccgctccggctcataaactagtagacgataaaattgccttctctggccccagcggctggggatttgcaaagttctgaggaaggctatcagggctgactgtgctgggatctctgatcccagctaggacctcagtctcctaacctggctccctcttccccaccccacccctgagaaacgttgtttctggtcctgacggctggaagtgattagtgctgcatgggtcgggggcgcaacacttgggaggacctggcctggcggagcgactgcaactgggaatagtggggatgccacgaagaagcaagcacaggtgaatggacccgaggctgccccacctgacgaaatcagaacacacagagaagctgccgggagacccgggccgcaggagagaagacccagggaactcccagctggtgcaactgcccaggaggggtctttgtcagtgaggactggcaaaatcagtcgattttgtctgtctttatcttctttttattaagctcccatagttcaggtatgtatggtttccccagcctgcagaggctcagaaactgccaaggggagcaaggtgccctgaccagagaggggtcactccccatagaagagagacttgaagggcagacttcacggacccagctggatcttgggacattcctgacaacccaggtactaactgtgaggcctggtatactcattcctatttaatctgggccctttttatctgccacacttattctggttctgggctcatacctgggtaagcacccacagccctcctttgtaggaagaaggcagctcagggacagtggggcctcagcagttgaggcccagcagggtatgggttttgttcctacattccaccccaaacagctggaggattcacaccttagagcagggaagccctgccactcctgaggagcttgctgctttgctgcccagggaagtcagaaactgatgtgcttctagctttttaaaacagtgtcaggaaaaaccaggccagtccctcctggactgtccattatgtcactttccttgtagacccctgcatctcccaccatctgtgcagtgtccacctgtctattccctggggcaactgctgcatgcaattggggttccctaaacagggcttaggagatccaaggcacctgggccaaagactccttgacaaagatgggaaggcaccttgatagggtcttcttggtaaagggctcactccaacaacccccctcccccacccgcaacattcacataatgccctcctggaaagctgagcaacacacttaaaggctgatgggccactgctggatcaaagagcagagccaggccatggtggaaagctgagctgcctcaggacgttgttaaatggttattaatggtgaggggcaggggagggcctggagagatcttcgggctacaggcctcagccctggaaaccatcctagtggtttcacttaatgtgcaataaagcagctctctggaggcagcaggaactgccccactgcatcccaggcatatcaccaagcagatgctgcaaccttcactcatgcatcctctatgtggcttttgtgtctgtctctacctctgctctcaattacttacgtgtgtctgtgaggagtgtggagctctgctgatgggcctgtgcctcacagccccttccatctctcccgcctagttctcccctctgcagctgggctcaggtactgggattggacagctcctaaacatgagtttgggggaggagatggaagtggagagtagcaaagggaggaggcccaggacagcagaggcccctctaaggtcgtcaaagcggccagggactagtccaggggatcgtggggccacagaaggggacttttctcagtactggaactcgagctggggcgaaatcggatccacagagaggggtaggagggtgagtgattaatgaggaagattaagagattaaaacttgttctgggttggggaggggacactcactcggctgtcctataggttaccccccaccccagcttggaagcacagaagctcctgggtgctcgcctcttcccacccgcgggtagaaccctccctgttcacgatccttctcaagagatgcacggaggccagccttcaccgctggccccgcggggccaacggttttccttttcaggcagtctcttgtgtttcccaccttctcagattcctttgattgtccattcagacatttcggggccctgcgctccctccccttgtagagatccccacattccaaattcgctgtcttgggaaggcaccccattcccgcttaaggatgcttcctcacacctcccctttcagatttcccattctcacccctcagccctacccccaccttatcttgcacccacacaccccatcggcgggttcctccaccccgggccgcccccgctcgaccccgttccccactggtggcacggaggcctgctcaataaacgacctttagtctcggattgccggcccggacattccactgaattctgtgaatgtgtagcagggttggaggaccctcggaataacccccttggggaggtggacaaggacaatctcagcgaagagcttgctcccctcctccccacccttaggaaacgtccgtgaaccggagtgagagggcagtgggagttcagggagcaaagtccaggcggaggagcgtgaggcggggcttccgtccgtcccgcacacttctgggattgttttctctttcagaaagcgctactgcggagtgaaccggtccttatatcttagtttcgtgactttgggggcggcaggcctgtgagttgttttccgccctggacgctgttttgcaaagatctctgcgcgcccaccgccaccctcccgggcgtgcgggccgggaagcagccagcggtgggaaactccgacgccctcctcgacacttttctccccccaactccccaagactcacttctagggaagtcctttttcccatcaagccctgggaaagactggccaggctgagagagggacccgtcctcctctgtgccaaaggcgggagcaaatcctggtgctgtcgcctttggatgtgagtcctggaaatggcgggggtgaggaaggtgggcaggggcaaggtttggccctcaggcgagaaccgacgccttgtcccggaagcgcagcacggccgagtgcgtccgggggtgcagacggcgccctggggtggtcctgccgccacctctcctttgactcaggagcgccgcgccgcgtccgggcgcgttctcagtcgcgcgaagccagagaggaccctgggcgtgattctccctccctggcacagacggagacccgagtgaccccggggtccgggtgggcgtggggaatggacccatagacccgggacgagcggcgcggagcccgcagctggccagcttcagccaccttgggagacgcagtgcagctgccgctgctgacagacaagaccaaggctcggctgggccccaccccagatccggcctgagcgccttccgcgctgctcggcctcaaggcgaaacttttcgcgcagaaactcctggagaacagccccggccgccaggaaagaagcgtacccaggccgtctgctgtgtgcccaccccgatccccatcagtgccccacgcactcgagctcttcttcggcgtctgcagcctcttcatccgcgcggagaggcggaggtctcccggaaacagtgtccgactgtggcaccccagagcgtccaatgcgagctcaggcctttcccgcaagtctggagttttcttatccagttgaggccgccttcgctgtactcactctctgcctcccaccccatcttctgccacccgacctccatctttgatggttagcgccttcagccctcaacagcttcgcacaaccaacccctagaagccgtggagtcagaccggccagggtgggacctaggttttaactcgggttctggctacacacgctgcgcctccatacagtttgtcccaggtttggcagcaggccggctaccttcaggaattctttgctttggcttctgtctgttcctgtctgttgggcaagtttctagctaccccactgagagaaccatagaacaaggaccctggcatggcatacagacaaggaatgtttgctgaattaatggagctggtgccttgcagcttcccttttgttccttgaagttgcccttgctctcctccacatcagctccctctcctcctcagctacttattccccaccctggcttcttctagtcgcagtccccaagtacttgctgaatcctgtatggacagcctaagcctccatttctgacaattcctgtggccccactccatttgttttttagacttctccct

SEQ ID NO: 1232 - DNA, 4528 bp, Homo sapiens; identical to SEQ ID NO: 1231

SEQ ID NO: 1233 - DNA, 4528 bp, Homo sapiens; identical to SEQ ID NO: 1231

SEQ ID NO: 1234 - DNA, 1086 bp, Homo sapiens
ttggctcgccggttctggaaccaagtgaccacctgcgcgttggccaggccgagtcgcgtagctagcccgtctcgctcggacggcgccaggaaacttttcgcgcagaaactcctggagaacagccccggccgccaggtactcgcccgcccggaccgcaaagcccacagagcttcaattcgcaggaaggggagtggggagccctgagctggggtgttcctggaagaggtcggggagcggggggagaggcattccaggctggaggcctggaaacgtttggaagctttgctaaccttggagaccatgtcaggaaagaagcgtacccaggccgtctgctgtgtgcccaccccgatccccatcagtgccccacgcactcgagctcttcttcggcgtctgcagcctcttcatccgcgcggagaggcggaggtctcccggaaacagtgtccgactgtggcaccccagagcgtccaatgcgagctcaggcctttcccgcaagtctggagttttcttatccagttgaggccgccttcgctgtactcactctctgcctcccaccccatcttctgccacccgacctccatctttgatggttagcgccttcagccctcaacagcttcgcacaaccaacccctagaagccgtggagtcagaccggccagggtgggacctaggttttaactcgggttctggctacacacgctgcgcctccatacagtttgtcccaggtttggcagcaggccggctaccttcaggaattctttgctttggcttctgtctgttcctgtctgttgggcaagtttctagctaccccactgagagaaccatagaacaaggaccctggcatggcatacagacaaggaatgtttgctgaattaatggagctggtgccttgcagcttcccttttgttccttgaagttgcccttgctctcctccacatcagctccctctcctcctcagctacttattccccaccctggcttcttctagtcgcagtccccaagtacttgctgaatcctgtatggacagcctaagcctccatttctgacaattcctgtggccccactccatttgttttttagacttctccct

SEQ ID NO: 1235 - DNA, 1086 bp, Homo sapiens; identical to SEQ ID NO: 1234

SEQ ID NO: 1236 - DNA, 1086 bp, Homo sapiens; identical to SEQ ID NO: 1234

SEQ ID NO: 1237 - DNA, 1086 bp, Homo sapiens; identical to SEQ ID NO: 1234

SEQ ID NO: 1238 - DNA, 7090 bp, Homo sapiens
aaaaaagttgcaattccttgcctccactgtgagacaaaccccagccacatctccagcacacaagaacttccaaacgcctgaactgtagcagccaggcgttcctccagcagccagcaagttcctccccaaggagcttgctacacatgccggaaatctggccactgggccaaggaatgcccgcagcctgggattcctcctaagccacgtcccatctgtgtgggaccccactgaaaatcggactgttcaactcacctggcagccactcccagagcccctggaactctggcccaaggctctctgactgactccttcccagatcttctcggcttagctgctgaagactgacgctgcccgatcgcctcggaagccccctagaccatcacggacgccgagcttcgggtaactctcacagtggaaggtaaacccgtccccttcttaatcaatacggaggctccccactccacattaccttcttttcaagggcctgtttcccttgcctccataactgttgtgggtattgacggccaggcttctaaacctcttaaaactccccaactctggtgccaacttagacaatactcttttaagcactcctttttagttatccccacctgcccagctcccttattaggctgagacactttaactaaattatctgcttccctgactattcctggactacggctatatctcattgccacccttcttcccaatccaaagcctcctttgcgtcctcctcttgtatcccccgaccttaacccacaagtataagatacctctactccctccttggtgaccgatcatgcaccccttaccatctcattaaaacctaagcacccttaccccactcaatgccaatataccatcccgcagcacactttaaaaagattaaagcctgttataactcgcctgctacagcatggccttttaaagcctataaattctccttacaattcccccattttacctgtcctaaaaccagacaagccttacaagttagttcaggatctgcgccttatcaaccaaattgttttgcctatccacccagtggtgtcaaacccataaactctcctatcctcagtacctccctctactacccattattctgttctggatctcaaatatgctttctttactattcctttgcacccttaatcccagcctctctttgctttcacttggactgaccctgacacccatcaagttcagcaaattacctaggctgtactgccgcaaagcttcacagacagcccccattacatcagtcaagcccaaatttcttcctcaactgttacctatctcggcataattctcataaaaacacatgtgctctccctgccaatcgtgtccgactgatctctcaaacccaagcattttctacaaaacaacaactcctttccttcctaggcatggttagcgtgttcagaattcttacacaagagccaggaccacaccctgtagcctttctgtccaaacaacttgaccttactgttttagcctagccctcacgtctgcatgcagcagctgccgctgatttaatacttttagaggccctcaaaatcacaaactatgctcaactcactctctacagttctcataacttccaaaatctattttcttcctcatacctaacgcatatactttctgctccccggctccttcagctgtactcactctttgttgagtctcccacaattaccgttgttcctggcccagacttcaatccggcctcccacattattcctgataccacacctgacccccatgactgtatctctctgatccacctgatattcaccccatttccccacatttccttctttcctgttcctcaccctgatcacacttgatttattgatggcagttccaccaggcctaatcgccacacaccagcaaaggcaggctatgctatagtacaagccactagcccacctctcagaacctcccatttcctttccatcgtggaaatctatcctcaaggaaataacttctcagtgttccatctgctattctaccactcctcagggattattcaggccccctcccttccctacacatcaagctccaggatttgccccacccaggactggcaaattagctttactcaacatgccctgagtcagaaaactaaaatacctcttagtctaggtagacactttcactggataggtagaggcctttcctacagggtctgagaaggccaccacagtcatttcttctgttctgtcagacataattcctcagtttagccttcccacctcaatacagtctgataacagatgagcctttattagtcaaatcagccaagcagtttttcaggctcttagtattcagtgaaacctttatatcccttacagtcctccattttcaagaaaggtagaatggactgaaggtcttttaaaaacacatctcaccaagctttcaggcctgtcctcggaaagctacaaagtacagcccatttaagctcctgtatagatgctcctttttattaggccctagtctcattccagacaccagaccaacttagactgtgccccaaaaaatacttgtcatccctactatcttctgtctagtcatactcctcttctccgttctcaactactcatacatgccctgctcttgtttacactgccggtttacactgtttatccaagccatcacagctgatatctcctcgtgctatccccaaaccgccactctgaactcttgaagtaaataaataatctttgctggcaggactatgctgaatctccttaggcactctctaatcagatgtcttaggtcctcccaattcttagaccttttataccagtttttctccttcttattccatttagtttttcagttcatacaaaaccgtatccaggccatcaccaatcattctatacaacaaatgtttcttctaacaaccccacagtatcaccccttaccacaagatctcccttcagcttaatctctcccactctaggttcccacaccgcccctaatcccgcttgaagcagccctgagaaacatcgcccattctctctccataccaccccccaaaaattttcgccaccccaacacttcaacactattttgttttatttttcttattaagaaggcaggaatgtcaggcctctgagcccaagccaagccatcacatcccgttacctgcatgtatacgcccagatggcctgaagtaactaaagaatcacaaaagaagtgaatatgccctgccccaccttaactgatgacattccaccccaaaagaagtgtaaatggccggtccttgccttaactgatgacattaccttgtgaaagtccttttcctggctcatcctggctcaaaaagcacccccactgagcaccttgccgcccccactcctgcccactgagcaccttgagacccccactcctacccaccagagaacaaaccccctttgactgtcattttcctttacctacccaaatcctataaaacggccccacccttatctcccttccctgactcttttcggactcagcccgcctgcacgcaggtgaaataaacagccatgttgctcacacaaagcctgtttggtggtctcttcacacggacgcgcatgaaaatggacgcagattattcagactcctcctgtatcaggcccatggctttcaaagtgctggcagaacaaaaatggaagtccggtcattgaactaataaaaccaggaagagcaagagtgctgatggcacaatgcacccacctgcctccagatccatattttcaactgccttacctgtggaggaccttgaaacacatgaatctcaacgtggtacagcacctacagcacctagcccctgtgcccaactgtcccaagaggagccaatcctgagaagaagttgagccaatcatatttctcagtcaagcattagaagagacacagagacacctgagttggataaaaatgggcacttgccactgataggcaacctttgtagaacacttgctacatgccaggtaccttatagagatgatctaatataactctaggaagtaggtactgttactatccctctctttcacatgtaagcaaactgaggcttatagacgttaactacctttgccttaggtcatataactgttacgtgaaagatacacgattggaatccaggcaagttgtgcttgtaaccactaagccaggctgggcagcagaggcacttgtgttggggaagtagaaactccatacagataactgtaatgaggaaaagaagagccagtttctaaggcaagtgtgggaatggagcagacactgggagatcctgaaccctcctaggagagaagtcagggccccagtgctccactgcagtctcaatgaggcagaaatggaattagattccatccttttgatagtacagagataacataaggaaatgttgccatcaaataccctctgcatgattgggtgtatttttgaagatgatgttagctccaggagtgaccaacttttgaaaatgggtttgaacccagatctgcagaactctgcatctaaaggatttcaacagaagccccaacatagctctgtgtcttcctaagaaatcccaagacttcaggtgcttctggaatgctatcagagtgccatcttcagcagatggcttgatacaacatgaaagaaaagaaggaaggggaagagaggggaggaggaagggaggggagaaatggggaaggaagaaaagaaaggaagaaggaaggtaggcaagcactagaagtactttgtttctcctgaatacagaatatgaaatgaaaacaaaaagccacacaacagaagcacatttccagttctcagagccttctgctgcaaattcctagggagtccacgagctgctgcttgacagtggtgtccatctcttaattagcatttttggatccaccacaaatcagctggatggccatttcctcacaatttatagtcgcctggaaatggctttcacagctgggccacagatccctcacccagggagcctgtaatcgagctgctcggcagccttgttcagacgtaattaatatttctggaaccgctgctcagaggcttctgtaactgtgctgcaccaggggcgagccagttggaagtggatttactgttggacgatgggtgacacagctgtgcaggccccaggccaaggtgacaagagagctcggaggcagtcacccttcactgcctgtaatgtgagagtgatggagaagggaatgagcaaaaaggagagtgagacatggtcgtggcttcaactcctggctctgatgatcatggtctaaggctgcagaggggacaaaggtaagatgaccactggcatttttggctggccttcccctttcctccctggccatatgtacatgtcaactaccagcctttctccttgcaagctagagcttccaaagctagcagggaatagtgtacaactggaaggaatttgcaacagattttatttaacacccttgacttaaagtgagaccgaaggaggcccacagaagttaactggctggtgctgaggtcggtgagtggctgcttaaacagactggaaggaagaagatctctcaagttttagtctgtcccttcttctgccactacaagcttgaagtgggggaggatatgcatgtaactgagctttgcagtaacatgggccttagttgatatcccttctgtatcacctggggttgtgagacctttggggctgtggggaagctaactcatgaatcatcagtttcctcaaggagaaagacgcacacacacacacacacacacacacactccaatacatccatgatatgtaagtggtagctctcataatcatttgctgttattcttatgtggtcattactgttacctccaattcttgtgagctgtatgagcttggttgaatcacagaaactatttgaacttcagttccacatctacaaaatcaatacaagagaggccccatcttccaaaagctattgtgaaaagtctatagcttactctatgtgatgcacttgtagcagtgcctggcttgcagtgagatctcactagatatccgctactttgctatcttccttaatatcatgttcatggcaaagttccctatagctctgaccttattatttgcataattaaaggtatttcaaagccccctgaccttcagactcaagtctcaatttcttaactggacactgtggatcctcaagacctgtctctcgcatctctgtgcagctaataatttggcaaccctttgagggatctcactttgtcactcacgtcctgccctctggtcagtctctgcttcacctttcttctctctgcttcacctttgtgccttaaatacatagctttctctttctgaaattcctttcttctcctttctttttcttgttcttttttttttttttttttttggcagggggagagataggatcttgctctgttgcccaggctggaatgtggaataatgcagtggtaagatcataggtccctgcagtctgaaactcctggtctcaagccactctcttgccttggcgccctgagtagctgggagtataggtgcacaccacctcgtctagctaattttttatatataacttttggtagagatgggatcttgctatgttgcccagcatggtcttgaactcctggcctcaagtgatcctcctgccttctttcttcaaataacagttacttgcttatcaaggcttggtttacttgtcacagacttcagacttttgtatgctcccacaccatttccaggctatgcccctaggatatggctctgtcataccacttacaagtcaatggaaaccctggcttacctgactatcacatgcctacaatgggccctttgaagacatgaacttgacatttatctttgtttccccagttcctaacatatattagggcccaatgaatgtatgcagtctaaataactcaaatctaagaataagaagaatatactgtatgcatttagcataaagcctctcacatttttaaatacttgacaaacatttgttaaatgagtgagtaaagaaatgagtgaataatctgaagattgttatagtctctataacaatgcaatattctcatctttataggatttcgaataaaa

SEQ ID NO: 1239 - DNA, 2564 bp, Homo sapiens
ggtgtttcatccacattattgcaggaacagatgaatttaattaaaagaacaccacagtgggcacctcttccagggatgcctccctctaagaacatgacactgagatgatcaaggttctaaaagggcgatcaaatcactctccgaaaatgaaactgctcagacagaatgacaattaaattaataacaaccaagacaatgcccagatttcatctccgctcacagcccctcctgtgtgctgtatgatcaggttcttgggggtggctccagatacagcaaacagtcaggattaatccacaagagtgagctgtcagcatgaggttcccctacagtggagcttgccaaggtccgtggctcccagggcacccgttccagggctaacagatgaagcatggaaatgctgtgtggagtgagctgagcagccattctcaggagaaaacagacaaatcctcctgcaccctggcaaaccagctttgtggcctgttttatgtcatctttgctgagctccaccgggtcacccctcctgctggctttgtgatattgacatttcaggcactggcacagatacattggccttcctggctgggatttcacggacggagtgagcagtgctggcttggaggagccgtggcggcacagggcctgtgccctcagctgatcagtgcctgtcctgaccccaaagggccctcgcagcactgtttgaaattgctcttgccatgtttggaaccgattcctcggtacgtttcagactcattgttgtgactttggtttcaatccagggacacaccgtggccaatggagtgtctcaacagcatctatgatcgctgtttcccagagacagcatctcagataccgatgctgaaagagaaacagcagcctgtccccaggtggcaggaaatagtccattttaacggcaatttcataagtggcagatgatttttattgtaattttctggtgagctgattaagtggaggcagagtcagttctgaggcgtcaatgtctttaacaactcggggagaccgaggccatgctcagcaggaacactaagtccatggaaaacaggccctgggcccgctgatgtgcataattccacgtttgccccccatgtaaccaggatggtaaattacaggtgtcagataatcacgctctggagtggctacttgaggatgcgatcgaccaatttaagctccgtctgacacatgatcaatagcccgtgatgctgcatggaattgcaggcacagcgtccaaacctgcagagcagtggctcccagctgtggcaactttgccccccagaggacatttggcaatgtctggatatgtttgcaattgtcacaactaggagagggggatgctattggcatctggcgagtgaggccaaggatgctgctaaacctcccatgatgcacaggagaagtccccacacagacacatcctgcgcagactgtccataaagcttaaatgagatgctctgacttagagccacagtgaacattccattccatcgtctgggtatctccagggatgtacgtagctggatgtctagcttttcatctgggtatgaccggcctcacgcagaatcaaaaccatgtgtaggtcgaatctcttatttgctctcctgcttcctttcattgtaatattctccttctcattagtattttctgttattggaggaatggtaagaaaacataaaatgctggagagttacgattttgtttctgtcaataaaaaagtaatttgccagtgactcataaaaagcagaaaattaattagagaagacatgagatctatcaaaaagctgatcagggtggctcacgcctgtaatcccagcactttgggaggccgaggcaggtagatcacctgaggtcagcagttcgagaccagcctgaccaacaaggtgaaatcctgtctctactaaacacatgaaaaaaaagttagccgggcatggtggcagtttcctgtagtcccagctactccagaggctgagacaggagaattgcttgaacctgggaggcggaggttgcagtgagctgagatcgcgccagtgcactccagcttaggtgacggagtgagacttcgtctcaaaaacaaaacaaacaaaaaaaactgatcacctcaggagagcagcagagagaagagtccagatgggagctggtcagtttcaggagagtgcacagagcaggacctcgtgggactggcctagagctcctcaaactaacgtcagttcagcgggtgcaactagcattttaaaacattaatcacagagttgagtagaaaatatcaaaagtattctgatgctctgacatttccaggccttgccgaccctggacagcgtgctcttcccatgcctgccaattcctaagagacaggaaacaactcatctggagcatgtcttgcaaatgaaaaacaaatcaagagcccacacgccccaaccacctcttttattgggctctccctctccagggccaggtaccagacaactaggaacagcccctatgtcccagagcctgctgaagtgactcacactcacaaccctgagcctggtgactgcctatccattcattcctca

SEQ ID NO: 1240 - DNA, 2564 bp, Homo sapiens; identical to SEQ ID NO: 1239

SEQ ID NO: 1241 - DNA, 700 bp, Homo sapiens
ggagaagctgcctgtggctgagagcttgtgtgtttggggaggtgctctcagcctgtcatatgcacttctcaatcttctagaaagaaacccaaaaaagaaagcagacgacgacctcgggacagaggagaaaaatcccaagtgttcacacagttacacggagtctttatggcaaagagaacatttagcagctttgaatattgggcatctcctttttactcaacacaagcattctagaccctataaaggactagttcttttgttgttgctgggttgtgtaattttttgtgttttcccagtgataagcccagttgttggtaggcagaggcccgagggaagggtgactccccagtgttgtgctgaatcctgcctggaggctgctacactagattctccatcattcctctgcctcacagcagtcccagaagaggaaggctgcaggcccagttcccggagcactgccatcaccctaccccagcttacagaagagctcaggggtggctggagcacggagggagatggagtggcaaggcagtgaatgacatgcgtgatgttggggctgttgcaacatgggaccacgtgaccctttcctgttcactctaccctttgactctaaatctcaaagccagtgttggggcccagtggctccattcgattgaaacatggccaatgatatccaagagctccccttcagggatgtcaa

SEQ ID NO: 1242 - DNA, 700 bp, Homo sapiens; identical to SEQ ID NO: 1241

SEQ ID NO: 1243 - DNA, 1072 bp, Homo sapiens
ctttgctgactctcttttcggactcagcccgcctgcacccaggtgaaataaacagccatgttgctcacacaaagcctgtttggtggtctcttcacacagacgcgcatgaaatttggtaatcaggctgctcctcgccaggccgagctgggtcccaattcttcctcagcctccgctcctccaccctataatctttgtatcacctcccctcacacctggtccggcttacagtttcggcccgtgactagccctcccccacctgcccagcaatttacttttaaaacggtggctggcgccaaaggcatagtcaaggttaatgctcctttttctttatcccaaatcagaagcgtttaggttctttttcatcaaatataaaaatccagcccagttcataacttgtttggtagcaaccctgagacactttacagccctagaccctaaaacgtcaaaaggccgtcttattcttaaaatacattttattacccaatctgctcccgacattaaataaaactccaaaaattaaattccagccctcaaaccccacaacaggatttaattaacctcgccttcaaggtgtagaataatagaaaaaagttgcaattccttaccttcactgtgagacaaaccccagccacatctccagcacacgagaacttccaaacgcctgaaccgcagcggccaggtgttcctccagaacctcctcccacaggagcttgctacacgtgccggaaatctggccactgggccaaggaatgcccgctgcccgggattcctcctaagccgcgtcccatctgtgtgggaccccactgaaaatcggactgttcaactcacctggcagccactcccagagcccctggaactctggcccaaggctctctgactgactccttcccagatcttctcggcttagcggctgaagactgacactgcccgatcgcctcggaagccccctagaccatcacgaacgccgagctttgggtaactctcacagtgaaaggcccatccatctggcagagaaagggatgctcaggacacagaacaaccatgttaccttaacaagacttccgtgagcacc

SEQ ID NO: 1244 - DNA, 323 bp, Homo sapiens
gggcagcaaggcacgcctgtgaccagccctccacacctcggcagcactcgtgggtcctcctcaaccaggcggacacgagaaacagatgataacatggtgcaaggacagacttcagctcaccaatcagatgaaggttttggggttgggttttttcagacaacgatgtacattttagcttccaaatgtgcacaggggcacaaaggtctggatgctgggcactacgggtaccacaagaggatggaaagaaccagctcattcggttttattgtatgtatgtatgtatttattttgagacagaatctcactctgtcgtccaggctgga

SEQ ID NO: 1245 - DNA, 1430 bp, Homo sapiens
aacatcacaaacatcattatagaagagagctccaactctctctctctcacacacacacacagacgcacaatttgaccaagttgatgaaataaatcagataaagaaatgcacagcagaagttaaaaagttatggcaactgtgaaggtcaaccaaaacttgcccatgagctaaatatggcctctgagctagcaatctgcaagctctgccttagagtaacagaaaagaaaggagaacccaacagagagaagcaccagagcagaaggcagaggatgaggctcattcctgcctctgccttacagtggactttgggtaaatcatgttacttctctgagcttcaaaacccctacccccaaattacagtcttgaggcagatgatctctaaaacatgccacctccaacattctatgatgttgcaggaagtcagggaccccaaacagagggaccagctgaagccatggcagaagaatgtggattgtgaagatttcatggacatttattagttccccaaattaatactttaataatttcttatgcctgtctttactgcaatctctaaacacaaattataaagatttcatggacacttatcacttccccaatcaatacccttgtgatttcctgtgcctgtctttactttaatctcttaatcctgtcagctgagtaagatgtatgtcgcctcaggaccctgtaataattgcattaactgcacaaattgtacagcatgtgtgtttgagcaatatgaaatctgggcacctttaaaaaggaacaggataacagcaattgttcagggaataagagagataaccctaaactctgaccgccagtaagccgggcggaacagagccatatttctcttctttcaaaagcaaatgggagaaatatcgctgaattctttttctcagcaagtaacatccctgggaaagagaatacgtgcctgggggtgggtctctaaacagccccccctgggcgtggccgtcttttatggttgaggctgtaggggtgaaatagaccccagtctcccatagtgctcccaggcttactaggaagaggaaattcccacctaataattttggtcagaccggttgctctcaaaactctgtctcctgataagatgttatcaatgacaatggtgcccgaaacttcattagcaattttaatttcaccccagtcctgtgttcctgtgatcttgccctgcctccacttgccttgtgatattctattaccttgtaaagtacttgatgtctgtgaccacacctattcacccactccctctccttttgaaaatccctaataaaaacttgctggtttttgcagcttgtggggcatcgtggaacctaccgacatgtgatgtctccccctgatgcccagctttaaaataaatctcttttgtactctgtccctttatttctcaagccggccaacacttaggg

SEQ ID NO: 1246 - DNA, 277 bp, Homo sapiens
ataatatgttgcaatttattgaatgtttactatatacatatatgtttatatatatatgtttatatatatgacatgtttatatatatgagacaatggataaaaataggttttggcaataaagtagggtccttacattagttataaatatatacagttaggatcctatcttaaaacacactaaatatgtgcagtaagccagaatttatagggtttgttaccctttagagatccattagatgtttgcaggataggtcattcactgtgctcaagatttttc

SEQ ID NO: 1247 - DNA, 277 bp, Homo sapiens; identical to SEQ ID NO: 1246

SEQ ID NO: 1248 - DNA, 4292 bp, Homo sapiens
cagggaaattcgactccacaaaccacaggcctcggcgggggaagagcccggcgggcgccagcgaagcggaaccaaacggagccgcggcacgcaggcgcaaaggctggcgttcgaggttcgtttacgcgccgcttcgccgtgcaggtggtggcgaagcgctcctccgaaaggtttcggaagctggtggtagctctgaagataacgctgcgttagggcatactgcggcggaggatggaactccgattgaaagcagttgctggagtggagcacgaatttcaacaagccgcatgttgaagtgtgaggcgtgaaagggtatgtctgatatttgctttaaaatgctccagcaaagaaattaagggatggatgaagcaaaagagccaggtatggtggctcatgcctctaatctcagcactttgggaggccgaagcaggcagatcacctgaggtcaggagtttgagaccatcctgaccaacatggtgaaactcgtctctactacaaacataaaaaaattagctgggcgtggtaccacgcacctgtaatcccagctactcctctggaggctcagacaggagaactgcttgaaccgggaggcggaggttgcagtgagctgagatcgcaccaatccattccagcctgggcaacagagtgagactccatctcataaaaaaaaaaaaagtaaagaaaaaaaagaaaatgtctttatttcattttctttcctaaagaatatatttgctggataaaggattctgtgttgacagttttgttgctttttaaaagcactttataaatgttgctccatggtttctgatgagaaatctgccatcactgaaatctttggttctcctatatacaaagtgttgttttcttccagttgttttcaaagtattttctttacagttggtttcatcactttgattatgacgtgcctgggtgtggttttcctttttgggatttgctgtgccagcagaccggctttaaatagaatgctatgtaaatgtatgtgaatatttgttttttgccagatgtttggaagtttttagctattatttcttcagatatttttttcttccaattgttctttctgggctcctaagacatgaatattagactgtttcatattgtcccacagatccccaaaggtcttctcatttttttcacttttttctctgtcattcagactagataatttctgctcatgtatcttcaaatttactgactcttccctcagtcatcttcattgtgttgagaccttccagtaaattttgttattgtattttcagttctacaatttccacttgtttctttttatagcttctatgctgagacttttagctttccatttatttcaacagtgtttccctttatatatttcctttggagaaatgtcttctttgtgtagcatgattaaaataactagtttaacggccaggtgtgctggcttatgcctgtaatcccagcactttgggaggcccaggcaggcagatcacttgaggtcaggagtttgagaccagcctggccaacgtggtgaaactctgtctctattaaaaatacaaaaaattatctaggcgtggtggtacacacctgtagtcacagctactcaggaggctgagacaggagaatcacttgcaccctgggggtggaggttgcagtgagccaagattgtatcactgcactctagcctgggtgatagagactgtctcaaaaataaataaaaaaaataaaataactagttttaagtctttttctgataattctgacatttgggtaaccttagagttggctcttgttcattgtcttttccctagagagttgcttaggtttcacaagttctttgtccaatcattttgggttgtttctgggatatatttggaatattatgatattctctatcctgtttaaatcttcataagaatgtttttgttttgttttgttttagcagaccatcaattcagttaagtttcagagcacacatcctggccactttttttggtggctgtggttccaatgttagttttcactgcctttgttaagctgttctttgccccagttgtgcaccatctagtggccaatctgaaacttggacagtggcctacactgtaattcagtgttcagaacctttgctcagctgcttctggttagtttcacacatacacagcttgtgagatgatcccaggattttattgacagatttaagggttccttttcttcagttccctcctatttgtgatcttacctatactctggtttctagaaccccattcttggtttttggctagaaagtcagggcgttagcctccccattgccagtgttctgccctgcaatgtctgccactagtgcaccagggggaagagaagagtgatacctctttactgctgcgggattgatgtagagcaaggaaagtccagaaggttccaagtcattacccatggttctcctggtggggcggtgggtcttactgcatctttcctgaggctctcttagaatactgcaattaaattaaaaagggttttgtcccatagcctccaacctcctttctggtcctctgactagaaacagcaaattgttccttggactatttttctctctgtcagctagcatttccagttttcctgttaaatgtcttttttctttttccttttttttgagacaaggttttgctctgttgcacgatcacagctcactggagccttaacctcctgggctcaagtgatcctcccacctcagcccccgtgaagctgggaccacaagtatgagccaccacacctggcaaaatttttttaattttgcagagacagtgtctccctgtgttgctcactctggtctcaacctgagctcgagtgatcctcctgccttggcctcccaaagtgctcgattacaggtgtgagccactgcacctggccttattatgtgtctatgtgtggattttctagtttattctgtttgggatttgtctggcttctagaatgtgtggggtcatgtctttcatcagtttttaaaattctgcattctatctaagtatttgctctgtcctattcttgcctctcctctcacagctaatgaagcacttaggatttttcactgtattctctacaggtcttctgtttttttttccagctgtttctcccatggtgcactgtgaatagtttctcctgagttatcttccagtttataaactaccccaattggctacattctattacatctatttactgagttttaaagtgcagtttttatgtatattcttgtaatgtttatattcagttcttttccagattagctccacaactttttatcgtatagtttcccatttcctgcaagtacattcacacaccttatttccttaaacaaagaaaacaaatctaatacctatatctgtgagtttgttttcattgcttcaagtaattcttgcctctggaatctagtttccttatatgactactttttactatgtgttactagacatatttgaaaagtaatttgaggcctacaatgaaattacttttccatgaaaagtatttacattttattttctctgtcacctggaggcattactagtgtgggaacaccttaaaggaagctcagtgcttaagattctttagatcactggggcaattctaaacttgcctgttcttttacattggttcttccacctctgattcattatcatcctaaaggtgaaagtatttgggagtctcagcctattgtgtggagggtctcctgttaggttcatcaccttatatgggccctgaactttaatttctgtccccctcactcataaggttgtcagagtaagggtacatgcttgcttctcttattctctttacttttggacttggcattccttattgtctggaaaatctctttgatgttttaagattattcttgtattttaatcaggaattgttttcaacaggaacatgatgtaaatatcctagcatgcaattttcagaaacaagtagtttcccacaattgaatctttgctcctacagggccaaatcctactctttctcttggcatgctctgcacttaagcgcatactacttgtggcatggaatccataaatgttgataaagaactacgcctaattctgtcagaacaattaatcatttttagaaatttttgcttagaaacctggtaaagtgctctgcatgtagcaagtatacgaacacacaaagtttgttgaatagctgcataaaacaaatgggctagattttacttcatatttcaaaattcagagaaagagagtagtattaaaagacataagccaaaaatagatcattgcagactgagt

SEQ ID NO: 1249 - DNA, 4292 bp, Homo sapiens; identical to SEQ ID NO: 1248

SEQ ID NO: 1250 - DNA, 4292 bp, Homo sapiens; identical to SEQ ID NO: 1248

SEQ ID NO: 1251 - DNA, 4292 bp, Homo sapiens; identical to SEQ ID NO: 1248

SEQ ID NO: 1252 - DNA, 4292 bp, Homo sapiens; identical to SEQ ID NO: 1248

SEQ ID NO: 1253 - DNA, 4292 bp, Homo sapiens; identical to SEQ ID NO: 1248

SEQ ID NO: 1254 - DNA, 4306 bp, Homo sapiens
ggggtgtgcaccgacatggggagctgcagagtcatttggtgcatgcacattcaggttcacttttctaaggtggttatgagaatttatctctcaccggtcgtgggttctggtcccagttaatacctccccagtcctcgataggggaatctttttttgtttgtgtttttcttgagcctcgctggtgggcatgcagcaagtcctatttgtatgtttggtttttttttagcacactcacaaagactaatgagactgcacaccttttcacctatttattggccctcttggggagcatcttttattaagagcctgctcagtcatttgccggttctgccacatgggtgtctatctttttcttattggttcataaaagaattttgaaaatataagctatattgctttatatctcgttcttgttagttatatgtatgtagaaaacacattatctgcggcctttgcactttcttaatggtgtccttggatgacagcaagctcttaaatttcaatctttttgtcagtggtttagtgccttttgtgttcttggtaagtaatcttttcacagttccccaataataacactttttttcttatgttattctctgggagacttaattatgtttatttttaccttttacatgtaggtcaacattccatctggaattgggtttttgcatggtgtgagatgctcagagtcgataatttctttatggatatcaaatttacacagcccatcggttgaaaatgccatttcccacaatacatattatctttttcataaaataagggtccatatatgcatgagtttggttctggacactctattctgttttgcaggtttctgtcgaccctgcaggaacactcatggtatacaagactgtagctttgtaaaaactcttgatcgctggtagtctaaattttttcctctttcctcatatttgtcttggctatattttgccctttgcgtttccatataaattttagaaacagcttgtcaatttccacccactcacgcaagtcccactgagttatttattaggaccctgtgggatctgtagaataatttggggagaactgatcttttgtaacatttgggttttgacaaccctggaatgttcctactggctcccaggccatccctccatgactgtgttctgtgggtaaccctcaatctgtcctgatcagccccatcatgctggtgtccagagaaaaaggtaggctcccaaattcagagatggagggattggtgaggctggcattcaagaatagtgagaggtggatatagatgttttagaggacaaagctgcctcagtgcctagaaaagggcttgagacccccaatgacacagatgagtttggagatcacacatgtgtggtgttgcacacctttggggcagggacccctctggcagggctcagcagcctctgcaaaggtgtcaaaggcagaggggctcgtcgccacccagctctcaggggctgtgcaccctcctggacccctttcaactgagttgattggagtggggtggtcatcaggattgccgtgtcctccaaaatgtatgtgtttgactcctcagccccagggtgatgatgtgaggtggggccttgggagttgattgggtcttgagggtggggcttcatgatggggttgctgcccttgtgacggaggctccaatgggctccctgccctctctcctcctggtaaggacacagcaagcagattccatctgtggaccaggacgcaggtcctcatcagacatccaatctgctggcaagttggtcttgaacttccagcctccggaactgcgaatcgttgttgacaagctacatagtctgtgtattccattatagcagcccaaagggatgagaagatggatatggcccggagataatgcacacctctcgtggggacagtgtccccatccccctccggctgcactgaagacctggagcaatggctgccatccatgcgcgaggacccctcggaggttccacctgcacagaccttgctaagggtgaggtgattactagaaggagcaccttttctagttaaaatctaactagattctccttggcaacttgtcttacagaaacagaaagactgtggggagagtccgttttcttagagccgtatgaagaaatcctaaaaaccaactgcccaatctcaactcgtaacagggaacctggggagtgacatcagagattcccaatgttttcctcctcgttgatccctgcgatgaaggcacttgcccatgtgtattctgtagtaggagtttgcattctgaaactggtctttattaaagaacaaacacattatttacaaattatagtaagagaaatacctacttatttgtaaaacttgttgctcagcataacaacacaggtgactgcatgtcatccacagagtttcagatgactctgttatgccgaccatgtcctggtggatgtgcagttctctcataggccttttaccttattgaaaatcacgcgtgcatcccagctgttgtttaggatcctgagccccctgggctgggagccacagcactgatgacctcagaaacaaggttgttagaggctgtgttctctccacacccctttcttgtgaggccctgggatgctgcttggtctggaggggcatccttcccaaagccccacaggaggctgctgtcatctgcattctaccgagggcatccccagtcccaggtttcatcctggtgtcccgctcatatgttccctgtcaccctgacgtgctcaaatgagtcagtcgtcttcattcatagattctacattgcaaattctcctactcactaaaatttatttgtagcgtcaaaatcagcattcatgcactgtcttagattgtaggtgtgcacagagcgataaaaaatcggagtcgcctgacatgcacagccccgcctggggctgaacaaaggcccagctctgccttcccgttacggctcatcctgtaaacggtgtcctttctgtggtctgttgagtgccgtattttttgaatttgtgtgcattttgctggtgatctcactgcttaagagggcgagcacagtgtggaagtgctgtagtgttcccacgtgcaaggggctgtggtgtgcctcatggagaacacgtgtctgagaagcttccctcaagcacgagtgatgaatcaacactgcatagtgaacaaggtgtctaaacagaaacacgaagcacaaggctgtgtgctgatccatggatgaaatgctgtgaccagagctgagccctgcgtttccccaggagcaggggtgtccgtcggctcgccgtctgcagactctagtatgtagccaccctgagtggtggggaccgactgcacttctcagcagtactcggctaaaagcctgcgtgcaacttagctttatgtgtcctgagtttggtctttgtttcacaaagggaagggggttggatgttgggtttcccaggacatggtgcctgtttagaagtgcccccagggcctcagagccagcgggaggcatccacccaaatgctgctgacaaaccttcctgtggcagctgccactccacacggaggtgcagggaagccagctgccagggcacacacacaaacacatgcatgtgcacacacaccatactgtcacacacacctcaacatgcacgtgcacacatgccacactcacacgtacacaagcacacatacctgaatatgcacatgcacgcacacatgctccactcacgtgcacaagcacacacagccacaccggaacacacatgccacactcacaagcacacactggaacacacatatgcacacactcatgccacacacagataagcatacacacatcagaacacacacaccacacctacacacaagcacacacaccccaaaacacacatgcacacacacatgctacacacacacaagcacacacacacacaggcacacatgccacataaacacatactggaacacatacatgtacacacaccacagaagcacacacactgaaacacacacatgcacacacatgcacacacacacacaccagaacacagacatgcatacgcatgccacacacacacacacctgaacacacatgccacactcacacgtacacaagtgcacacacaccagaacacacacaccacactcacacacaagtgcacacacacacaccggaacacacatatggatacacacatgccacgcacaccagaacacaggcacatgctccatgctcacacacacatatactggaacacacacatgcacacaccacacacacaggcacactgaaacacacgcacacacaccagaacacatgcacacac

SEQ ID NO: 1255 - DNA, 1276 bp, Homo sapiens
gtagcgtatctcttggtccactgtctggccattctgtcatgttctgctctgttggtcatatactgagtggcaatacttcccaccaaggggtcggctggaagaaaagaatgtagattactttggagaaaggaaaagaacattttaaactttagcgaatagtgacagcttgggtagatacgtacgacaaagtatgtgtgatcaaacccatcttcgaaacaccactccaccatgctggatatttttccatcaaaatttcaaaaaaacataacgttgggggaagagggaatgcttaggctttagtgtactggtctgtctttatcttagttcattccatttttctcccaacaaacaacactcaattggagtttctttactcttatgtgttaggctgagttcagtagagactggaacggtcaaggcttcagactgcaatgaacatccagctgtgttcatgtgacccttagctcaatgtcaccagttaacggcattgtgaatactgtgaagtcttcggggctgttgcagtgcaacactattaacctttacgctggttaaagagccaggttgccaggcaaaacctggacctccaattaagtatagtatttctctgaatcttaggatctttaataaatttatatttggtttacctagaaaatatatttgtctgtgtgtgtgtatatatatacatatgtgtatatatatatattttttgagacagggtctcgctttgccacccaggctggaatgcagtgcagtgacatgctcatggctcactgcagctttgaccttctgggttcaaacaatcctgacacctcagccaccctagtagctgtgactacagaaaaatattttttaaatgaaatgaagtcccaaaaaagtcacaattcaatagtcactaagtatttaacaactaccattttcaaaattgagtgccatctcagtgaccagctatgggacacatgctcactgaaccccagaggcacaggtgaggcttgccaggcagatgactcgacatttagaagtgtctgatttgttttataagaactctatgggaaattaagcaacaggaaaaaaaaaggaggaagaataattgaaactaaaagcccaaggcaaacttacgtcagtcttcagtttaaaataccttgttgctagaatatactgattaatgaagttgtgtgtctcaactagtagactgaacttgattaaaactttcttttgaaaagccgattagtttttgtattcacaaacttgtgcagaaaaattagttttgtcctttgaa

SEQ ID NO: 1256 - DNA, 655 bp, Homo sapiens
taataaatacaattccggatttattaaaaatcagggctcccctgctgtgccctcctggcactaaggaaataaataaccagagggggcacagctaggtaaagggggaaaaaatcagatctcaagacagactctttgaactaccctttctccctccccaattcccacccccttatggctcttgggacatagcacctgagcaggcacctcagtccgtgtagagtgtgaccggcaccaaggcatgtctgccctacccaagaagggagacagggctgaagcaccaattggaggcacctgagggtggtggctgggggagggaggatggggtaacagaacctaggcagcagaagcagctgacgggggtccggccccctctccaagttcagccagtgcctgactgaggatcttccggggcagttcaacagcagcacggatgaagactgcatcatcccgcacatagtttcgctttcgaatgtcctggtgggagatgaacttgggataaccaaagcccagagaactctcatccagggagccccgccacgtgcctggcttctggaaattcttccagtttgggtcggggtggaaggtctcagtgacgtgctgtggtttagccagcccagggtcgctctgatccagcagggagaaggtgacacggcgg

SEQ ID NO: 1257 - DNA, 655 bp, Homo sapiens; identical to SEQ ID NO: 1256

SEQ ID NO: 1258 - DNA, 5275 bp, Homo sapiens
aataggaaaagtgagagtggaagaaagaaaaagccagcatagaatgtgttaatgagtggattgttgggactcacttctgctgagtatcctctgacaaactgtgatgaatatgcttctggatagtactactgagagatgggcatttttttctccacaattgcaggtgaagacacaagcaagccaaggaaatattgagtgctttatccattgtgttggctaccgtctacctcttgcactgctcagatatgcttacatccaatacagattctgtcaggcctctgagcccaagccaagccatcacatcccctatgacttgcatgtatacacccagatggcctgaagtaactgaagaatcacaaaagaagtgaatatgtcctgccccaccttaactgatgacattccaccacaaaagaagtgtaaatggctgatccttgccttaagtgatgacattaccgtgcgaaagtccttttcctggctcatcctggctcaaaaagcacccccactgagcaccttgcaacccccactcctgcccgccagagaaaaaaccccctttgactgtaattttcctttacctacccaaatcctataaaacagccccacccttatctctctttgctgactctcttttcagactcagccagcctgcacccaggtgaaataaacagccatgttgctcacgcaaagcctgtttggtggtctcttcaaacagacgtgcatgaaatttggtgccctgactcggatcgggggacctcccttgggagatcaatcccctgtacttctgttctttgctccatgagaaagatccacctatgacctcaggtcctcagaccaaccagcccaaggaacatctcaccaattttaaatcagtttttcaagtggtacctgagattcagcacttctaaaaagctccaaggtgatgaaggtgctgctagttggaggccatactttgagttgccagatgctaaaaattcaacagatgggagtaggatttaatggcatcaagattacagcaagagtgtcgtcaatgtctgagagaaaaggcacaggacaattcatgtaatctactttttacctcctcactatgccagcagcacacttggagaggaatgttataatggaagaagctgcccagtcactgattaaaatatgaacataacaggaaatgttaaaagaagttcctccctgaagatgaagaaaaatgaagccagatggaaaattgaatttacacaaggaatgacagtgtctagaatgagtggcttctacgcttggaccgacacatggaaaatggaatcccttctcctgctccttgcacttctgtaggcacagctgctgttgctacctcaggaggctggggcagtagagctgaatggctgcctttctggggctgttagttgtgagtgtacccccacatgtggtatggcctccatgcatggactgtcccatgaaagatgggtgtcctcaccctgtgcagtgctgctgctactgagagtggcaagcctgggagctgcatgtctgagactgggtgtcaaccccttaccacgtcaccaccaacaccagtgtacaccactcaggaccaagagaatcatcctgctgctgctatctatcacctatataccatgcttctatcacccatataccatgcaaactgctcaggacccaagaatctgctcacctacctagatgaatgttgccactcaggccatctgagcaagctatctggaggctcaagaatcagtccatctgattccattaacattgatgacagtgtattctaccctggagcacaaaaacaggcatgtttacccactgctgccaccatgggggtctgaaaactggcctacctggcatccttgtttgccgcaaaattttaccatagcctccactaataactgcaccctgaacaacctgaggaaataacagataccactcaggctgtcacagctgaaaaatcattcagggattacactgtctcatgcacccagaataaaagctaaaaggtcttacccaaccaacactattaatatattttcaggaaaaagtacccacctacaaaagaaaatttgaaaaaaaaattaaaaagcaagaaaatgtgacacctacaaaaggacataataattccagcaacagatcacaatataaaagaaattcatgaaattccaaaaaaagaattcaaaattatgatacaaaagctcagtgaaataaaaaagaattctgaaaaacaatatgaggaaatcagaaaaagaatccaagatatgaatgataaatttaccaaagagatagatatcataacaaagaaccaagcagaaattctagaataaagaactccgtgaatgaaatacaaaatatatttgaaagcttcaaagacaggctagatgaagcagaagaatatcagaacttaaagacatgtctcttgaaataacccagtctgaaaacaataaagagaaaaagaattttaaaagtataaaaagtataagtcagacaacaatcaaaaaaaataattttaaaaatataaatagggggccaaatggcttactataaacagctgccattacaggttcccaccaagaagaaccaaaatagcatgtgaatcctgcactggcaactgaggtatccatgttctatcatcaggactgactagtaggttgacatgacccatggagagcaaagaaaagaggggtgatgcgatggctcacctgagagccacacctggcaaggggagccgcaacccccagccaagggaggcagtgagtgattgtgctacccagcttggtaaaccatgctttttcaatggatctgtgcaacccgtggatagggagatcatactcatgaacccatcccaccagggattctgtcccaaccacagagtcacacagattctcaatagccacttggctggagactgcctaagactactgagctcccaggggaaggggaggccatcatcactgctgctgcctgctgccttagaaaactgagcaccccaggcaagggacggcagccatcactgcagctgcctgctgcctaagatgactgaactgctggcggtgggggtagggcagcagccacccctgcagcttcagtccgctgtttttcccctgcaatgccagggagactgaatggtttggacttaagaggtattccccacaggatagcacactggctgtggcagattgtagacatactgcgtctttaggccaaactctgccccgtgcctcctgggcaggccatccctccaggaacttcagcaactccagccagaggcttagggacagaactctgatctctatggacctgagccctagggagtggggtggatgtggtctctgaggaccaacagacttagtctttccccctgctagttctgaggaatccaggcagcccagaccagtgggtttcccccaagtgcagaacaccccctccacaaagggacagccagagtgctttgttaagtgggtcccagatcctgtgcccctgacgggtgagataccccaacaggagtcaccagacactttatacaggagcattcctgctgacatcaggttggtgctcctcaaagacctcagaggaagaagcagccaccacctttgctgttcttcagcctcttcaagtgacatctacaggtgcgggagggacccaggtgaatagggcctgaagtgaaccatcagcaaatcacagcagccctacaaaagagtagcctgactgttaaaaggaaaacaaacacacagaaagctacaacaacagcattaacaaaaatgtccccacaaaaaccccatccgaagatcagcagcctcaaagaccaagacaatggggaaaatgtctccagcacatatcaaagttcttcatggcagccactctcgtcacaggcctggaagactaggaggaaaaagtggttttgtgggttgggcccagggtccccatgctatgtgcagcctagggacttggtgccctgtgtcccagccactccagtcatggctgaaaggggccaatctagagctcaggctgtggcttcagagagtgcaagcctcaagccttggcagtgtccacttgatattgagcttgccagtaaacagaagtcaagaattggggtttgggaacctccttctatatttcagaagatgtatggaaatgcctggatgtccaggcagaatttgctggaggggtggggctctggtggagaactactgctattgcagtgcagaagggaaatgtggggtcagagcccctacacagagtccatactggggcacctcctggtggagctgtgagaagagggccaccatcctccagacccgagaatggtagagccactgacagcttgcactgtgcatctggaaaagatgtggacactcaatgccagtctgtgaaagcagccagaagggaggctgtaccctgcaaagccacagggacagagctatcccagaccatgggaatccacctcttgcatcggcatcatctggatttgagacatggaatcaagtagatcactttggaactttaagatttgagtgccctgctggattttttacttgcatggggctgtaactctttagttctggccaacttctcccatttggaatggctgtatttacccaatgcctgtacccctattgtatctaggaagtaactaacctgcctgtgattttacaggctcatagatggaagggacttgccttatctaggatgagactttggactgtggacttttgagttaatgctgaaatgagttaaaactttgggggactgttgggaagacatgattggttttgaaatgtgagtacatgagatttggaaggggacaggggaggaatgatatggtttggctgtgtccccacccagatctcatcttgaattcccacatgttgtgggaggaccgggtgggaggtaattgaatcatggggacaagtctttcccatgctatactcacgatagtgaataagtctcgtgatctgatggctttaaaaatgggagtctccctgcacaactctctcatcacttgctgtcatctacataagatatgacttgcccctccttgccttctgccatgattgtgggacctcctcagccatgtagaactgtaagtccaataaacttctttcttttgtaagttgcccagtctcatgtatatctttattagcagtgtgaaaacagactaatacaaatcacctctatgcaaataaactagaaaatttagaagaaatggataaattcctgtacacatacatcctttcaagactaaaccacaaaaaagtcaaatttttgaatagaccaataacaa

SEQ ID NO: 1259 - DNA, 5977 bp, Homo sapiens
aataggaaaagtgagagtggaagaaagaaaaagccagcatagaatgtgttaatgagtggattgttgggactcacttctgctgagtatcctctgacaaactgtgatgaatatgcttctggatagtactactgagagatgggcatttttttctccacaattgcaggtgaagacacaagcaagccaaggaaatattgagtgctttatccattgtgttggctaccgtctacctcttgcactgctcagatatgcttacatccaatacagattctgtcaggcctctgagcccaagccaagccatcacatcccctatgacttgcatgtatacacccagatggcctgaagtaactgaagaatcacaaaagaagtgaatatgtcctgccccaccttaactgatgacattccaccacaaaagaagtgtaaatggctgatccttgccttaagtgatgacattaccgtgcgaaagtccttttcctggctcatcctggctcaaaaagcacccccactgagcaccttgcaacccccactcctgcccgccagagaaaaaaccccctttgactgtaattttcctttacctacccaaatcctataaaacagccccacccttatctctctttgctgactctcttttcagactcagccagcctgcacccaggtgaaataaacagccatgttgctcacgcaaagcctgtttggtggtctcttcaaacagacgtgcatgaaatttggtgccctgactcggatcgggggacctcccttgggagatcaatcccctgtacttctgttctttgctccatgagaaagatccacctatgacctcaggtcctcagaccaaccagcccaaggaacatctcaccaattttaaatcagtttttcaagtggtacctgagattcagcacttctaaaaagctccaaggtgatgaaggtgctgctagttggaggccatactttgagttgccagatgctaaaaattcaacagatggggatttaatggcatcaagattacagcaagagtgtcgtcaatgtctgagagaaaaggcacaggacaattcatgtaatctactttttacctcctcactatgccagcagcacacttggagaggaatgttataatggaagaagctgcccagtcactgattaaaatatgaacataacaggaaatgttaaaagaagttcctccctgaagatgaagaaaaatgaagccagatggaaaattgaatttacacaaggaatgacagtgtctagaatgaacatctaggagcgaacactagagtccaacagaaaagccacaagaaatacctggggcatagaagaagaaagtgagtggtcagctcagtcgagatcgggatcaactgggagcccaggggtgctcagtgttgtaaggaaaaggtaagggagagaacttcagcagtccacatctccagcatggactgctgcaatcctaaccatgggagaagtcctgta[450 bp omitted]gctcagccttgcaaacagagtgatatcccttcccactggcagagtggcttctacgcttggaccgacacatggaaaatggaatcccttctcctgctccttgcacttctgtaggcacagctgctgttgctacctcaggaggctggggcagtagagctgaatggctgcctttctggggctgttagttgtgagtgtacccccacatgtggtatggcctccatgcatggactgtcccatgaaagatgggtgtcctcaccctgtgcagtgctgctgctactgagagtggcaagcctgggagctgcatgtctgagactgggtgtcaaccccttaccacgtcaccaccaacaccagtgtacaccactcaggaccaagagaatcatcctgctgctgctatctatcacctatataccatgcttctatcacccatataccatgcaaactgctcaggacccaagaatctgctcacctacctagatgaatgttgccactcaggccatctgagcaagctatctggaggctcaagaatcagtccatctgattccattaacattgatgacagtgtattctaccctggagcacaaaaacaggcatgtttacccactgctgccaccatgggggtctgaaaactggcctacctggcatccttgtttgccgcaaaattttaccatagcctccactaataactgcaccctgaacaacctgaggaaataacagataccactcaggctgtcacagctgaaaaatcattcagggattacactgtctcatgcacccagaataaaagctaaaaggtcttacccaaccaacactattaatatattttcaggaaaaagtacccacctacaaaagaaaatttgaaaaaaaaattaaaaagcaagaaaatgtgacacctacaaaaggacataataattccagcaacagatcacaatataaaagaaattcatgaaattccaaaaaaagaattcaaaattatgatacaaaagctcagtgaaataaaaaagaattctgaaaaacaatatgaggaaatcagaaaaagaatccaagatatgaatgataaatttaccaaagagatagatatcataacaaagaaccaagcagaaattctagaataaagaactccgtgaatgaaatacaaaatatatttgaaagcttcaaagacaggctagatgaagcagaagaatatcagaacttaaagacatgtctcttgaaataacccagtctgaaaacaataaagagaaaaagaattttaaaagtataaaaagtataagtcagacaacaatcaaaaaaaataattttaaaaatataaatagggggccaaatggcttactataaacagctgccattacaggttcccaccaagaagaaccaaaatagcatgtgaatcctgcactggcaactgaggtatccatgttctatcatcaggactgactagtaggttgacatgacccatggagagcaaagaaaagaggggtgatgcgatggctcacctgagagccacacctggcaaggggagccgcaacccccagccaagggaggcagtgagtgattgtgctacccagcttggtaaaccatgctttttcaatggatctgtgcaacccgtggatagggagatcatactcatgaacccatcccaccagggattctgtcccaaccacagagtcacacagattctcaatagccacttggctggagactgcctaagactactgagctcccaggggaaggggaggccatcatcactgctgctgcctgctgccttagaaaactgagcaccccaggcaagggacggcagccatcactgcagctgcctgctgcctaagatgactgaactgctggcggtgggggtagggcagcagccacccctgcagcttcagtccgctgtttttcccctgcaatgccagggagactgaatggtttggacttaagaggtattccccacaggatagcacactggctgtggcagattgtagacatactgcgtctttaggccaaactctgccccgtgcctcctgggcaggccatccctccaggaacttcagcaactccagccagaggcttagggacagaactctgatctctatggacctgagccctagggagtggggtggatgtggtctctgaggaccaacagacttagtctttccccctgctagttctgaggaatccaggcagcccagaccagtgggtttcccccaagtgcagaacaccccctccacaaagggacagccagagtgctttgttaagtgggtcccagatcctgtgcccctgacgggtgagataccccaacaggagtcaccagacactttatacaggagcattcctgctgacatcaggttggtgctcctcaaagacctcagaggaagaagcagccaccacctttgctgttcttcagcctcttcaagtgacatctacaggtgcgggagggacccaggtgaatagggcctgaagtgaaccatcagcaaatcacagcagccctacaaaagagtagcctgactgttaaaaggaaaacaaacacacagaaagctacaacaacagcattaacaaaaatgtccccacaaaaaccccatccgaagatcagcagcctcaaagaccaagacaatggggaaaatgtctccagcacatatcaaagttcttcatggcagccactctcgtcacaggcctggaagactaggaggaaaaagtggttttgtgggttgggcccagggtccccatgctatgtgcagcctagggacttggtgccctgtgtcccagccactccagtcatggctgaaaggggccaatctagagctcaggctgtggcttcagagagtgcaagcctcaagccttggcagtgtccacttgatattgagcttgccagtaaacagaagtcaagaattggggtttgggaacctccttctatatttcagaagatgtatggaaatgcctggatgtccaggcagaatttgctggaggggtggggctctggtggagaactactgctattgcagtgcagaagggaaatgtggggtcagagcccctacacagagtccatactggggcacctcctggtggagctgtgagaagagggccaccatcctccagacccgagaatggtagagccactgacagcttgcactgtgcatctggaaaagatgtggacactcaatgccagtctgtgaaagcagccagaagggaggctgtaccctgcaaagccacagggacagagctatcccagaccatgggaatccacctcttgcatcggcatcatctggatttgagacatggaatcaagtagatcactttggaactttaagatttgagtgccctgctggattttttacttgcatggggctgtaactctttagttctggccaacttctcccatttggaatggctgtatttacccaatgcctgtacccctattgtatctaggaagtaactaacctgcctgtgattttacaggctcatagatggaagggacttgccttatctaggatgagactttggactgtggacttttgagttaatgctgaaatgagttaaaactttgggggactgttgggaagacatgattggttttgaaatgtgagtacatgagatttggaaggggacaggggaggaatgatatggtttggctgtgtccccacccagatctcatcttgaattcccacatgttgtgggaggaccgggtgggaggtaattgaatcatggggacaagtctttcccatgctatactcacgatagtgaataagtctcgtgatctgatggctttaaaaatgggagtctccctgcacaactctctcatcacttgctgtcatctacataagatatgacttgcccctccttgccttctgccatgattgtgggacctcctcagccatgtagaactgtaagtccaataaacttctttcttttgtaagttgcccagtctcatgtatatctttattagcagtgtgaaaacagactaatacaaatcacctctatgcaaataaactagaaaatttagaagaaatggataaattcctgtacacatacatcctttcaagactaaaccacaaaaaagtcaaatttttgaatagaccaataacaa

SEQ ID NO: 1260 - DNA, 6396 bp, Homo sapiens
aataggaaaagtgagagtggaagaaagaaaaagccagcatagaatgtgttaatgagtggattgttgggactcacttctgctgagtatcctctgacaaactgtgatgaatatgcttctggatagtactactgagagatgggcatttttttctccacaattgcaggtgaagacacaagcaagccaaggaaatattgagtgctttatccattgtgttggctaccgtctacctcttgcactgctcagatatgcttacatccaatacagattctgtcaggcctctgagcccaagccaagccatcacatcccctatgacttgcatgtatacacccagatggcctgaagtaactgaagaatcacaaaagaagtgaatatgtcctgccccaccttaactgatgacattccaccacaaaagaagtgtaaatggctgatccttgccttaagtgatgacattaccgtgcgaaagtccttttcctggctcatcctggctcaaaaagcacccccactgagcaccttgcaacccccactcctgcccgccagagaaaaaaccccctttgactgtaattttcctttacctacccaaatcctataaaacagccccacccttatctctctttgctgactctcttttcagactcagccagcctgcacccaggtgaaataaacagccatgttgctcacgcaaagcctgtttggtggtctcttcaaacagacgtgcatgaaatttggtgccctgactcggatcgggggacctcccttgggagatcaatcccctgtacttctgttctttgctccatgagaaagatccacctatgacctcaggtcctcagaccaaccagcccaaggaacatctcaccaattttaaatcagtttttcaagtggtacctgagattcagcacttctaaaaagctccaaggtgatgaaggtgctgctagttggaggccatactttgagttgccagatgctaaaaattcaacagatgggagtaggatttaatggcatcaagattacagcaagagtgtcgtcaatgtctgagagaaaaggcacaggacaattcatgtaatctactttttacctcctcactatgccagcagcacacttggagaggaatgttataatggaagaagctgcccagtcactgattaaaatatgaacataacaggaaatgttaaaagaagttcctccctgaagatgaagaaaaatgaagccagatggaaaattgaatttacacaaggaatgacagtgtctagaatggtaaatatgtgcatgaatataaaacactttgaaattttaatttttagtacctttgaaatataattaagtaaaatgaattattttgaggtctataaccctgatgtaagtaaaatgtataacaacaaagcacaaaaatcagttcggaggaaataaaattaaatgttgcaaggtcctttgatgatacatgaagcagagtaatattatttgaaggtagactggaaaaagcagaagtatggccactagcagtgaatagcattaaaatttcatcagataatttaagtgcataaaaatattatatttttatataatattgtatataataaatattaaagatgagtgactagggacattgaatacccaccctgtccaaaaggaagaatcaaaattatgaatagataattgtacctggaacagaacatctaggagcgaacactagagtccaacagaaaagccacaagaaatacctggggcatagaagaagaaagtgagtggtcagctcagtcgagatcgggatcaactgggagcccaggggtgctcagtgttgtaaggaaaaggtaagggagagaacttcagcagtccacatctccagcatggactgctgcaatcctaaccatgggagaagtcctgta[450 bp omitted]gctcagccttgcaaacagagtgatatcccttcccactggcagagtggcttctacgcttggaccgacacatggaaaatggaatcccttctcctgctccttgcacttctgtaggcacagctgctgttgctacctcaggaggctggggcagtagagctgaatggctgcctttctggggctgttagttgtgagtgtacccccacatgtggtatggcctccatgcatggactgtcccatgaaagatgggtgtcctcaccctgtgcagtgctgctgctactgagagtggcaagcctgggagctgcatgtctgagactgggtgtcaaccccttaccacgtcaccaccaacaccagtgtacaccactcaggaccaagagaatcatcctgctgctgctatctatcacctatataccatgcttctatcacccatataccatgcaaactgctcaggacccaagaatctgctcacctacctagatgaatgttgccactcaggccatctgagcaagctatctggaggctcaagaatcagtccatctgattccattaacattgatgacagtgtattctaccctggagcacaaaaacaggcatgtttacccactgctgccaccatgggggtctgaaaactggcctacctggcatccttgtttgccgcaaaattttaccatagcctccactaataactgcaccctgaacaacctgaggaaataacagataccactcaggctgtcacagctgaaaaatcattcagggattacactgtctcatgcacccagaataaaagctaaaaggtcttacccaaccaacactattaatatattttcaggaaaaagtacccacctacaaaagaaaatttgaaaaaaaaattaaaaagcaagaaaatgtgacacctacaaaaggacataataattccagcaacagatcacaatataaaagaaattcatgaaattccaaaaaaagaattcaaaattatgatacaaaagctcagtgaaataaaaaagaattctgaaaaacaatatgaggaaatcagaaaaagaatccaagatatgaatgataaatttaccaaagagatagatatcataacaaagaaccaagcagaaattctagaataaagaactccgtgaatgaaatacaaaatatatttgaaagcttcaaagacaggctagatgaagcagaagaatatcagaacttaaagacatgtctcttgaaataacccagtctgaaaacaataaagagaaaaagaattttaaaagtataaaaagtataagtcagacaacaatcaaaaaaaataattttaaaaatataaatagggggccaaatggcttactataaacagctgccattacaggttcccaccaagaagaaccaaaatagcatgtgaatcctgcactggcaactgaggtatccatgttctatcatcaggactgactagtaggttgacatgacccatggagagcaaagaaaagaggggtgatgcgatggctcacctgagagccacacctggcaaggggagccgcaacccccagccaagggaggcagtgagtgattgtgctacccagcttggtaaaccatgctttttcaatggatctgtgcaacccgtggatagggagatcatactcatgaacccatcccaccagggattctgtcccaaccacagagtcacacagattctcaatagccacttggctggagactgcctaagactactgagctcccaggggaaggggaggccatcatcactgctgctgcctgctgccttagaaaactgagcaccccaggcaagggacggcagccatcactgcagctgcctgctgcctaagatgactgaactgctggcggtgggggtagggcagcagccacccctgcagcttcagtccgctgtttttcccctgcaatgccagggagactgaatggtttggacttaagaggtattccccacaggatagcacactggctgtggcagattgtagacatactgcgtctttaggccaaactctgccccgtgcctcctgggcaggccatccctccaggaacttcagcaactccagccagaggcttagggacagaactctgatctctatggacctgagccctagggagtggggtggatgtggtctctgaggaccaacagacttagtctttccccctgctagttctgaggaatccaggcagcccagaccagtgggtttcccccaagtgcagaacaccccctccacaaagggacagccagagtgctttgttaagtgggtcccagatcctgtgcccctgacgggtgagataccccaacaggagtcaccagacactttatacaggagcattcctgctgacatcaggttggtgctcctcaaagacctcagaggaagaagcagccaccacctttgctgttcttcagcctcttcaagtgacatctacaggtgcgggagggacccaggtgaatagggcctgaagtgaaccatcagcaaatcacagcagccctacaaaagagtagcctgactgttaaaaggaaaacaaacacacagaaagctacaacaacagcattaacaaaaatgtccccacaaaaaccccatccgaagatcagcagcctcaaagaccaagacaatggggaaaatgtctccagcacatatcaaagttcttcatggcagccactctcgtcacaggcctggaagactaggaggaaaaagtggttttgtgggttgggcccagggtccccatgctatgtgcagcctagggacttggtgccctgtgtcccagccactccagtcatggctgaaaggggccaatctagagctcaggctgtggcttcagagagtgcaagcctcaagccttggcagtgtccacttgatattgagcttgccagtaaacagaagtcaagaattggggtttgggaacctccttctatatttcagaagatgtatggaaatgcctggatgtccaggcagaatttgctggaggggtggggctctggtggagaactactgctattgcagtgcagaagggaaatgtggggtcagagcccctacacagagtccatactggggcacctcctggtggagctgtgagaagagggccaccatcctccagacccgagaatggtagagccactgacagcttgcactgtgcatctggaaaagatgtggacactcaatgccagtctgtgaaagcagccagaagggaggctgtaccctgcaaagccacagggacagagctatcccagaccatgggaatccacctcttgcatcggcatcatctggatttgagacatggaatcaagtagatcactttggaactttaagatttgagtgccctgctggattttttacttgcatggggctgtaactctttagttctggccaacttctcccatttggaatggctgtatttacccaatgcctgtacccctattgtatctaggaagtaactaacctgcctgtgattttacaggctcatagatggaagggacttgccttatctaggatgagactttggactgtggacttttgagttaatgctgaaatgagttaaaactttgggggactgttgggaagacatgattggttttgaaatgtgagtacatgagatttggaaggggacaggggaggaatgatatggtttggctgtgtccccacccagatctcatcttgaattcccacatgttgtgggaggaccgggtgggaggtaattgaatcatggggacaagtctttcccatgctatactcacgatagtgaataagtctcgtgatctgatggctttaaaaatgggagtctccctgcacaactctctcatcacttgctgtcatctacataagatatgacttgcccctccttgccttctgccatgattgtgggacctcctcagccatgtagaactgtaagtccaataaacttctttcttttgtaagttgcccagtctcatgtatatctttattagcagtgtgaaaacagactaatacaaatcacctctatgcaaataaactagaaaatttagaagaaatggataaattcctgtacacatacatcctttcaagactaaaccacaaaaaagtcaaatttttgaatagaccaataacaa

SEQ ID NO: 1261 - DNA, 567 bp, Homo sapiens
aaaacagtctgcataggtgaagtgaccccatgttagcagtaagtaaacactatggggttgggaagaaagctccccaggagacaacgattctgcatctcttggctgctgtagaaagttcttcaagaaacaggcaatgggggcctgatctagaagtcttcccagaagagctaccctgaccatgcctgctgtggctcattcacattacacaattcaaagttggcaaacgtggtgactaagcaagcaaaaagcttggctaaaaactcacatattcaaatcgatccttgcagagctgaaccatcaggtgcagaaagacaagtccggcaaaccagaggcaccacatgaccacctcttccactgtctggacattcagcacaccaaagatgaaaatgaacttgtagaaaataaaattccaaaatttgtctttgagatgctaaaaaagaaaaatgtttatgaaggtgagtaccatcacacctaccccatttgagggaagttaccataacaaaagccggcttctatggaagatatattctgcacttggctttctaatacttgtcctcaagaaaacag

SEQ ID NO: 1262 - DNA, 567 bp, Homo sapiens; identical to SEQ ID NO: 1261

SEQ ID NO: 1263 - DNA, 816 bp, Homo sapiens
cagagttctgctatacacaaatacgcatgtttcaatgggtacttccagggaccgcatggagatcccttaagttgaaactggacaaacagaacagtggatggttctagctgagatctgggatagtttctgaattcagaagtgttcaccagccacattgcatgtattagctggaaccatatatgaaactacgatactcagctgtttctaacctacaaacacagtgattacatatggctcaacttaatgtatatgaagcctagaatgtcagaactgatagagccttagagactttcaagtctatttcattatgttgaagaggaaaacggatgagggagagaagtgtccagcctaagatcatacatcaccttaagtggtagaatcagggctgcttctcttcctactggaccatgtacctgtctctcatactctgcttcttttaatataataataatttaggtgcgatatcagtcttttttgtttttgtttttgtttttttttgagacagagccttgctctgtcacccagaattgtatgaccttcaggcctggatccactcctgtgtagcacagagttttgaaaagcactaggcaaggagaccagagttcctgggttccaatcatggcactatgcaggcccaaatgggcagcacagcacttgccctgctttcttcacgggagcgggggcagggtggtggtggtaaatcatatctgtgatatgggatagtcatcactgcttctcatggctgaagataacacataaaaaatgtgtccccagagcatcttcctgtctcatttccctctgctacaacttcttctc

SEQ ID NO: 1264 - DNA, 816 bp, Homo sapiens; identical to SEQ ID NO: 1263

SEQ ID NO: 1265 - DNA, 816 bp, Homo sapiens; identical to SEQ ID NO: 1263

SEQ ID NO: 1266 - DNA, 816 bp, Homo sapiens; identical to SEQ ID NO: 1263

SEQ ID NO: 1267 - DNA, 1201 bp, Homo sapiens
ctttataaggttttttaaaaatattttattactttctgacattacaagatgctgcaggcccttcttgttcattccctgccccagacctagaataagccatttctccacgtaactctggtttattttattggggaatggtattagaagccaagatcttggtgctatgtgtgttcattgctgctaaagtgtcattacttccttgacctctcagctgacagagcaaggaaataagtgtgtataaactaattcatgcatacacagatatctataaatatttatgtatgtaatcatccatacttttattaagctaatattgagtgcatacggatgtctaatctagcattctcccttacttatctgtgaactttgaatccaacagtaagaaatctgactcccattatcagccataagaatttattaactcttcaattgcagtatacatatgtagcactgtcagagttattaattgtattcatgtggaaagcaagtttttctgttaagtttttctgttagagcagaatgtttttgtgtgttttattttgtctttcattttataaactccaatcatttccagagctacttagctcagcatcttttttttccacgctcttaagttgttttatacatttttgatacagttagattgtttttgtcacattcttcattctatcctgggatcccccaaccacctaagtggattttttgataatttgcatgcttttaggataactcttcattctgtaaagtgctatgggttttggcaaatgcagagtcatgtatccaagattacaatatcgcacagaagagtttcatcactatataaaactcaccagtcttcctcctattcaaccatctccatgccttcttcccagccctaactccttaaaaccactcatatctttactattgctatagtattgcctcttccaccatgtcatataaatggaaacatacagtattagtcttctcaaactagtttcttttacctaacaacatgcatttaagattcatagtgtcttttaatgacttgatagattatttctttgtagctgaataatattgcatcttatagatgtaaccgtttgtatatccatattttctcacagcctatgacttgtcttttgattctctgaacagtgccattcacaaagcagaagttttaatttttataaagtctaatgtatcaactttttctttcata

SEQ ID NO: 1268 - DNA, 494 bp, Homo sapiens
tctcttgctctgtcacccaggctggagtggcagtgttgcaatctcggctcactgcaacctctgcctcccaggttcaagtaactgggactacaggtgtgcgtcaccatgcctgggtaattttaaatttttgatagagacagggtctcgctatgtttcccaggctgtattactgtctttgattacataggtcagtgacaacagggaactaggtctcacagtgacctgctatggacttcagagattccttggcaaggcattgtcgaaaatataaggttcatgttgaagttgtcataaaatttttatgtagctgtataaatgtggacagcagatataaaaataaggaataccttagacttctgtaagccagatataagtacctacctaagatgctagaaatgatattctaatttaaattttttttttaatttttagagatggggtcttgctatgttgcccaggctggagtagagtggctattcacaggcataattata

SEQ ID NO: 1269 - DNA, 494 bp, Homo sapiens; identical to SEQ ID NO: 1268

SEQ ID NO: 1270 - DNA, 494 bp, Homo sapiens; identical to SEQ ID NO: 1268

SEQ ID NO: 1271 - DNA, 494 bp, Homo sapiens; identical to SEQ ID NO: 1268

SEQ ID NO: 1272 - DNA, 1214 bp, Homo sapiens
gtaatgtctaggttttcttctagggtttttatggttctctctctcttttttttaagttagccttgctaaaggcttttcaattttgttaatgttctcagggaactagctctggtttcatgattttctctactgaatttctagtttctattttattgatttatgttctaattgttgttaattatattattctatatattttggatttaatttgcatttcttttaaatttccaaaggtggaagcttatattattgattttagatcttttcccctttctaatacatgcattaaatgttctgaatttcccagtaagcactgcttttgctgcataccacaatttttgatatgttgtttttatttttatttattttaaaatattttttaattcctcttgatatttcttcattgacctctgtgttatttagaagtgtgttgtttaatctccaagtatttgaggaattttctagctaatttacttctttagatctattgtgatctgagagcagacattggaagatttatgttctcttaaatttgttaaggtatattttatggtccagtatgtggtctatgttgatgaataatccatgtgagttgaggaagaatgtgtatttttctgttttagaataaagtagttgatagatatcagctatattcagttgattgatgatgttattgatttcagctatgtccttgcagattttctgcctgctatatttgtccatttctggtagagggtgttgaattctccaactgtaatagtggattaaactaacagactacagttagttttcatttcatgtgttttgctgctttgctaggcacatatgcattaaaaattgctatgtcttcttgcagaattggtccctttatcattatataatgttcctctttatccctgataattttctttgctctgaagtctcttctgtttgaaattaatacagatactcccactttctttaaagtagtgacaacatggtatgtacttttccatcatatacttttaaattctatatttaaagtggatttcatgtacacaacatatttatttctctataaagagatatataagtttctgctgtgggttcctgccctagtccatcatgattctttgcatgtgcctgtctgcaattaacgggacagtgatttgccctgtgacctcacttctttgatgcatctaaaaagagctgttgatttttcagttaagtttttt

SEQ ID NO: 1273 - DNA, 8390 bp, Homo sapiens
tctgactcatattttaaaatctctctttggttgctgtgtaaacaacagactggagagaggccaagagcacaagcagaaaaaccagccagggtgctatttcagcagtctaggtggagagtcatggtgacttggacccatccaacagagacgaagacaactaaatggattcaggatatattctagagataatacagaaaatcacctctatttcataatgagactactgagacaagttatgtggaaaactattctgcttagcaaaccccactttgatgctctctcttctgtagatctagagataacgagtcctaactctttgccaaggatatggcaaagactctgatggaaaaggcagtaatgtgtacacaaaggtgaacataaataaatgtgtgtatgataaacgctgggaatggacatagaaaaacgggtatgcaattggacagagacgacgggagacagaaggaaagatacttgctcagctgtatctaagtaagttcataggagtttcatggtctgaaaaatctgtgacagtggaatttctactaagaagcttaaaaaagtttcaccttctccttggacacttcagaataaggccttcttagaatataatgcattatatcacaaatatacttttatataaaatatttgggaccaaaacaagagtaaagaaccaggatccgaaagggtgaatgcctactaaatatctttgattatctaaagctgtttaaaagctattagattggcacctggaaccccaaaatatccacttttcactgggaaggagtggctgtgcctcttcaatcatcccctaaatgcaaagaagtttgacccccacgcaatggataaaagtcacccaaaaaatgaacaaaagaggtgtttggaaaaaccagaacaccattcatcccagctaacgacttgttcattatgagtgatgatggataaagacttctcatgctgagatgaaatcaagatttatatgcattgtttcctctcccaacttgtgggaagatcatcatcatttaattctatctctgcggccagtgatgggcatccagagagctggttatcaaacggcgcagtcagctggcaaaagccgaaacgtgcagttggcacatctggacggagccgccacagccgagggtgaacaatgactcctggcaagcatccaaattgcttgcagacgctagcaggtctcatctacaaccgcccctaccagcatctctctctctctctcttttttatgagaatcagattttcattgctccattcaattgctctcctctgccattttttacagctcttatcgttcccctggaatatggccttgagacagctcatccgtgtccttcactgtgttatctcttctaacttttattaaaacttcagctttcatctgaagatagctaattaaatctggaacagattatatgcctccccttaaaaagagcacaaaactattttcttcaaccccagcaatgctttttttcctttccaaaaggtaaaatcaaaggtgtttaagaagtctctttatttacagagctaagatattcaacacgtcatatatgagttgatttatattaaagttgtctgtgatatgacaaatctttgagctatttctcaagatgattatttctcaatcctggtatatatcctttaaatatcacagctaatactataagcatattttctatataaagttgggtaatgaggagttaagttattagtgcacatcaagtgatttgtctttttattcgtcttttttttttaaaggttgccctcatttgataaggatgaagagaaatttttcttttcttccccataccacaaatattagtaactaaaagttctcccatgggaaattatgtgaaaacatgaaattaatagcagtgattcaagtttaggactgattcggttttcaagacagctttatatcaactgatcatcagcacaagtagctctgtctgagtctaccacaaattattaatgaaggaacttccacaattgatatgaatacattcttctcacatatgccgctgacccagtccctttctgaggccgaggggcagtgtacaatcaccttttcttgcatagatcagctaaccaaaccttctagcaatgacatctgaaagaatctagccagccatcacacacacacaccccctatgcccttttaataagggttaagcttctactactgtgagaatatgatttaactatcccacctgaaactttctgggatccttttcttcgcttcactgccttcagtaagatttccttcatggtaacctttgtgttgtccacctgaataagggagaatccatgagcagcatttctgtaggaaaagacaaatattaaatcatcaccaacattcatccagagagatgttactgcaatcttcactgtgtttaagcaagttttttttgttgttgtttgttttgttttgtttttgaaatggagtctcgctctgtcacccaggctggagtgcagtggtgcaatctcggctcactgcaagatccgcctcctgggttcacaccattctcctgcctcagcctcccaagtagctgggactacaggcgcccgccactacatccggctaattttttgtatttttttttttttttagtagagacagggtttcaccatgttagccaggatggtctcgatctattgacctcgtgatctgcccgcctcggcctcccaaagtgctgggattacaggcatgagccaccgcgcccggccgtgtttaagcaagttttaaaaatacataaatccattgtggcacaatgtaatatgtatcaccatgctacacctgcggacgcttccgagcggctgccatgtctgtgcagtcaggaatgataagtgaaccacccgtgaatgttaacgatagtgatcattctgagaccacaaggcaatagcatataacagaaggaaaggcttcaagctaatgacaccctttaataaaggtctggtcacttggggtatactgtggatttatcatcaagaagaaaaagtttgctgagctagaagcggtggctgaagcctataatcccagcactttgggaagctgaggtcagcagatcacttgagtccaggagtttgagaccagcctgggcaacacagcaacactctatctctacaaaaaatacaaaaagtatttgggcatggtggtgcatgcctgtagtcccagctacttgggaggctgaggtgggacgattgctcgagcctgggaggcagaggttgcagtgagccaagatgatgtcactgcactccagcctgggtgacagagcaataccctatctcaaaaaaaaagtttgccaaccctaggataacgtggcgagatttggggggttatgtgttccagcagctagagttatttaacataactaacaaacttagtaaaagtcaaatggcattactgcaagctgcatacagaacttgtttgctgaacagagaaaaatggtgacagaattcagtgggcacaaagatctctatgaacagtcttgctggtctctgaaaaatctgtgctgtttggtgccaagtcacactatacacaagtatcagtcaggcagagcccacttatgtatagaccaagcaacagataaagtagagtgaccaatctggtttacctaggatggaggaaggggttggaggtgagcatcagggagtgctcatagattcaggactttcagttttgaaacagggagagtcctggacaaaccatcacaaactgatcatactaacagaaagcgtggtgggccaaacgtaaagtagagttttctaggttaggagcggtggctcatgcctgtaatcctaacactttgggaggccgaggcaggaggactgcttgagctcaggagttcaggaccagcctgggcaacacagtgagaccttgtctctactaaaaatagagttagttgggcatggtgacacatgcctgtagttccagctacttgggaggctgaggcaggagggtcctttgagcccaggagtttggggctgcagtgagccatgatcacatcactgcactccagactaggccacacagcaagacacttatcaaaaaaaaaaaaaaaaaaaaaaagcattttctagtaaagaacatttaaaatttatgtgtttgtgtggggggacacattataaatcaattggcccactaaaataatggacgagtagttaaaaatacactgtttaaaaggatgttaatcgtgatgtctcatatgaaaatcaaaagactcaagttgacaagtaaaacatttaacacccaattaaacccaacatcagcaatgtttaatttcagcaaaacatcatctgttacattaaagttgttaatttgtattttattaacgttataattttatctgtatttagtttgtaattttgtttaggttgtgtaaaaacactgaatttatagctaaacattacagaactttgtatttgcatgtatctaagtagcattattaaaaaactcatttggataaacattgagactttaggagaatttatttccctttaaaagagttctgtacataacttacatttaagaaactccctcatgacaattccatgagatagttactgttacccaaattttaaagatgaagaaactgagacttaacaaaggtaagtaaaattgtctaaggtcatgcatgtagcaagatactattgaagctgaaacatgaacccaggtttgcctaaattcaaagtctgtgctgccgcacttagagggaaagatggtactggagccccgggaatagccggtgtgagggcctctaaaggtcagaaggcgacatgggcttcctggtatttgaaaggcaggaacgggtgtaaaaaaggggaagaggtcttagaaagcaaggtgggacacactgctgggtcaggtgtcctcctggcagcccacagacacctgaagtttcagtcattccttctccatgaagccctgtgctgggtgctcaggatacagagagacaataagactgtgccttcctagtcttcaagaagttaatggtcttgctactaactcagaggatgtgtgctcataagaggactcatttgaaagtatgtagatcctcgatgtttacccactgcccatgttcactgaaagttattccaattcagctttttcagtccagctgagcaatgtccacctaaacactacccctcctctgctataaaacaaagtcggagaagaaaaatgtagaagtggcagagatctactcagtaacccattcaagaaatacgtgtgacagatctatcacagtaatggagtgatggtgagtattgtgggcacagataattcagttcttgctctccaagggttgtttattaatagtaacaataacagcagctaacactaagatgatgcgtacatatgctaaacactgttctaagtgcttcagatctattaactcatttaatcctcataactgatctgtgaggtaggtattattatctccatttcactgagccacagaaaagttaaatattcatccaggaccacacacactagtaagggcaaggctaggatcggcatccaagcgatctggctcacagcccaccatgctgtcacctactgcactatagcagtggctgaatgtcagccttaagacagtgagattcacaggttaaaccaacaccagattccccagcctcaatctttcagcagagggttggaaagggcatggactttaaagtcagggatggcgtcaaatccaggcctaagaacaatattgctcaccctcaggttccacgcctctaaattgttcataaaaactgggctattttgggattaagtgagatagcatatgcatagttggcccttagtaagtattagttcactccctatgtcaaacctacttgcctctttctgtttcagcttagtgtcttcccagccacttcttgtccctcctctactgggagacaaatggaaggaggaaaggggggaaatgacgaggaggagtagttacggctttatttattttgctgggatttccttctctgaaactttagacacatccctacagactcctgaaggtctgctctgttctgcatctgtaggagaagctttactaacttagaatatagaccagaaaggcgagtaagaggttgctgaaccaagaaaatacacacagggcaaacggtcagtaatctgtactatttcatcagacgactgagaaaaagaaaatttattgacacttttgttcttaatgctcacatataaagatttcactttacctcgtgttttcagaaacactccagacacatcaaataaactctcttgaattttaaaatagaaaaaggattgactgggctatgtgtgtgtctgggagtgggaacacagggatgggagtaattcaggatcaaaaaacagagtattaagtttaaagcagttgttactctctgccttccccctccttcctattctccagaaggcagggttcatagtgaaacactgtgtagtcttagatgcccctcctggaaaggcatatgaatcctagccccactccactctactgaaaactcagtgatttaaagcctcttgctttaaaaaaggacttctggttcaaaagactgctatgatcatgtgttaacattcatgtagaaaaagttctagtcatattaataatcaataaaaatgcaagtaaaaactatcgaaatgccactgtgtatatcttttagagtagaaaaaaaaacttctaataccttgtaatggtaaaactataaaaatgattttaggaattctgttggtaacattgtaaattaggacatctttcagagggctattgtcaataaaaagtgagtctaaagatgtttttactctgaccaataatcctacttacaaggcatgatcctaaggaagttgttcaacagaataaaaggtatatagataatgaccatcatcatcaaattacttattaaaaccacacaaggaagcaatctaaatattctgtgatcggcttccactacaacccatacacttttcttttatactgcttatcacattttaattatttgacaactgtctcactactagatagtaagctccatgagggtagtgctgtctctgcctagatctctggcacataaatacagactgtaggaattaagaacaaatactgaaacgtttataatttattatttttagatggagtctcactttgtcgcccaggctggagtgcaatggcgcgatctcagctaactgctacctccgcctcccgggttccagcgattctcctgcctcagactcccgagtagctgggattacaggtgcccaccactgcatccggttaatttttgtatttttagtagagacggggtttcaccatgttggccaagctggtttcgaactcttgaccctcctcggcctcccaaatcctggcctgcctcggtctcccaaagtgctgggattacaggcgtgagccactgcgcctgacctaatttaatgtcaagtaaaaataacacaaaaatatgtgtgctacaagtgaaactgagtaacatatacacacgattattatacaagattaaaaatagttaagatggaggcatcattggccaacttttcaattattttaaatatcctttaaagttattttagtacctctgaaatgaaaaagcaggaaaaaatttgctgttatttacaccaaacttgaccttgtagtagggatgaaacggccaccatgaaagcctgagggcccactccccagcttacccccaggtactcagttattctttctttgctcaagggtagaaagagccaaaatactcatatatcatatgtagcataaccctattttctgtaacaatctcaaacaaaggcagtatgttgagagagacagggaaatgtcttctaaagcaatcccttttgagcagtgaatttgctggttactaacagcagggggtgccaaagggatcgctattgttcccaggagacagccatgagaaggactgctgaggcctaggttgaaaaaaagcttaggtttgagagtaaaatccaaatgcagcaggttttcccttaacaactgggacatgtggataaaactcaggagctcataaacttgaatggataaaaactacattttaattttcactaacttctaatattttgcatttccttgatttataagtgtaggcaaacaatcacagcagaatcacagtgccagtgactctgtcatgaacagaagtcatagctaacactacagcacattacagctgttgcagatttctcaaataccatttatgctcatcaccgctttgaaacaacaggcttcaggagttactgttaggtatacagctggatattgtttaatctactagtaaagccacacatattactatatcatgaatttgttcaataatctgataactttaaataacagaatacttttatattccag

SEQ ID NO: 1274 - DNA, 4333 bp, Homo sapiens
cacagtggagcactgagtaattacgttgtgactggggctggcctggcttggctctttgcatctgctgttccctctgtctggaacactcctcccacgggaattttttcacggctggcttcttcccatacatcacctctcaacttggatgtcaacatcctgcacccctggatgaaacagcgcctctaccctctgtccacctgtcccggggcttggtacccctcacctgactctgaatgtgcctgcacagcatttgccaaaccgcatctgccacatggacacctggcctgcctgccccgagagaaggtaagctcggtgagggcggggaccacattgcagcgtcctctgtcgtgtccccaagtcttagagagagctgctacacagcagtgccgggacacgtgaatgcccagcatcactcctggagtgaacaaagacagtgacttccagatcttcccagcccatgggactccaaggtcctcagaggcatggctaccactcaggtccagtcctgtggccatgcctctggggtaggaggtgacacagagtctgtaccactcgctcctccctccacggctcacgtgaccagagcctccctgccggcatggcccacttttatccctgacaccctccacatggcagcaagaatcttcaccaagccaccttccaggtcaccacgggctcaatccccttcagatcttcttgggacagtgaccctggcagtgtctgcactgaggtctgcccttctcccaccaggatggcctggggaaaatgaccaataacccatcagattttgctccctagggggcttccctgcctggtcctggggagtctggggccgcccctgcagctgactgcccctggggccctgggcacccctctatttacaagtgaagggctggcccagatgtcgttcaaggctgtttgcagcctgaaaacactggctaagtttgaacttctcaggcctgaaagaagcaagaccaattccaatagtcactcccgtccttcgcacccatgaagagttacaagctgccgttcctttggggtgcattggacggccatgaaacctaatactgacggcccaccacccccgaaactcgagccccctggagggggctggggggggggtctgtgttctgatgtggagaaacacgcgtggagataccaatacacgctctgctgaacccaggggccatggaatctgcacctgagcagccagacctctgctggtgacggtgtctgaacttgcaggagcgtggaggttattcacactcattaaaatagctcgtcatcttcaaaacaaagccaggaggtggacacgttgtctacaagtttgccaacggcactgttgctgtttatttattctagaattgctgtttttcagtcccgttgagggccaccttttgggagaaggataaaacaaaccaccattttctggagatgtgagcttcaaacttggacccccacctcgggaccttctagttgctttcccaaggcagatatgccttctgcagaaacagctcatgtggagagccctgggggaccatcccctcactgccctgatgacctgtagcccccttcagttaaagttctcaaatgctcaggtgtccaggttcagatcagaaactggccagccagccctggggaactcacggaggaatgcagtctgtggatgcttccctgcaatgccagcctcacttacaaggcctccgctctcagggtgaagggcaagaagtgattcatatccaggcttctccaggagatggggggagggaccaggggatgggggagggacccggggatgagggagggtccaggggatggggtgatgggccagggggatggggggatgggcctgggggataggggatatggaccatgtgagtagtgggggacaggcctgtgcaggagagagttcaccctggcctaggcctctcctgagctccctgctccagcctttgcacgtgctctacagtgacacacctgacgtttgctaacagctgcctgtgggccccacctccacagctcagcaacccctctcattctgtgacagtcccacagcccccagcatacaaatgcagatcggaggcaaggagaagccgagcccctggccagggttgagaggagctcaggtgcaggcccaggatgcagactccagacatcctgctctgagctctggcaccacagcccagggggtgcgttcacgctaacgaagcctgcacctcctccatgtgctcttaggctgtctgtgattcatcagaatgtgcagaggagaaggcatgagagctcggcccacagtggacacagtggcgcagcctgccctgcagtgggaacgtgagcatggggggcacgggctgggcgtggtgaacaccccaagtgagcctggggtgatgcagttgggtggccgcatccaaccctgtgaagtgctgggtcctttgctgctgaccatacacagaactctttttcagactgagtttggtatcagtgtgagtgtgcaacacctgcgcatgtgtttcatgtagccgcacgtgtgtactgtgtggaatgtgcgtacgtgtaaatgtgtggtgtgtgtgtgtggtgtgtatatgtgtgtagtgtgtgtggcatgtagtgtgtgcagtgtatgtggtatgtccatgcgattcatgtatgtggtataaaatgtactgtgtgtggtgtatatggtgtgtggggcatgtgtgacatgctccgtgtgtgtggtgtgtggggcatgtgtgtgggtgtgtgcagcatgcactgtgtatgtggtgtgtgtggtgtgtatggggcatgtgtgtgggtgtgtgcagcatgcactgtgtatatggtgtgtgtggtgtgtatggggcatgtgtgtgtgtggtgtgtgatgtgcactgtgtgtatggtgtgtgtgtggtgtgtacggggtgtgtgtgtgtggtgtgtgacgtgcactgtgtgtatggtgtgtgtggtgtgcatggggcgtgtgtgtgtgtgtgtgtgtggtgtgtgtggcatgcactatgtgtgtggtgttacaaggcagtgtgtgtgcggtgtgcactgtgtgtgtggtgtgtgtggggcgtgtgtgtgtgtgtggtattgatatggtttggctgtgtccccacccaaatctcatcttacattgtatatcccagaattctcacgtgttgtgggaggaacccagggggaggcaattgaatcaccggggccagtctttcccgtgctattctcgtgatagtgaataagtctcacaagatctgatgggtttatcaggggttttcattttgcttcttcctcattttcttttgctgctgtaatgtaagaaacgccttttgcctcctgccataattctgaggcctcacagccatgtggaacttcttcaggagagaattaacatccaatggattcccagaaaacttttccctcgatgtaccagcaaacacctacaatgccctgaaaagccgcctctgcgaccccaatgcagatcacacgtcctgtcccagcccctgcagcctccacgcggcgggtgcactgccaggcacgggaaggcagcgctggcgagtagaactggcccatctcgcagataggaagctgagcctcagggacgtttcacgccttcgtcaaggtggtgagaggaggagcgggattgccgtgaaggtggtgagaggaggagcggggtttgctgcccgacttcagggatctgtcaccctcgtccagcagggttggttcttcccgaggctgggaggatgccaagcctggtggaggatgggggcggtggtgtggtgtggggagcttctgacttgcacatcctgagggaaccttctgcagctgatgtgtgaactggaccccaggccgtgcctccgaggaatccccaaggctatggcccctcaggtcctgctggggtgttggcccccacctctgcctcagaatgcaggggttctgcagggaagccgcagaccagcctgctgccttgggccctagggacactgcagccccagaaagtactgtgggggacaaaagagttgtttctcgggggagaaaacacctgtgaggaaatgcaggtgccacagagggaaatcctcctggggaggagggtacctgttccatcctcggccgacacgggactgcctggtgcctggtacccacagccgctacctgccgcacgcatctctccatggtttgctaattacttccattagttttaaacaaacttgacaagagacagaagggtccagagagaaattaaatctaactgtttaaacatgtagtcggagcctcccttgcctctgtccccctggcggtggttgctgcagaccccaaagccagtgctggaggtggcacagag

SEQ ID NO: 1275 - DNA, 7804 bp, Homo sapiens
tctttaccttgtttatgatgcagagacatttgttcacatgttttcctgctggccctctccccactattaccctattgtcctgccacatccccctctccgagatggtagagataatgatcaataaatactgagggaactcagagaccggtgcggcgcgggtcctccatatgctgagcgccggtcccctgggcccacttttctttctctatactttgtctctgttgtctttcttttctcaagtctctcgttccacctgaggagaaatgcccacagctgtggaggcgcaggccactccatctggtgcccaacgtggatgcttttctctagggtgaagggactctcgagtgtggtcattgaggacaagtcaacgagagattcccgagtacgtctacagtgagccttgtgggtgaaggtactctacagtgtggtcattgaggacaagttgacgagagagtcccaagtacgtccacggtcagccttgcggtaagcttgtgtgcttagaggaacccagggtaacgatggggcaaactgaaagtaaatatgcctcttatctcagctttattaaaattcttttaagaagagggggagttagagcttctacagaaaatctaattacgctatttcaaacaatagaacaattctgcccatggtttccagaacagggaactttagatctaaaagattgggaaaaaattggcaaagaattaaaacaagcaaatagggaaggtaaaatcatcccacttacagtatggaatgattgggccattattaaagcaactttagaaccatttcaaacaggagaagatattgtttcagtttctgatgcccctaaaagctgtgtaacagattgtgaagaagaggcagggacagaatcccagcaaggaacggaaagttcacattgtaaatatgtagcagagtctgtaatggctcagtcaacgcaaaatgttgactacagtcaattacaggagataatataccctgaatcatcaaaattgggggaaggaggtccagaatcattggggccatcagagcctaaaccacgatcgccatcaactcctcctcccgtggttcagatgcctgtaacattacaacctcaaacgcaggttagacaagcacaaaccccaagagaaaatcaagtagaaagggacagagtctctatcccggcaatgccaactcagatacagtatccacaatatcagccggtagaaaataagacccaaccgctggtagtttatcaataccggctgccaaccgagcttcagtatcggcctccttcagaggttcaatacagacctcaagcggtgtgtcctgtgccaaatagcacggcaccataccagcaacccacagcgatggcgtctaattcaccagcaacacaggacgcggcgctgtatcctcagccgcccactgtgagacttaatcctacagcatcacgtagtggacagggtggtgcactgcatgcagtcattgatgaagccagaaaacagggcgatcttgaggcatggcggttcctggtaattttacaactggtacaggccggggaagagactcaagtaggagcgcctgcccgagctgagactagatgtgaacctttcaccatgaaaatgttaaaagatataaaggaaggagttaaacaatatggatccaactccccttatataagaacattattagattccattgctcatggaaatagacttactccttatgactgggaaattttggccaaatcttccctttcatcctctcagtatctacagtttaaaacctggtggattgatggagtacaagaacaggtacgaaaaaatcaggctactaagcccactgttaatatagacgcagaccaattgttaggaacaggtccaaattggagcaccattaaccaacaatcagtgatgcagaatgaggctattgaacaagtaagggctatttgcctcagggcctggggaaaaattcaggacccaggaacagctttccctattaattcaattagacaaggctctaaagagccatatcctgactttgtggcaagattacaagatgctgctcaaaagtctattacagatgacaatgcccgaaaagttattgtagaattaatggcctatgaaaatgcaaatccagaatgtcagtcggccataaagccattaaaaggaaaagttccagcaggagttgatgtaattacagaatatgtgaaggcttgtgatgggattggaggagctatgcataaggcaatgctaatggctcaagcaatgagggggctcactctaggaggacaagttagaacatttgggaaaaaatgttataattgtggtcaaatcggtcatctgaaaaggagttgcccaggcttaaataaacagaatataataaatcaagctattaacagcaaaaaataaaaagccatctggcctgtgtccaaaatgtggaaaagcaaaacattgggccaatcaatgtcattctaaatttgataaagatgggcaaccattgtctggaaacaggaagaggggccagcctcaggccccccaacaaactggggcattcccagttaaactgtttgttcctcagggttttcaaggacaacaacccctacagaaaataccaccacttcagggagtcagccaattacaacaatccaacagctgtcccgcgccacagcaggcagcaccgcagtagatttatgttccacccaaatggtctttttactccctggaaagcccccacaaaagattcctagaggggtatatggcccgctgccagaagggagggtaggcctttgagggagatcaagtctaaatttgaagggagtccaaattcatactggggtaatttattcagattataaagggggaattcagttagtgatcagctccactgttccccggagtgccaatccaggtgatagaattgctcaattactgcttttgccttatgttaaaattggggaaaacaaaaaggaaagaacaggagggtttggaagtaccaaccctgcaggaaaagctgcttattgggctaatcaggtctcagaggatagacccgtgtgtacagtcactattcagggaaagagtttgaaggattagtggatacccaggctgatgtttctgtcatcggcataggtactgcctcagaagtgtatcaaagtgccatgattttacattgtccaggatctgataatcaagaaagtacggttcagcctgtgatcacttcattccaatcaatttatggggccgagacttgttacaacaatggcatgcagagattactatcccagcctccctatacagccccaggaataaaaaaatcatgactaaaatgggatagctccctaaaaagggactaggaaagaagtcccaattgaggctgaaaaaaatcaaaaaagaaaaggaatagggcatcctttttaggagcggtcactgtagagcctccaaaacccattccattaacttgggggaaaaaaaaacaactgtatggtaaatcagcagcgcttccaaaacaaaaactggaggctttacatttattagcaaagaaacaattagaaaaaggacattgagccttcattttcgccttggaattctgtttgtaattcagaaaaaatccggcagatggcgtataatgccgtaattcaacccatgggggctctcccaccccggttgccctctccagccatggtcccctttaattataattgatctgaaggattgcttttttaccattcctctggcaaaacaggattttgaaaaatttgcttttaccacaccagcctaaataataaagaaccagccaccaggtttcagtggaaagtattgcctcagggaatgcttaatagttcaactatttgtcagctcaagctctgcaaccagttagagacaagttttcagactgttacatcgttcactatgttgatattttgtgtgctgcagaaacgagagacaaattaattgaccgttacacatttctgcagacagaggttgccaacgcgggactgacaataacatctgataagattcaaacctctactcctttccgttacttgggaatgcaggtagaggaaaggaaaattaaaccacaaaaaatagaaataagaaaagacacattaaaagcattaaatgagtttcaaaagttgctaggagatactaattggatttggagatattaattggatttggccaactctaggcattcctacttatgccatgtcaaatttgttctctttcttaagaggggactcggaattaaatagtgaaagaacgttaactccagaggcaactaaagaaattaaattaattgaagaaaaaattcggtcagcacaagtaaatagaatagatcacttggccccactccaaattttgatttttgctactgcacattccctaacaggcatcattgttcaaaatacagatcttgtggagtggtccttccttcctcacagtacaattaagacttttacattgtacttggatcaaatggctacattaattggtcagggaagattatgaataataacattgtgtggaaatgacccagataaaatcactgttcctttcaacaagcaacaggttagacaagcctttatcaattctggtgcatggcagattggtcttgccgattttgtgggaattattgacaatcgttaccccaaaacaaaaatcttccagtttttaaaattgactacttggattttacctaaagttaccaaacataagcctttaaaaaatgctctggcagtgtttactgatggttccagcaatggaaaagtggcttacaccgggccaaaagaatgagtcatcaaaactcagtatcacttgactcaaagagcagagttggttgccgtcattacagtgttaacaagattttaatcagtctattaacattgtatcagattctgcatatgtagtacaggctacaaaggatattgagagagccctaatcaaatacattatggatgatcagttaaacccgctgtttaatttgttacaacaaaatgtaagaaaaagaaatttcccattttatattactcatattcgagcacacactaatttaccagggcctttaactaaagcaaatgaacaagctgacttgctagtatcatctgcattcatggaagcacaagaacttcatgccttgactcatgtaaatgcaataggattaaaaaataaatttgatatcacatggaaacagacaaaaaatattgtacaacattgcacccagtgtcagattctacacctggccactcaggaggcaagagttaatcccagaggtctatgtcctaatgtgttatggcaaatggatgtcatgcacgtaccttcatttggaaaattgtcatttgtccatgtgacagttgatacttattcacatttcatatgggcaacctgccagacaggagaaagtacttcccatgttaaaagacatttattatcttgttttcctgtcatgggagttccagaaaaagttaaaacagacaatgggccaggttactgtagtaaagcagttcaaaaattcttaaatcagtggaaaattacacatacaataggaattctctataattcccaaggacaggccataattgaaagaactaatagaacactcaaagctcaattggttaaacaaaaaaaaggaaaagacaggagtataacactccccagatgcaacttaatctagcactctatactttaaatgttttaaacatttatagaaatcagaccactacctctgcagaacaacatcttactggtaaaaggaacagcccacatgaaggaaaactgatttggtggaaagataataaaaataaaacatgggaaatggggaaggtgataacgtgggggagaggttttgcttgtgtttcaccaggagaaaatcagcttcctgtttggatacccactagacatttaaagttctacaatgaactcactggagatgcaaagaaaagtgtggagatggagacaccccaatcgactcgccagtctacaggtgtatccagcagctccaaagagacagcaaccagcaagaatgggccatagtgacgatggtggttttgtcaaaaagaaaagggggggatatgtaaggaaaagagagatcagactttcactgtgtctatgtagaaaaggaagacataagaaactccattttgatctgtactaagaaaaattgttttgccttgagatgctgttaatctgtaactttagccccaaccctgtgctcacggaaacatgtgctgtaaggtttaagggatctagggctgtgcaggatgtaccttgttaacaatatgtttgcaggcagtatgtttggtaaaagtcatcgccattctccattctcgattaaccaggggctcaatgcactgtggaaagccacaggaacctctgcccaagaaagcctggctgttgtgggaagtcagggaccccgaatggagggaccagctggtgctgcatcaggaaacataaattgtgaagatttcttggacatttatcagtttccaaaattaatacttttataatttcttacacctgtcttactttaatctcttaatcctgttatctttgtaagctgaggatatacgtcacctcaggaccactattgtacaaattgattgtaaaacatgttcacatgtgtttgaacaatatgaaatcagtgcaccttgaaaatgaacagaataacagtgattttagggaacaaaggaagacaaccataaggtctgactgcctgaggggtcgggcaaaaagccatatttttcttcttgcagagagcctataaatggacgtgcaagtaggagagatattgctaaattcttttcctagcaaggaatataatactaagaccctagggaaagaattgcattcctggggggaggtctataaacggccgctctgggagtgtctgtcctatgtggttgagataaggactgagatacgccctggtctcctgcagtaccctcaggcttactaggattgggaaaccccagtcctggtaaatttgaggtcaggccggttctttgctctgaaccctgttttctgttaagatgtttatcaagacaatacatgcaccgctgaacatagacccttatcaggagtttctgattttgctctggtcctgtttcttcagaagcatgtcatctttgctctgccttctgccctttgaagcatgtgatctttgtgacctactccctgttcatacacccctccccttttaaaatccctaataaaaacttgctggttttgtggctcaggggggcatcatggacctaccaatacgtgatgtcacccccggtggcccagctgtaaaattcctttctttatactcttatttctcagaccagctgacacttagggaaaatagaaagaacctatgttgaaatattggaggcgggttcccccgatacctgggtattgtccaaggtttcctttgctgaggaggattagtaaaaggaatgcctccatctcctgcatgtccctgggaacagaatgttcccaccaaccaccctgtggctggaggcgggatatgctggcagcaatgctgctctattactctttgctacactgagatgtttgggtggagagaagcataaatctggcctatgtgcacatctgggcacagcaccttcctttgaacttatttgtgacacagattcctttgctcacgttttcctgttgactttctcaccactcaccctattctcctgtggcattcgccttgcggagatagtgaaaatagtaataaatactgagggaactcagactgagggaactcagactgggcagaccggggccagtgtgggtcctccatatgctgagcgccggttccctgggcccactgttctttc

SEQ ID NO: 1276 - DNA, 7804 bp, Homo sapiens; identical to SEQ ID NO: 1275

SEQ ID NO: 1277 - DNA, 7781 bp, Homo sapiens
tctttaccttgtttatgatgcagagacatttgttcacatgttttcctgctggccctctccccactattaccctattgtcctgccacatccccctctccgagatggtagagataatgatcaataaatactgagggaactcagagaccggtgcggcgcgggtcctccatatgctgagcgccggtcccctgggcccacttttctttctctatactttgtctctgttgtctttcttttctcaagtctctcgttccacctgaggagaaatgcccacagctgtggaggcgcaggccactccatctggtgcccaacgtggatgcttttctctagggtgaagggactctcgagtgtggtcattgaggacaagtcaacgagagattcccgaggtgaaggtactctacagtgtggtcattgaggacaagttgacgagagagtcccaagtacgtccacggtcagccttgcggtaagcttgtgtgcttagaggaacccagggtaacgatggggcaaactgaaagtaaatatgcctcttatctcagctttattaaaattcttttaagaagagggggagttagagcttctacagaaaatctaattacgctatttcaaacaatagaacaattctgcccatggtttccagaacagggaactttagatctaaaagattgggaaaaaattggcaaagaattaaaacaagcaaatagggaaggtaaaatcatcccacttacagtatggaatgattgggccattattaaagcaactttagaaccatttcaaacaggagaagatattgtttcagtttctgatgcccctaaaagctgtgtaacagattgtgaagaagaggcagggacagaatcccagcaaggaacggaaagttcacattgtaaatatgtagcagagtctgtaatggctcagtcaacgcaaaatgttgactacagtcaattacaggagataatataccctgaatcatcaaaattgggggaaggaggtccagaatcattggggccatcagagcctaaaccacgatcgccatcaactcctcctcccgtggttcagatgcctgtaacattacaacctcaaacgcaggttagacaagcacaaaccccaagagaaaatcaagtagaaagggacagagtctctatcccggcaatgccaactcagatacagtatccacaatatcagccggtagaaaataagacccaaccgctggtagtttatcaataccggctgccaaccgagcttcagtatcggcctccttcagaggttcaatacagacctcaagcggtgtgtcctgtgccaaatagcacggcaccataccagcaacccacagcgatggcgtctaattcaccagcaacacaggacgcggcgctgtatcctcagccgcccactgtgagacttaatcctacagcatcacgtagtggacagggtggtgcactgcatgcagtcattgatgaagccagaaaacagggcgatcttgaggcatggcggttcctggtaattttacaactggtacaggccggggaagagactcaagtaggagcgcctgcccgagctgagactagatgtgaacctttcaccatgaaaatgttaaaagatataaaggaaggagttaaacaatatggatccaactccccttatataagaacattattagattccattgctcatggaaatagacttactccttatgactgggaaattttggccaaatcttccctttcatcctctcagtatctacagtttaaaacctggtggattgatggagtacaagaacaggtacgaaaaaatcaggctactaagcccactgttaatatagacgcagaccaattgttaggaacaggtccaaattggagcaccattaaccaacaatcagtgatgcagaatgaggctattgaacaagtaagggctatttgcctcagggcctggggaaaaattcaggacccaggaacagctttccctattaattcaattagacaaggctctaaagagccatatcctgactttgtggcaagattacaagatgctgctcaaaagtctattacagatgacaatgcccgaaaagttattgtagaattaatggcctatgaaaatgcaaatccagaatgtcagtcggccataaagccattaaaaggaaaagttccagcaggagttgatgtaattacagaatatgtgaaggcttgtgatgggattggaggagctatgcataaggcaatgctaatggctcaagcaatgagggggctcactctaggaggacaagttagaacatttgggaaaaaatgttataattgtggtcaaatcggtcatctgaaaaggagttgcccaggcttaaataaacagaatataataaatcaagctattaacagcaaaaaataaaaagccatctggcctgtgtccaaaatgtggaaaagcaaaacattgggccaatcaatgtcattctaaatttgataaagatgggcaaccattgtctggaaacaggaagaggggccagcctcaggccccccaacaaactggggcattcccagttaaactgtttgttcctcagggttttcaaggacaacaacccctacagaaaataccaccacttcagggagtcagccaattacaacaatccaacagctgtcccgcgccacagcaggcagcaccgcagtagatttatgttccacccaaatggtctttttactccctggaaagcccccacaaaagattcctagaggggtatatggcccgctgccagaagggagggtaggcctttgagggagatcaagtctaaatttgaagggagtccaaattcatactggggtaatttattcagattataaagggggaattcagttagtgatcagctccactgttccccggagtgccaatccaggtgatagaattgctcaattactgcttttgccttatgttaaaattggggaaaacaaaaaggaaagaacaggagggtttggaagtaccaaccctgcaggaaaagctgcttattgggctaatcaggtctcagaggatagacccgtgtgtacagtcactattcagggaaagagtttgaaggattagtggatacccaggctgatgtttctgtcatcggcataggtactgcctcagaagtgtatcaaagtgccatgattttacattgtccaggatctgataatcaagaaagtacggttcagcctgtgatcacttcattccaatcaatttatggggccgagacttgttacaacaatggcatgcagagattactatcccagcctccctatacagccccaggaataaaaaaatcatgactaaaatgggatagctccctaaaaagggactaggaaagaagtcccaattgaggctgaaaaaaatcaaaaaagaaaaggaatagggcatcctttttaggagcggtcactgtagagcctccaaaacccattccattaacttgggggaaaaaaaaacaactgtatggtaaatcagcagcgcttccaaaacaaaaactggaggctttacatttattagcaaagaaacaattagaaaaaggacattgagccttcattttcgccttggaattctgtttgtaattcagaaaaaatccggcagatggcgtataatgccgtaattcaacccatgggggctctcccaccccggttgccctctccagccatggtcccctttaattataattgatctgaaggattgcttttttaccattcctctggcaaaacaggattttgaaaaatttgcttttaccacaccagcctaaataataaagaaccagccaccaggtttcagtggaaagtattgcctcagggaatgcttaatagttcaactatttgtcagctcaagctctgcaaccagttagagacaagttttcagactgttacatcgttcactatgttgatattttgtgtgctgcagaaacgagagacaaattaattgaccgttacacatttctgcagacagaggttgccaacgcgggactgacaataacatctgataagattcaaacctctactcctttccgttacttgggaatgcaggtagaggaaaggaaaattaaaccacaaaaaatagaaataagaaaagacacattaaaagcattaaatgagtttcaaaagttgctaggagatactaattggatttggagatattaattggatttggccaactctaggcattcctacttatgccatgtcaaatttgttctctttcttaagaggggactcggaattaaatagtgaaagaacgttaactccagaggcaactaaagaaattaaattaattgaagaaaaaattcggtcagcacaagtaaatagaatagatcacttggccccactccaaattttgatttttgctactgcacattccctaacaggcatcattgttcaaaatacagatcttgtggagtggtccttccttcctcacagtacaattaagacttttacattgtacttggatcaaatggctacattaattggtcagggaagattatgaataataacattgtgtggaaatgacccagataaaatcactgttcctttcaacaagcaacaggttagacaagcctttatcaattctggtgcatggcagattggtcttgccgattttgtgggaattattgacaatcgttaccccaaaacaaaaatcttccagtttttaaaattgactacttggattttacctaaagttaccaaacataagcctttaaaaaatgctctggcagtgtttactgatggttccagcaatggaaaagtggcttacaccgggccaaaagaatgagtcatcaaaactcagtatcacttgactcaaagagcagagttggttgccgtcattacagtgttaacaagattttaatcagtctattaacattgtatcagattctgcatatgtagtacaggctacaaaggatattgagagagccctaatcaaatacattatggatgatcagttaaacccgctgtttaatttgttacaacaaaatgtaagaaaaagaaatttcccattttatattactcatattcgagcacacactaatttaccagggcctttaactaaagcaaatgaacaagctgacttgctagtatcatctgcattcatggaagcacaagaacttcatgccttgactcatgtaaatgcaataggattaaaaaataaatttgatatcacatggaaacagacaaaaaatattgtacaacattgcacccagtgtcagattctacacctggccactcaggaggcaagagttaatcccagaggtctatgtcctaatgtgttatggcaaatggatgtcatgcacgtaccttcatttggaaaattgtcatttgtccatgtgacagttgatacttattcacatttcatatgggcaacctgccagacaggagaaagtacttcccatgttaaaagacatttattatcttgttttcctgtcatgggagttccagaaaaagttaaaacagacaatgggccaggttactgtagtaaagcagttcaaaaattcttaaatcagtggaaaattacacatacaataggaattctctataattcccaaggacaggccataattgaaagaactaatagaacactcaaagctcaattggttaaacaaaaaaaaggaaaagacaggagtataacactccccagatgcaacttaatctagcactctatactttaaatgttttaaacatttatagaaatcagaccactacctctgcagaacaacatcttactggtaaaaggaacagcccacatgaaggaaaactgatttggtggaaagataataaaaataaaacatgggaaatggggaaggtgataacgtgggggagaggttttgcttgtgtttcaccaggagaaaatcagcttcctgtttggatacccactagacatttaaagttctacaatgaactcactggagatgcaaagaaaagtgtggagatggagacaccccaatcgactcgccagtctacaggtgtatccagcagctccaaagagacagcaaccagcaagaatgggccatagtgacgatggtggttttgtcaaaaagaaaagggggggatatgtaaggaaaagagagatcagactttcactgtgtctatgtagaaaaggaagacataagaaactccattttgatctgtactaagaaaaattgttttgccttgagatgctgttaatctgtaactttagccccaaccctgtgctcacggaaacatgtgctgtaaggtttaagggatctagggctgtgcaggatgtaccttgttaacaatatgtttgcaggcagtatgtttggtaaaagtcatcgccattctccattctcgattaaccaggggctcaatgcactgtggaaagccacaggaacctctgcccaagaaagcctggctgttgtgggaagtcagggaccccgaatggagggaccagctggtgctgcatcaggaaacataaattgtgaagatttcttggacatttatcagtttccaaaattaatacttttataatttcttacacctgtcttactttaatctcttaatcctgttatctttgtaagctgaggatatacgtcacctcaggaccactattgtacaaattgattgtaaaacatgttcacatgtgtttgaacaatatgaaatcagtgcaccttgaaaatgaacagaataacagtgattttagggaacaaaggaagacaaccataaggtctgactgcctgaggggtcgggcaaaaagccatatttttcttcttgcagagagcctataaatggacgtgcaagtaggagagatattgctaaattcttttcctagcaaggaatataatactaagaccctagggaaagaattgcattcctggggggaggtctataaacggccgctctgggagtgtctgtcctatgtggttgagataaggactgagatacgccctggtctcctgcagtaccctcaggcttactaggattgggaaaccccagtcctggtaaatttgaggtcaggccggttctttgctctgaaccctgttttctgttaagatgtttatcaagacaatacatgcaccgctgaacatagacccttatcaggagtttctgattttgctctggtcctgtttcttcagaagcatgtcatctttgctctgccttctgccctttgaagcatgtgatctttgtgacctactccctgttcatacacccctccccttttaaaatccctaataaaaacttgctggttttgtggctcaggggggcatcatggacctaccaatacgtgatgtcacccccggtggcccagctgtaaaattcctttctttatactcttatttctcagaccagctgacacttagggaaaatagaaagaacctatgttgaaatattggaggcgggttcccccgatacctgggtattgtccaaggtttcctttgctgaggaggattagtaaaaggaatgcctccatctcctgcatgtccctgggaacagaatgttcccaccaaccaccctgtggctggaggcgggatatgctggcagcaatgctgctctattactctttgctacactgagatgtttgggtggagagaagcataaatctggcctatgtgcacatctgggcacagcaccttcctttgaacttatttgtgacacagattcctttgctcacgttttcctgttgactttctcaccactcaccctattctcctgtggcattcgccttgcggagatagtgaaaatagtaataaatactgagggaactcagactgagggaactcagactgggcagaccggggccagtgtgggtcctccatatgctgagcgccggttccctgggcccactgttctttc

SEQ ID NO: 1278 - DNA, 7781 bp, Homo sapiens; identical to SEQ ID NO: 1277

SEQ ID NO: 1279 - DNA, 9019 bp, Homo sapiens
ggtctgagaaataagagtataaagaaaggaattttacagctgggccaccgggggtgacatcacgtattggtaggtccatgatgcccccctgagccacaaaaccagcaagtttttattagggattttaaaaggggaggggtgtatgaacagggagtaggtcacaaagatcacatgcttcaaagggcagaaggcagagcaaagatgacatgcttctgaagaaacaggaccagagcaaaatcagaaactcctgataagggtctatgttcagcggtgcatgtattgtcttgataaacatcttaacagaaaacagggttcagagcaaagaaccggcctgacctcaaatttaccaggactggggtttcccaatcctagtaagcctgagggtactgcaggagaccagggcgtatctcagtccttatctcaaccacataggacagacactcccagagcggccgtttatagacctccccccaggaatgcaattctttccctagggtcttagtattatattccttgctaggaaaagaatttagcaatatctctcctacttgcacgtccatttataggctctctgcaagaagaaaaatatggctttttgcccgacccctcaggcagtcagaccttatggttgtcttcctttgttccctaaaatcactgttattctgttcattttcaaggtgcactgatttcatattgttcaaacacatgtgaacatgttttacaatcaatttgtacaatagtggtcctgaggtgacgtatatcctcagcttacaaagataacaggattaagagattaaagtaagacaggtgtaagaaattataaaagtattaattttggaaactgataaatgtccaagaaatcttcacaatttatgtttcctgatgcagcaccagctggtccctccattcggggtccctgacttcccacaacagccaggctttcttgggcagaggttcctgtggctttccacagtgcattgagcccctggttaatcgagaatggagaatggcgatgacttttaccaaacatactgcctgcaaacatattgttaacaaggtacatcctgcacagccctagatcccttaaaccttacagcacatgtttccgtgagcacagggttggggctaaagttacagattaacagcatctcaaggcaaaacaatttttcttagtacagatcaaaatggagtttcttatgtcttccttttctacatagacacagtgaaagtctgatctctcttttccttacatatcccccccttttctttttgacaaaaccaccatcgtcactatggcccattcttgctggttgctgtctctttggagctgctggatacacctgtagactaacaacagacagaacaggcatacaaggattaatatgaaatttacaatagtgaaacttctgatgcttttaacccaagtgactggcttaagatttgtgaggctatcagcagctttcacgattgtctccgttcctggcaccaaatttaaatgggcttttgatgcctcaaaaattttttcttggctgggcacggtggctcacgactgtaatcccagcactttgggaggccaaggtgggcagatcacaaggtcaggagatcgagaccatcctggctaacacggtgaaactccatctctattaaaaacccaaaaaaaattagccaggcatggtggtgggctcctgtagtcccaactacttgggaggctgaggcaggagaatggtgtaaacccaggaggcggaacttgcagtgagctgagatcacgccactgcactccagcctgggcgacagagcgagactctgtctcaaagaaaaaaaaaattcttttaattttgaaatgtctaaagtaagattatcttctcctccttgcagatggcatctaaccatgtcccagtgatgctcagactcattataggcttgtggtgtaacacaaaaatctgatgtattccagtcacatcgtaactgaaaaagatattccaagctcatgagcctctcccatccaaatgacagtttgtctaagatcattaatttggtttgccaatttttgatctatttggatctgagaattccacaattttgaggaattcttttgccaatcatttacgtattctgcagtttgaacagaggagtgtaaagcaattccagcagccgcagcagtagctgtgactgcaatgaggcccataatcactgccatcaaagtaaaaatgaatcttttggatctagttagaattccttttaatacttccgttaaaatatggatggatagcgaagcctcccatggtcggtccatggacacaaggatccacacaccctctcttgctcttcctagtagaatacggtgctgccaattaaaagtcaaatcaatgcaagtaaacattccacaattttcacagattatggtttgggaatcaggtttaataactatgtttttcctacaactagcaatataagggagttttacacaattttgcaaaggaattgtcagactggaatttaggttgatagtataatatgacttacgatctcttgttcctatagcttgatttccagaacaaattctaatgtggtgtgaggccacagtaagcttcctaattctggatgttcaggaccagtaacaggactaactttggtcaaggtgatgaaattcccttttcaccccatttccttggacagagtgattctaaccttctataaacctggtccagcctttcagttacatcaccgtcataggctggattaatgggccagatggatggggcctgtgaacatgaatgagtctggcctgtacagttatgatataattggcctcaagggacccagtctatcatagttcaaaattcattgttttgtactacactgcagtatcagccacacattctccgcagactaagacttctgggctttttgattctttgggaatttccttggggcaagccttccccttaggcctacattgtaatgatctttgataagaagggtcctgtaaattatttatctgtgacattccacttaccatgtgataagtaaatctactggtagcactgactgtaggtacttctaccaaccaattttgggttgtaggcattaagcatcctggtgccttccctaggcaaacaggaggataaggatacccaatggaaatattcatcatcattccttcttcaggttgggcagggcaacagtcatctgtggggccaggcacccatgcactattattaacatctacttcaataggattatccatctatgtaactgcccgaattaagggtgggaaaggcacataggcccagtaagtataattagctgcagctgctcctgcagacttgggaagacttaccaccgttgatacaatcatcagagctgcaagcagcatattctctggagttggtgtcacctttgtattctctaggcttttttttttagctaactgtgtcagcttctttaattgtgcctatattggcaactctgcttccttgatggaaggcaactttttctgttcttctgatatcaccattttgtttacctggcgagtcgattggggtgtctccatctccacacttttctttgcatctccagtgagttcattgtagaactttaaatgtctagtgggtatccaaacaggaagctgattttctcctggtgaaacacaagcaaaacctctcccccacgttatcaccttccccatttcccatgttttatttttattatctttccaccaaatcagttttccttcatgtgggctgttccttttaccagtaagatgttgttctgcagaggtagtggtctgatttctataaatgtttaaaacatttaaagtatagagtgctagattaagttgcatctggggagtgttatactcctgtcttttccttttttttgtttaaccaattgagctttgagtgttctattagttctttcaattatggcctgtccttgggaattatagagaattcctattgtatgtgtaattttccactgatttaagaatttttgaactgctttactacagtaacctggcccattgtctgttttaactttttctggaactcccatgacaggaaaacaagataataaatgtcttttaacatgggaagtactttctcctgtctggcaggttgcccatatgaaatgtgaataagtatcaactgtcacatggacaaatgacaattttccaaatgaaggtacgtgcatgacatccatttgccataacacattaggacatagacctctgggattaactcttgcctcctgagtggccaggtgtagaatctgacactgggtgcaatgttgtacaatattttttgtctgtttccatgtgatatcaaatttattttttaatcctattgcatttacatgagtcaaggcatgaagttcttgtgcttccatgaatgcagatgatactagcaagtcagcttgttcatttgctttagttaaaggccctggtaaattagtgtgtgctcgaatatgagtaatataaaatgggaaatttctttttcttacattttgttgtaacaaattaaacagcgggtttaactgatcatccataatgtatttgattagggctctctcaatatcctttgtagcctgtactacatatgcagaatctgatacaatgttaatagactgattaaaatcttgttaacactgtaatgacggcaaccaactctgctctttgagtcaagtgatactgagttttgatgactcattcttttggcccggtgtaagccacttttccattgctggaaccatcagtaaacactgccagagcattttttaaaggcttatgtttggtaactttaggtaaaatccaagtagtcaattttaaaaactggaagatttttgttttggggtaacgattgtcaataattcccacaaaatcggcaagaccaatctgccatgcaccagaattgataaaggcttgtctaacctgttgcttgttgaaaggaacagtgattttatctgggtcatttccacacaatgttattattcataatcttccctgaccaattaatgtagccatttgatccaagtacaatgtaaaagtcttaattgtactgtgaggaaggaaggaccactccacaagatctgtattttgaacaatgatgcctgttagggaatgtgcagtagcaaaaatcaaaatttggagtggggccaagtgatctattctatttacttgtgctgaccgaattttttcttcaattaatttaatttctttagttgcctctggagttaacgttctttcactatttaattccgagtcccctcttaagaaagagaacaaatttgacatggcataagtaggaatgcctagagttggccaaatccaattaatatctccaaatccaattagtatctcctagcaacttttgaaactcatttaatgcttttaatgtgtcttttcttatttctattttttgtggtttaattttcctttcctctacctgcattcccaagtaacggaaaggagtagaggtttgaatcttatcagatgttattgtcagtcccgcgttggcaacctctgtctgcagaaatgtgtaacggtcaattaatttgtctctcgtttctgcagcacacaaaatatcaacatagtgaacgatgtaacagtctgaaaacttgtctctaactggttgcagagcttgagctgacaaatagttgaactattaagcattccctgaggcaatactttccactgaaacctggtggctggttctttattatttaggctggtgtggtaaaagcaaatttttcaaaatcctgttttgccagaggaatggtaaaaaagcaatccttcagatcaattataattaaaggggaccatggctggagagggcaaccggggtgggagagcccccatgggttgaattacggcattatacgccatctgccggattttttctgaattacaaacagaattccaaggcgaaaatgaaggctcaatgtcctttttctaattgtttctttgctaataaatgtaaagcctccagtttttgttttggaagcgctgctgatttaccatacagttgtttttttttcccccaagttaatggaatgggttttggaggctctacagtgaccgctcctaaaaaggatgccctattccttttcttttttgatttttttcagcctcaattgggacttctttcctagtccctttttagggagctatcccattttagtcatgatttttttattcctggggctgtatagggaggctgggatagtaatctctgcatgccattgttgtaacaagtctcggccccataaattgattggaatgaagtgatcacaggctgaaccgtactttcttgattatcagatcctggacaatgtaaaatcatggcactttgatacacttctgaggcagtacctatgccgatgacagaaacatcagcctgggtatccactaatccttcaaactctttccctgaatagtgactgtacacacgggtctatcctctgagacctgattagcccaataagcagcttttcctgcagggttggtacttccaaaccctcctgttctttcctttttgttttccccaattttaacataaggcaaaagcagtaattgagcaattctatcacctggattggcactccggggaacagtggagctgatcactaactgaattccccctttataatctgaataaattaccccagtatgaatttggactcccttcaaatttagacttgatctccctcaaaggcctaccctcccttctggcagcgggccatatacccctctaggaatcttttgtgggggctttccagggagtaaaaagaccatttgggtggaacataaatctactgcggtgctgcctgctgtggcgcgggacagctgttggattgttgtaattggctgactccctgaagtggtggtattttctgtaggggttgttgtccttgaaaaccctgaggaacaaacagtttaactgggaatgccccagtttgttggggggcctgaggctggcccctcttcctgtttccagacaatggttgcccatctttatcaaatttagaatgacattgattggcccaatgttttgcttttccacattttggacacaggccagatggctttttattttttgctgttaatagcttgatttattatattctgtttatttaagcctgggcaactccttttcagatgaccgatttgaccacaattataacattttttcccaaatgttctaacttgtcctcctagagtgagccccctcattgcttgagccattagcattgccttatgcatagctcctccaatcccatcacaagccttcacatattctgtaattacatcaactcctgctggaacttttccttttaatggctttatggccgactgacattctggatttgcattttcataggccattaattctacaataacttttcgggcattgtcatctgtaatagacttttgagcagcatcttgtaatcttgccacaaagtcaggatatggctctttagagccttgtctaattgaattaatagggaaagctgttcctgggtcctgaatttttccccaggccctgaggcaaatagcccttacttgttcaatagcctcattctgcatcactgattgttggttaatggtgctccaatttggacctgttcctaacaattggtctgcgtctatattaacagtgggcttagtagcctgattttttcgtacctgttcttgtactccatcaatccaccaggttttaaactgtagatactgagaggatgaaagggaagatttggccaaaatttcccagtcataaggagttcacatctagtctcagctcgggcaggcgctcctacttgagtctcttccccggcctgtaccagttgtaaaattaccaggaaccgccatgcctcaagatcgccctgttttctggcttcatcaatgactgcatgcagtgcaccaccctgtccactacgtgatgctgtaggattaagtctcacagtgggcggctgaggatacagcgccgcgtcctgtgttgctggtgaattagacgccatcgctgtgggttgctggtatggtgccgtgctatttggcacaggacacaccgcttgaggtctgtattgaacctctgaaggaggccgatactgaagctcggttggcagccggtattgataaactaccagcggttgggtcttattttctaccggctgatattgtggatactgtatctgagttggcattgccgggatagagactctgtccctttctacttgattttctcttggggtttgtgcttgtctaacctgcgtttgaggttgtaatgttacaggcatctgaaccacgggaggaggagttgatggcgatcgtggtttaggctctgatggccccaatgattctggacctccttcccccaattttgatgattcagggtatattatctcctgtaattgactgtagtcaacattttgcgttgactgagccattacagactctgctacatatttacaatgtgaactttccgttccttgctgggattctgtccctgcctcttcttcacaatctgttacacagcttttaggggcatcagaaactgaaacaatatcttctcctgtttgaaatggttctaaagttgctttaataatggcccaatcattccatactgtaagtgggatgattttaccttccctatttgcttgttttaattctttgccaattttttcccaatcttttagatctaaagttccctgttctggaaaccatgggcagaattgttctattgtttgaaatagcgtaattagattttctgtagaagctctaactccccctcttcttaaaagaattttaataaagctgagataagaggcatatttactttcagtttgccccatcgttaccctgggttcctctaagcacacaagcttaccgcaaggctgaccgtggacgtacttgggactctctcgtcaacttgtcctcaatgaccacactgtagagtaccttcaccctagagaaaggcacccacattgggcatcagatgaagggggccagcccctccacacctgt

SEQ ID NO: 1280 - DNA, 9019 bp, Homo sapiens; identical to SEQ ID NO: 1279

SEQ ID NO: 1281 - DNA, 9019 bp, Homo sapiens; identical to SEQ ID NO: 1279

SEQ ID NO: 1282 - DNA, 4575 bp, Homo sapiens
gcagagacatttgttcacatgttttcctgctggccctctccccactattaccctattgtcctgccacatccccctctccgagatggtagagataatgatcaataaatactgagggaactcagagaccggtgcggcgcgggtcctccatatgctgagcgccggtcccctgggcccacttttctttctctatactttgtctctgttgtctttcttttctcaagtctctcgttccacctgaggagaaatgcccacagctgtggaggcgcaggccactccatctggtgcccaacgtggatgcttttctctagggtgaagggactctcgagtgtggtcattgaggacaagtcaacgagagattcccgagtacgtctacagtgagccttgtgggtgaaggtactctacagtgtggtcattgaggacaagttgacgagagagtcccaagtacgtccacggtcagccttgcgacatttaaagttctacaatgaactcactggagatgcaaagaaaagtgtggagatggagacaccccaatcgactcgccaggtaaacaaaatggtgatatcagaagaacagaaaaagttgccttccatcaaggaagcagagttgccaatataggcacaattaaagaagctgacacagttagctaaaaaaaaaagcctagagaatacaaaggtgacaccaactccagagaatatgctgcttgcagctctgatgattgtatcaacggtggtaagtcttcccaagtctgcaggagcagctgcagctaattatacttactgggcctatgtgcctttcccacccttaattcgggcagttacatagatggataatcctattgaagtagatgttaataatagtgcatgggtgcctggccccacagatgactgttgccctgcccaacctgaagaaggaatgatgatgaatatttccattgggtatccttatcctcctgtttgcctagggaaggcaccaggatgcttaatgcctacaacccaaaattggttggtagaagtacctacagtcagtgctaccagtagatttacttatcacatggtaagtggaatgtcacagataaataatttacaggacccttcttatcaaagatcattacaatgtaggcctaaggggaaggcttgccccaaggaaattcccaaagaatcaaaaagcccagaagtcttagtctgcggagaatgtgtggctgatactgcagtgtagtacaaaacaatgaattttgaactatgatagactgggtcccttgaggccaattatatcataactgtacaggccagactcattcatgttcacaggccccatccatctggcccattaatccagcctatgacggtgatgtaactgaaaggctggaccaggtttatagaaggttagaatcactctgtccaaggaaatggggtgaaaagggaatttcatcaccttgaccaaagttagtcctgttactggtcctgaacatccagaattaggaagcttactgtggcctcacaccacattagaatttgttctggaaatcaagctataggaacaagagatcgtaagtcatattatactatcaacctaaattccagtctgacaattcctttgcaaaattgtgtaaaactcccttatattgctagttgtaggaaaaacatagttattaaacctgattcccaaaccataatctgtgaaaattgtggaatgtttacttgcattgatttgacttttaattggcagcaccgtattctactaggaagagcaagagagggtgtgtggatccttgtgtccatggaccgaccatgggaggcttcgctatccatccatattttaacggaagtattaaaaggaattctaactagatccaaaagattcatttttactttgatggcagtgattatgggcctcattgcagtcacagctactgctgcggctgctggaattgctttacactcctctgttcaaactgcagaatacgtaaatgattggcaaaagaattcctcaaaattgtggaattctcagatccaaatagatcaaaaattggcaaaccaaattaatgatcttagacaaactgtcatttggatgggagaggctcatgagcttggaatatctttttcagttacgatgtgactggaatacatcagatttttgtgttacaccacaagcctataatgagtctgagcatcactgggacatggttagatgccatctgcaaggaggagaagataatcttactttagacatttcaaaattaaaagaattttttttttctttgagacagagtctcgctctgtcgcccaggctggagtgcagtggcgtgatctcagctcactgcaagttccgcctcctgggtttacaccattctcctgcctcagcctcccaagtagttgggactacaggagcccaccaccatgcctggctaattttttttgggtttttaatagagatggagtttcaccgtgttagccaggatggtctcgatctcctgaccttgtgatctgcccaccttggcctcccaaagtgctgggattacagtcgtgagccaccgtgcccagccaagaaaaaatttttgaggcatcaaaagcccatttaaatttggtgccaggaacggagacaatcgtgaaagctgctgatagcctcacaaatcttaagccagtcacttgggttaaaagcatcagaagtttcactattgtaaatttcatattaatccttgtatgcctgttctgtctgttgttagtctacaggtgtatccagcagctccaaagagacagcaaccagcaagaatgggccatagtgacgatggtggttttgtcaaaaagaaaagggggggatatgtaaggaaaagagagatcagactttcactgtgtctatgtagaaaaggaagacataagaaactccattttgatctgtactaagaaaaattgttttgccttgagatgctgttaatctgtaactttagccccaaccctgtgctcacggaaacatgtgctgtaaggtttaagggatctagggctgtgcaggatgtaccttgttaacaatatgtttgcaggcagtatgtttggtaaaagtcatcgccattctccattctcgattaaccaggggctcaatgcactgtggaaagccacaggaacctctgcccaagaaagcctggctgttgtgggaagtcagggaccccgaatggagggaccagctggtgctgcatcaggaaacataaattgtgaagatttcttggacatttatcagtttccaaaattaatacttttataatttcttacacctgtcttactttaatctcttaatcctgttatctttgtaagctgaggatatacgtcacctcaggaccactattgtacaaattgattgtaaaacatgttcacatgtgtttgaacaatatgaaatcagtgcaccttgaaaatgaacagaataacagtgattttagggaacaaaggaagacaaccataaggtctgactgcctgaggggtcgggcaaaaagccatatttttcttcttgcagagagcctataaatggacgtgcaagtaggagagatattgctaaattcttttcctagcaaggaatataatactaagaccctagggaaagaattgcattcctggggggaggtctataaacggccgctctgggagtgtctgtcctatgtggttgagataaggactgagatacgccctggtctcctgcagtaccctcaggcttactaggattgggaaaccccagtcctggtaaatttgaggtcaggccggttctttgctctgaaccctgttttctgttaagatgtttatcaagacaatacatgcaccgctgaacatagacccttatcaggagtttctgattttgctctggtcctgtttcttcagaagcatgtcatctttgctctgccttctgccctttgaagcatgtgatctttgtgacctactccctgttcatacacccctccccttttaaaatccctaataaaaacttgctggttttgtggctcaggggggcatcatggacctaccaatacgtgatgtcacccccggtggcccagctgtaaaattcctttctttatactcttatttctcagaccagctgacacttagggaaaatagaaagaacctatgttgaaatattggaggcgggttcccccgatacctgggtattgtccaaggtttcctttgctgaggaggattagtaaaaggaatgcctccatctcctgcatgtccctgggaacagaatgttcccaccaaccaccctgtggctggaggcgggatatgctggcagcaatgctgctctattactctttgctacactgagatgtttgggtggagagaagcataaatctggcctatgtgcacatctgggcacagcaccttcctttgaacttatttgtgacacagattcctttgctcacgttttcctgttgactttctcaccactcaccctattctcctgtggcattcgccttgcggagatagtgaaaatagtaataaatactgagggaactcagactgagggaactcagactgggcagaccggggccagtgtgggtcctccatatgctgagcgccggttccctgggcccactgttctttc

SEQ ID NO: 1283 - DNA, 4575 bp, Homo sapiens; identical to SEQ ID NO: 1282

SEQ ID NO: 1284 - DNA, 10052 bp, Homo sapiens
gcagagacatttgttcacatgttttcctgctggccctctccccactattaccctattgtcctgccacatccccctctccgagatggtagagataatgatcaataaatactgagggaactcagagaccggtgcggcgcgggtcctccatatgctgagcgccggtcccctgggcccacttttctttctctatactttgtctctgttgtctttcttttctcaagtctctcgttccacctgaggagaaatgcccacagctgtggaggcgcaggccactccatctggtgcccaacgtggatgcttttctctagggtgaagggactctcgagtgtggtcattgaggacaagtcaacgagagattcccgagtacgtctacagtgagccttgtgtctctcatccctcctgacgagaaatacccacaggtgtggaggggctggcccccttcatctgatgcccaatgtgggtgcctttctctagggtgaaggtactctacagtgtggtcattgaggacaagttgacgagagagtcccaagtacgtccacggtcagccttgcggtaagcttgtgtgcttagaggaacccagggtaacgatggggcaaactgaaagtaaatatgcctcttatctcagctttattaaaattcttttaagaagagggggagttagagcttctacagaaaatctaattacgctatttcaaacaatagaacaattctgcccatggtttccagaacagggaactttagatctaaaagattgggaaaaaattggcaaagaattaaaacaagcaaatagggaaggtaaaatcatcccacttacagtatggaatgattgggccattattaaagcaactttagaaccatttcaaacaggagaagatattgtttcagtttctgatgcccctaaaagctgtgtaacagattgtgaagaagaggcagggacagaatcccagcaaggaacggaaagttcacattgtaaatatgtagcagagtctgtaatggctcagtcaacgcaaaatgttgactacagtcaattacaggagataatataccctgaatcatcaaaattgggggaaggaggtccagaatcattggggccatcagagcctaaaccacgatcgccatcaactcctcctcccgtggttcagatgcctgtaacattacaacctcaaacgcaggttagacaagcacaaaccccaagagaaaatcaagtagaaagggacagagtctctatcccggcaatgccaactcagatacagtatccacaatatcagccggtagaaaataagacccaaccgctggtagtttatcaataccggctgccaaccgagcttcagtatcggcctccttcagaggttcaatacagacctcaagcggtgtgtcctgtgccaaatagcacggcaccataccagcaacccacagcgatggcgtctaattcaccagcaacacaggacgcggcgctgtatcctcagccgcccactgtgagacttaatcctacagcatcacgtagtggacagggtggtgcactgcatgcagtcattgatgaagccagaaaacagggcgatcttgaggcatggcggttcctggtaattttacaactggtacaggccggggaagagactcaagtaggagcgcctgcccgagctgagactagatgtgaacctttcaccatgaaaatgttaaaagatataaaggaaggagttaaacaatatggatccaactccccttatataagaacattattagattccattgctcatggaaatagacttactccttatgactgggaaattttggccaaatcttccctttcatcctctcagtatctacagtttaaaacctggtggattgatggagtacaagaacaggtacgaaaaaatcaggctactaagcccactgttaatatagacgcagaccaattgttaggaacaggtccaaattggagcaccattaaccaacaatcagtgatgcagaatgaggctattgaacaagtaagggctatttgcctcagggcctggggaaaaattcaggacccaggaacagctttccctattaattcaattagacaaggctctaaagagccatatcctgactttgtggcaagattacaagatgctgctcaaaagtctattacagatgacaatgcccgaaaagttattgtagaattaatggcctatgaaaatgcaaatccagaatgtcagtcggccataaagccattaaaaggaaaagttccagcaggagttgatgtaattacagaatatgtgaaggcttgtgatgggattggaggagctatgcataaggcaatgctaatggctcaagcaatgagggggctcactctaggaggacaagttagaacatttgggaaaaaatgttataattgtggtcaaatcggtcatctgaaaaggagttgcccaggcttaaataaacagaatataataaatcaagctattaacagcaaaaaataaaaagccatctggcctgtgtccaaaatgtggaaaagcaaaacattgggccaatcaatgtcattctaaatttgataaagatgggcaaccattgtctggaaacaggaagaggggccagcctcaggccccccaacaaactggggcattcccagttaaactgtttgttcctcagggttttcaaggacaacaacccctacagaaaataccaccacttcagggagtcagccaattacaacaatccaacagctgtcccgcgccacagcaggcagcaccgcagtagatttatgttccacccaaatggtctttttactccctggaaagcccccacaaaagattcctagaggggtatatggcccgctgccagaagggagggtaggcctttgagggagatcaagtctaaatttgaagggagtccaaattcatactggggtaatttattcagattataaagggggaattcagttagtgatcagctccactgttccccggagtgccaatccaggtgatagaattgctcaattactgcttttgccttatgttaaaattggggaaaacaaaaaggaaagaacaggagggtttggaagtaccaaccctgcaggaaaagctgcttattgggctaatcaggtctcagaggatagacccgtgtgtacagtcactattcagggaaagagtttgaaggattagtggatacccaggctgatgtttctgtcatcggcataggtactgcctcagaagtgtatcaaagtgccatgattttacattgtccaggatctgataatcaagaaagtacggttcagcctgtgatcacttcattccaatcaatttatggggccgagacttgttacaacaatggcatgcagagattactatcccagcctccctatacagccccaggaataaaaaaatcatgactaaaatgggatagctccctaaaaagggactaggaaagaagtcccaattgaggctgaaaaaaatcaaaaaagaaaaggaatagggcatcctttttaggagcggtcactgtagagcctccaaaacccattccattaacttgggggaaaaaaaaacaactgtatggtaaatcagcagcgcttccaaaacaaaaactggaggctttacatttattagcaaagaaacaattagaaaaaggacattgagccttcattttcgccttggaattctgtttgtaattcagaaaaaatccggcagatggcgtataatgccgtaattcaacccatgggggctctcccaccccggttgccctctccagccatggtcccctttaattataattgatctgaaggattgcttttttaccattcctctggcaaaacaggattttgaaaaatttgcttttaccacaccagcctaaataataaagaaccagccaccaggtttcagtggaaagtattgcctcagggaatgcttaatagttcaactatttgtcagctcaagctctgcaaccagttagagacaagttttcagactgttacatcgttcactatgttgatattttgtgtgctgcagaaacgagagacaaattaattgaccgttacacatttctgcagacagaggttgccaacgcgggactgacaataacatctgataagattcaaacctctactcctttccgttacttgggaatgcaggtagaggaaaggaaaattaaaccacaaaaaatagaaataagaaaagacacattaaaagcattaaatgagtttcaaaagttgctaggagatactaattggatttggagatattaattggatttggccaactctaggcattcctacttatgccatgtcaaatttgttctctttcttaagaggggactcggaattaaatagtgaaagaacgttaactccagaggcaactaaagaaattaaattaattgaagaaaaaattcggtcagcacaagtaaatagaatagatcacttggccccactccaaattttgatttttgctactgcacattccctaacaggcatcattgttcaaaatacagatcttgtggagtggtccttccttcctcacagtacaattaagacttttacattgtacttggatcaaatggctacattaattggtcagggaagattatgaataataacattgtgtggaaatgacccagataaaatcactgttcctttcaacaagcaacaggttagacaagcctttatcaattctggtgcatggcagattggtcttgccgattttgtgggaattattgacaatcgttaccccaaaacaaaaatcttccagtttttaaaattgactacttggattttacctaaagttaccaaacataagcctttaaaaaatgctctggcagtgtttactgatggttccagcaatggaaaagtggcttacaccgggccaaaagaatgagtcatcaaaactcagtatcacttgactcaaagagcagagttggttgccgtcattacagtgttaacaagattttaatcagtctattaacattgtatcagattctgcatatgtagtacaggctacaaaggatattgagagagccctaatcaaatacattatggatgatcagttaaacccgctgtttaatttgttacaacaaaatgtaagaaaaagaaatttcccattttatattactcatattcgagcacacactaatttaccagggcctttaactaaagcaaatgaacaagctgacttgctagtatcatctgcattcatggaagcacaagaacttcatgccttgactcatgtaaatgcaataggattaaaaaataaatttgatatcacatggaaacagacaaaaaatattgtacaacattgcacccagtgtcagattctacacctggccactcaggaggcaagagttaatcccagaggtctatgtcctaatgtgttatggcaaatggatgtcatgcacgtaccttcatttggaaaattgtcatttgtccatgtgacagttgatacttattcacatttcatatgggcaacctgccagacaggagaaagtacttcccatgttaaaagacatttattatcttgttttcctgtcatgggagttccagaaaaagttaaaacagacaatgggccaggttactgtagtaaagcagttcaaaaattcttaaatcagtggaaaattacacatacaataggaattctctataattcccaaggacaggccataattgaaagaactaatagaacactcaaagctcaattggttaaacaaaaaaaaggaaaagacaggagtataacactccccagatgcaacttaatctagcactctatactttaaatgttttaaacatttatagaaatcagaccactacctctgcagaacaacatcttactggtaaaaggaacagcccacatgaaggaaaactgatttggtggaaagataataaaaataaaacatgggaaatggggaaggtgataacgtgggggagaggttttgcttgtgtttcaccaggagaaaatcagcttcctgtttggatacccactagacatttaaagttctacaatgaactcactggagatgcaaagaaaagtgtggagatggagacaccccaatcgactcgccaggtaaacaaaatggtgatatcagaagaacagaaaaagttgccttccatcaaggaagcagagttgccaatataggcacaattaaagaagctgacacagttagctaaaaaaaaaagcctagagaatacaaaggtgacaccaactccagagaatatgctgcttgcagctctgatgattgtatcaacggtggtaagtcttcccaagtctgcaggagcagctgcagctaattatacttactgggcctatgtgcctttcccacccttaattcgggcagttacatagatggataatcctattgaagtagatgttaataatagtgcatgggtgcctggccccacagatgactgttgccctgcccaacctgaagaaggaatgatgatgaatatttccattgggtatccttatcctcctgtttgcctagggaaggcaccaggatgcttaatgcctacaacccaaaattggttggtagaagtacctacagtcagtgctaccagtagatttacttatcacatggtaagtggaatgtcacagataaataatttacaggacccttcttatcaaagatcattacaatgtaggcctaaggggaaggcttgccccaaggaaattcccaaagaatcaaaaagcccagaagtcttagtctgcggagaatgtgtggctgatactgcagtgtagtacaaaacaatgaattttgaactatgatagactgggtcccttgaggccaattatatcataactgtacaggccagactcattcatgttcacaggccccatccatctggcccattaatccagcctatgacggtgatgtaactgaaaggctggaccaggtttatagaaggttagaatcactctgtccaaggaaatggggtgaaaagggaatttcatcaccttgaccaaagttagtcctgttactggtcctgaacatccagaattaggaagcttactgtggcctcacaccacattagaatttgttctggaaatcaagctataggaacaagagatcgtaagtcatattatactatcaacctaaattccagtctgacaattcctttgcaaaattgtgtaaaactcccttatattgctagttgtaggaaaaacatagttattaaacctgattcccaaaccataatctgtgaaaattgtggaatgtttacttgcattgatttgacttttaattggcagcaccgtattctactaggaagagcaagagagggtgtgtggatccttgtgtccatggaccgaccatgggaggcttcgctatccatccatattttaacggaagtattaaaaggaattctaactagatccaaaagattcatttttactttgatggcagtgattatgggcctcattgcagtcacagctactgctgcggctgctggaattgctttacactcctctgttcaaactgcagaatacgtaaatgattggcaaaagaattcctcaaaattgtggaattctcagatccaaatagatcaaaaattggcaaaccaaattaatgatcttagacaaactgtcatttggatgggagaggctcatgagcttggaatatctttttcagttacgatgtgactggaatacatcagatttttgtgttacaccacaagcctataatgagtctgagcatcactgggacatggttagatgccatctgcaaggaggagaagataatcttactttagacatttcaaaattaaaagaattttttttttctttgagacagagtctcgctctgtcgcccaggctggagtgcagtggcgtgatctcagctcactgcaagttccgcctcctgggtttacaccattctcctgcctcagcctcccaagtagttgggactacaggagcccaccaccatgcctggctaattttttttgggtttttaatagagatggagtttcaccgtgttagccaggatggtctcgatctcctgaccttgtgatctgcccaccttggcctcccaaagtgctgggattacagtcgtgagccaccgtgcccagccaagaaaaaatttttgaggcatcaaaagcccatttaaatttggtgccaggaacggagacaatcgtgaaagctgctgatagcctcacaaatcttaagccagtcacttgggttaaaagcatcagaagtttcactattgtaaatttcatattaatccttgtatgcctgttctgtctgttgttagtctacaggtgtatccagcagctccaaagagacagcaaccagcaagaatgggccatagtgacgatggtggttttgtcaaaaagaaaagggggggatatgtaaggaaaagagagatcagactttcactgtgtctatgtagaaaaggaagacataagaaactccattttgatctgtactaagaaaaattgttttgccttgagatgctgttaatctgtaactttagccccaaccctgtgctcacggaaacatgtgctgtaaggtttaagggatctagggctgtgcaggatgtaccttgttaacaatatgtttgcaggcagtatgtttggtaaaagtcatcgccattctccattctcgattaaccaggggctcaatgcactgtggaaagccacaggaacctctgcccaagaaagcctggctgttgtgggaagtcagggaccccgaatggagggaccagctggtgctgcatcaggaaacataaattgtgaagatttcttggacatttatcagtttccaaaattaatacttttataatttcttacacctgtcttactttaatctcttaatcctgttatctttgtaagctgaggatatacgtcacctcaggaccactattgtacaaattgattgtaaaacatgttcacatgtgtttgaacaatatgaaatcagtgcaccttgaaaatgaacagaataacagtgattttagggaacaaaggaagacaaccataaggtctgactgcctgaggggtcgggcaaaaagccatatttttcttcttgcagagagcctataaatggacgtgcaagtaggagagatattgctaaattcttttcctagcaaggaatataatactaagaccctagggaaagaattgcattcctggggggaggtctataaacggccgctctgggagtgtctgtcctatgtggttgagataaggactgagatacgccctggtctcctgcagtaccctcaggcttactaggattgggaaaccccagtcctggtaaatttgaggtcaggccggttctttgctctgaaccctgttttctgttaagatgtttatcaagacaatacatgcaccgctgaacatagacccttatcaggagtttctgattttgctctggtcctgtttcttcagaagcatgtcatctttgctctgccttctgccctttgaagcatgtgatctttgtgacctactccctgttcatacacccctccccttttaaaatccctaataaaaacttgctggttttgtggctcaggggggcatcatggacctaccaatacgtgatgtcacccccggtggcccagctgtaaaattcctttctttatactcttatttctcagaccagctgacacttagggaaaatagaaagaacctatgttgaaatattggaggcgggttcccccgatacctgggtattgtccaaggtttcctttgctgaggaggattagtaaaaggaatgcctccatctcctgcatgtccctgggaacagaatgttcccaccaaccaccctgtggctggaggcgggatatgctggcagcaatgctgctctattactctttgctacactgagatgtttgggtggagagaagcataaatctggcctatgtgcacatctgggcacagcaccttcctttgaacttatttgtgacacagattcctttgctcacgttttcctgttgactttctcaccactcaccctattctcctgtggcattcgccttgcggagatagtgaaaatagtaataaatactgagggaactcagactgagggaactcagactgggcagaccggggccagtgtgggtcctccatatgctgagcgccggttccctgggcccactgttctttc

SEQ ID NO: 1285 - DNA, 10052 bp, Homo sapiens; identical to SEQ ID NO: 1284

SEQ ID NO: 1286 - DNA, 557 bp, Homo sapiens
cacagacctactcccctgggggctgagggaggtcactgggaggtgatctttttccacctcggattgagcaagagaaggctgccagtggcccagactttgaaacaggccaggcagaggccaggctgagtcctccaccctcattgcaggagtccagcgtctggcctggggacttccctcaccagatctgttgaccaacttctagaaacccctgctttggggttgtgaattagaagggctgttttgaccctgaatatcaggcttcccttcctcccaggcatttctttcccgaggaggaaggtttccagtccctctcccaacccccaccctcagcaagccacaaagcctccaccgtcttcagctggttacaggtcaggatccaggtcgggggggaggggcaggtctcctgaggctagacttgaggaatgtttaggccaactcaccaggcagaggaggaaggggccagtttagatcactaagccaattaaaaacaaccagccagaaagaacctttctccttcctgacagctactctgccagctacctcctgggttttgttgg

SEQ ID NO: 1287 - DNA, 2018 bp, Homo sapiens
tgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccgggcaggagtgcagtggctcaatcttgggctcactgcagcctcaacctcccagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggacactgtcatctctcaagtacccatcttggagggtacggaccccacatgagggtgaggctctctgcacactccagaaaaggaccaaccacaccgagctcagttatggcacacacagtgggacctagacaaagggagagggtgaccgacatcccaactagcaggtgcaaggacgtgttgaactagctctctgcagcctccttggaggatgtgatcctatgggaggggtaggagtattcaggtccttgacatctcccaaatgtgtgattccgggatgccaaaggcctttggccagatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctactgaaaagcctctctgcctctatgttttataccatcggatgccaactcccggccttctaagccacctcccctttaggctaaaactgagacatgaacttgaaaaattgacactggcttcctctctctttagggtccccaggcaggtggctgggacactatttgcaatcagcaaggaaccctgctgcccttagactccccacagagcaagcagaacttgcagaatggggtaaaaacactctattaaagattttttaaacctatttatattgtaataaagtaaatgtaaataaaatttaagtgaaggcagattgcagatatttccgatgctatacaagatatatctcatagtatgggtgtagattctgcaaaggttaatgcagttaaacatatttgacacataaaaatgtcagatccaacattaatcattcaccaattgtaattgcctttctatgggtctcttctccccaagacatagcttaaaacaccaggctcggtagaaatctgggaggaaaaaagcaaataatacctctcagctgtcagggtctatgatacgctttgatagatttagcactgatttcattctctttacaattcagtgtgattgggtgtgcgtgtgtgtgtgtgtgtgtgtgtgtgtgtgtgtgtgtgttactccatgtttctcctttttaaggaaggagaaggtgtggaacaagagaaagttcctaagtctgaaggaagtccaacccagttatgaagggaatgccatccacaagccttttttataattggcccctgcctcaggtaaaggggtctcctttaaggagccagtctggctaaattggcagattctgaacaaagcctggccctgacaagtcttcagaaaaaccggttttcacctccagaatgtgccccag

SEQ ID NO: 1288 - DNA, 2018 bp, Homo sapiens; identical to SEQ ID NO: 1287

SEQ ID NO: 1289 - DNA, 6055 bp, Homo sapiens
tagacagataaactcaagtcataaaacatgtttttccttgaaaagaaatgatgtcatgtatgtctcaattgaataactgtctttgtttcttgcttctgttatacgcttccccctgcacaaatcttcccccacccacgaaatgcttaaaaggtaacttgactctttgtttggggctcagtcctttggatgttaatccaagtggaccagtgcacctaaataataaatatcctcctcaatcccttggtctctctgattccttatatatcccgatacatttctgggggctcatcaggattggagatgacagatttactgtcccctttgcctgcgatactaggtccccggggccaggagagacccggcatccaaggtgtgccacagctgagcttcacccggatatatagaccagctctccccacgtcccagcaccctgcctggcagcgcaatggaaccgaggatggggctgcaggacgataccagcacttcaggaactgtgtctcagttggcagtgttaccgctggtgtaatctcttctctgttcctggcttttattgagatggttgatcatctttacacagtcctttgcatgcagatacagaatcttgctccgctgccaaggctggagtgcactggttcaatctcggctcactgcaaactctgcctcccaagttcaagtgattctcctgtgtcagtttctttaggaatacagcactccatattgttaccataataatgaaacggattcccatggctacagcgatgaagcagcagaaaaaaaatggagatgctgtcaaagaaaaaagacacagatcagagaaagaagcataaaaggtgtttaagaaataagtaacatagcagggcgcggtggctcatgcctgtaatccctcacgcctacaatccctcacgcctgtaatctcagcagtttgggaggccgaggtggacagattgcttgcggtaaggagtttgagaccagcgtagccaacatggcgaaaccccatctctacgaaaaattagccaggcatggtggtgagtgcctgtagtcccagctacttcggaggtggaggccgaagaattgcttgagcctggaaggctgagatctcagtgagccgagactgccactgcacgggtgacagagcgagcctctgtctcaaagaaagaaagagtatgtacctggatatgtatttttaaaataatgtaaagatttaaaaatagttcgaagaacctaattgtatggcttttgaagcaactagaagtatgttctttacagatggtgggagtaatgttatattaagtttgtgtaagctataacacttaagtgtttataagcatgtttataagctggtgtttacaagcatgtttttatttccgaacaaaattcaaaagaagtttgtctttgtaaaaattcagatgtgcacagttcttgttcctctctgaagatattggaaatgtattgctaatactggtaatatataacaatttttttatgaatagatgacttatttaatagttacgtatctaaatctgaatattttctatataatttgtctatggaaacaaatatttatacaattgttcacatattgctcttttctttgtaatgttattccttctaggtataaaatatagacgttctcaagaagattagtgtttgcaatagaaagctgggccatttggccacacctgcaaatgattattggttttgcgggagactgcaatccataaaaaattactggcagagtttgagaatttgtataagaaaacaaattttatgagatgcaaaatcaatactattatactaatttaaattttgtaatagcaaagctaattcttgttacttttcagtctttcaattcactaagataatgagtgttacgcactgaacacatacaaatgtattgctgtgactgaatgaagaggacaaattaacaaagcaattccgaggccctggaaattgatcaaaggctaataatcatttgtgaactatttattcttggaaaaactgctagagattcaaggaagagtgcagcaaatttgtagtaagtttacctagtgctgctcccgtgccttctgcccacccaccacacccagcacagtgagtaacagttgcagtttttacagctgggggaaaatcaacagtgttttttgccacaaggacagacttgattagcggtcagaggttggggcatagtgtaacagaccactgcttttcaactgaaagtgctgaattttgcaggaaatgaatgagaaaaccccattttttgttgttttttattttttttagtctgaggtgtagtctcctctggggcaagaacagtgccagccataaatataacaaaatcctaaacatgagagtgcaatagacctcatgacattagccctctacatattctttaaatttttttttaaattgacacattgtaattgtacatatttatggggtacaacttgatgttcaatacatatatatgttacattaaataatcaaatcagggtatttagtgtatctgtctacctcatgtatttatcatttctttgtggtgagaacgttcaaaagcctctgttctagctattttgtaatatgcaatatcttactgttaaccatcatcaccctactatgcaatagaacagaacttattcctcctacctaactataactttgtacccattgaccaagctctcaccctgtccccctctttttctctcctccagtctctgttgaccactgttctggtgtttttctggtgatcgctctgcttctataatatcagctcttttttgctttatttctacatgagtgagattatgtgatatttgtctttctgtatctgccttatttcacttaacatgatgctcagcaggttcatccatgttgtataaatgacaggattttattcttgattattgaaaaaaatatgcatatgtgtagaggagaccagggtgattccagtaaaaagtaaaagcccaaggagacttgagaactgattgcaaatttatgaacacttccttcaccacacacacacacacacacacacacacacaccgctagcacagagtggagcctctactaacttaaggttttcgaataaaccttttaaaataatatattggctgacaaccaagctatgcaattcacaagggcaatccctaggaaatggggctaaaaaataaaaataaaaaattagaatttgaaacaaaaacatcagcaaatgcattttaaaggagaaagattctgcagtaaaattttatgtaagttacccccccaaaatctttataaaccccccaaatttatttgtatgatactatattataaaaaatgtctattataagaaattagaaaacatgcagaaactggaaaatgtcttccatacttggagggaaagacaatcagtcaataaaatctgactttttctgggacaagatggtagatttatcagaaaatatattttaaagtaactattataaatgtacttaaattatacagaaaagtatgttcaattaattaaatgaaaatatgatggcaatgagaaaacaagtaggaaattttgtcagagaaatgaaaaccaagaaataaaccaaattctgagttgagaagtacattacttgaaacgaaaaattcactaaattggctagaaaaaaaattgagattcaaaaggaagaattcatcaactttgggatatattaatagaaattattcatcccagagaaaaagagaatacagaaagatgtagaaaaataatattaagacaaaactgacttaaaaacttttcaaatttgcttttttaaaaatgtatacatccaagatgctaagcaaactaatgactaatagaatcagcatgtagaaatccccatctcaaaacatcataatcaaatgattgaagaggattttaagacaaagaccctgagataatcttgtggaacaggtaggacggattatgagatgacttgagtctgtgtgaatgccagggaatggttgaggtatcccccaccagcaggagtattttgaccacattaccttccagagaacccacatttgccctgaatactattctagattggaaggaggcaacatcaacaagatagaggaatagcataccccagcacttgctccccatagaaacaacaacttaatacatccagaaataaacgtcggtacatatggactagtgattttcaataagagtgccaagaccattcaatgggaaaagggcagtatcttccagaaatagtgttgagaaaactggctaaacatatgcaaaagagtgaaatcaaagccttacattacaccatctacaaatattaactcataatgtattgaagacttaatgataagatccaaaactgtaaaacttctagaagaaaacatgtgaggaaagcttcatgaaattggatttagcaatcatttcttgataaaacacccaaatcacagccaacaaaagcaaaaaataggcaaatgggattacatcagacttaaaaatgtctgcagagcaaatgattgaagcaacaaaatcatgtatctaataagggattaatatccagaatatattaagaacttatgtaatccaatgacaaaaaccctaataaccctatttaaaaatggacaaaggattcaaatagatatttctccaaagaagatatacaaatgtccaataagcatatgaaaagatgctcaacattactatcatcagaaaaacataaatcaaaaccactgttaaatatcacttcatacccattagcatggccgctatgaaaaaagcagaaaataacaattattgcttaggttgtgaagaaatttgggcccttgtgcactgttaatgaaaatgtaaaatggtacagtcactatggaaaacattatggaggttcctcaaaaaatttaaaattgagttgacatatgaaccaacaatcttacttctgtagagccaaaggagttgagatcaggaacttgaacaggtatcggcactcccatgttcattgcaacagttaaaacatagaagcaacatacaagcccattgatgaattggtggataaagaaaatgtggcatgtgtataaaatggaatacaattctgccattaaaaagaagaaaaagctattgcaacaacatggataaacctgaaggacattatgctgagtaaaataatagtaaattcatagaagcagggagtagaagggtggttgtcaggggctgggagagggaaaaacaggagagtattagtcaaagggtacaaactttcagttatacgagatgaacaaggtctagatatctgttttactacacagaacctgtagttaataatgttgtatactaaagatttggctaagagcgtagatcttaagtgtttgtatcacaaaaaataataataaagaaggtggaaggaaacttctggagattacagatatgtttatgacacagattgtggtggtttcatggttatacacttatctctaatcttatcaagttgtatgcattaaatatgtacagctttttgtatgtcaatcatacttcaataaagttgtttaaacatttttaaaaaggataatatactttattttaaaaaaggaagtcttgttgcatgctgcaacatggataaatcttaaggacattatgctaagttaaataagccagtcacacaaaaaaaatgctgcctgctttatttatatgagatatctaaagtattcaaactcatagaaacagaaagtagaatgctgattgctaggggcaaaaaggggagttgtccaatgtgtatagagtttcagttttgcaaaatgaacaaattctagaaatctgttgtaaaatgtgaatatagttaacactactgacctgttcacttaaaaatggttgagatatatgatatggttaagatgtaatggctcagatgtaacatactgtatgagttcaactatatgacattctggaaaagtaaacaactatggagacagtacaaaaatcgatgcttgccatgtgtttgaaggaggaaaggatgaatgggcagagcacagaagattttcagggcaatgcaattattctgtatgatctatgatgataaagacatgtcattat

SEQ ID NO: 1290 - DNA, 6055 bp, Homo sapiens; identical to SEQ ID NO: 1289

SEQ ID NO: 1291 - DNA, 622 bp, Homo sapiens
cctggctccagcccttgcctggaggttctagaatgttccagaacaatgaacaatggcactgcccatcctcagctggggtaaagctggggctcaaggaactggggtccagaaggcatctccagcaggcgatgggcagagaaagcagggcttctgttgtgaggggacagcacccccaacctggccctcaacagccttcacaagtttgtggttccaaaagcagttttatttttcttcttgtaaatcatgaccagtgagaaataatgtgtgccccaccccccaccagtgaagaagctgtgcgtgagtatcccacccgctctgggacccagaaatcccatcccttcccatctcctcccccactgtcccaaactcttcgtctcctctctctgccctgggcggccttgggccttccccagctatctcctagcaacaggtccatggttgcctcagcaaccaagagttccatacaggcctcagaggagaaattttgggaagtacaggagacaccgaaagaaaagaaaaggcagaacttcctgggtgtgtgcagaattgggtcgaagctgtcagattcgctgggttggaggcacaggtggagcacacccagtaaggtttggggctcaccccg

SEQ ID NO: 1292 - DNA, 622 bp, Homo sapiens; identical to SEQ ID NO: 1291

SEQ ID NO: 1293 - DNA, 1512 bp, Homo sapiens
ccagcctatgaaacagtatggtagacaagctgcaaagtttcataaagtctcaacaacggccaacatggaaattggaaaagttagaacaaatagaccaagcctggggaaatttactgaactctggggctcccttccaagtatggtgatcggtaacccaaattaaactcactaaggtgtcctgaaaaaaatggggtcaataaaagataatgtcaatctggaacacaccctctgaattgggactaaaccccaagccaatgaatggagaatgagcaacaagttatagctccaggggcctggtaagagtgaagaagggaaaagtctacagaaaaagtaatagttcagggaagactttatcttagcaggagcagaagaagggatgaagttaaatccatccactgggacaggccaggtttgctggtgattagaggagaagcctgctgtttagccattctgctttgtatagagtctacttacacagcttcagacttaggattgggttgccaagaaggtggggacatgcagacaccaaaatgtgctgcgtctctctctgtctctctgtatcctcctacccacatgatgtccactgccctttttgcagaactgcattctggtttggcaatatcccatgtcttggacttttgccaattgtctcttctttgcctcatttaaagctttctctctcccttttttttttttttttagatggagtctctgttgccaggctggagtgcagtgacatgatctcactgcaacctccgcctcccaggtgcaagtgattctcctgcctcagcctcctgagtagctgggattactggagtgcaccaccacacccagctaattttcgtatttttagtagagatggggtttcacaatgttggccaggatggtctcgatctcttgacctcgtgatccgcccacctcggcttcccaaaggcattctctctttattccccaatatagtccctcaaggtcttgccaaaggcctggttagaaagattaaaaaagaaaaaaacacacacacagaaaagaaatgagtctaaaggctgttatccctgtgggttaatcctcctagataacactgacattttaacaaatgcttttagtgctaaagaggaaatatgtgggaaagtttttaggcatgggccaggtgaatggaatagccgtttatcaaaacatttattagatgtgtgtacttctaaaatgatgccatgcagattgttgcctaatttgtagatctagttcgtgcatcctccatctctctctctctatttctctttctctttctgtttgtccctttctttctgtctgtctctctgcctctatagctctattgccctaactatctcttttcagtgaaatatacttctcccctgccatacaaaagtattgtattactgcatattcttcagtattcccatatagattttatgataacaattctctgaaatgtgtagatttgctcgattctgttatacagtcagacgtgtgtaactattttatgcatgcgtaaaa

SEQ ID NO: 1294 - DNA, 2528 bp, Homo sapiens
cccattgccaaatgacggctgagttatgctctctctatattttttaaagaattcgcttttgaaaagaaggtggaggtggctggggaggagagggtaatccacgtcctgtcactcactcccttccaggctgtgagaaagttgtgggcctgggaacttacagtttgttttctataattccatctggtttgagaccaaaaaggacatatttgtggagaacagaccacagtctgagagggaaaagggctgagggggtagaggtataaaaatcagatagctcagcacttcgctccaaaggagctgaaggagagaggattccactgcgtgtatgttttctctttcacgtctcacttttgttctctgccatcaggaaatgcagtagacatttgtcaccagcagctctttggagacttcaatgttccttcctcccaggatccgaaaggggacttcagacacggagaatctaagacaccaggagctcagaagaatggagtctcaagacatcaggcaaataccgaagagatcagagccaagttctaaagggcagccatttcccaaatgtcaaccaagagcgaagccaagagaattatgatttcctggctatacaatgacaggaaaagcttgatcaaagctggagtgcaagttaaaaagtgtaaggtactcaagtgctagggtctgtgtccaagcccaatcaattgatcattagttgtttttaacttcaacgtttcttttgcaacagcacctcttccttaaagtagcaatcttagcagactgccaccttacatgatgcatcttattctccaaggacaatgaagactgaactatcgcacattacctaagaaagatgggaattgacatgcacatcacaattgtatacacaacagaaattattgaatcatgagatatacattccggtgtgtgacagattggcacatgacataatctgggttctttatagactcagttgttttggggcgatctagattatcaagagaagagccttcatgcttagctttatcttgtaccaaccaccagggcccttgcttctgagcaggaagcagctggggaataggctctttctcttaatgacttccaacatagttctctcaaaccttactcctccagaaggccaccctcacctggctatggctacttcagaaaaaacttggcctctggtataatagagcagaatcaccacctcacattctatttcaagccaaagtcaatatctcaaaggctggttctgtgatttatttggcccttgggagctcctactgaaagtgctgaaatgtcgtactgacacttcagacttatagctacctagactccaagtaagatttatctctgactggagggtttctcctattaaaaaccaaagagtgtagggtgccttcacctgctaggtaatcttctatgccctaatgggaagaatgggagcagcagacaagtaagttcaggaaggagaaccaaagctgtgtccatgcccttgaggaaagagaaattggaccagacaagttcagtggaaactttctaatggatccatcaacttcatcttgtctaagcagagtcatagctagaagtgtgactgaaataggagaaccacgtccaggggttcaggggggattcctctgaaatcgcagctggaagcatttcgtaatagttctggtactgcacccatagatactgtcacctctactctttcttccaatcaccattagcagatgccacaggattcctacttctgaaagtttttgggccctgcaggtggaagactggagaagccaataaagtttaaggctacattttattccatccacaaatttggtgaaggaggaaatgtttacaattctgccatgccatgaataggagttttccaccgggtgtacactgctgttaacaaggtgtaaatacttgtccagtaaagagaccgtacggtactgctgatggacgtcccaacacaatgccagatgcaaaaacttctttggtgattgcttttgataacactgagtggctaaaggtcttctttcacatctttgcccacctcaaatcctgaaggcaaggtctctggaatttgaggctgtgccctcacatgcctccaaggcaccaacaaagcaaaatgaagagtctgcactgcttatcagttgacccaacactcagtccacattggaggggaaggggtggtgggctgaggatgtcttcttcctgtccaggatgcaatatggtcaaggatgaaaggaaagagatgctgggagcaagtctgcattgaagatgtatttctgttgctttactaccaaccctggttataaatgatgaaactataatgggtctgtaatagctactttcccatatagctcttgtctgtacatacataaaattaaaaataatagaatacttccattactaacatgtggtgacaagcattcttcatttaccatttttattccaaaaacatgatttaacattttaaaaaccaagatctgttcggtaaatcagataatagggtaaactatagtttaccctatcttacagcc

SEQ ID NO: 1295 - DNA, 2528 bp, Homo sapiens; identical to SEQ ID NO: 1294

SEQ ID NO: 1296 - DNA, 2528 bp, Homo sapiens; identical to SEQ ID NO: 1294

SEQ ID NO: 1297 - DNA, 2528 bp, Homo sapiens; identical to SEQ ID NO: 1294

SEQ ID NO: 1298 - DNA, 2528 bp, Homo sapiens; identical to SEQ ID NO: 1294

SEQ ID NO: 1299 - DNA, 2528 bp, Homo sapiens; identical to SEQ ID NO: 1294

SEQ ID NO: 1300 - DNA, 1747 bp, Homo sapiens
tcggtcactgcacatctgttattcagttcactcacagacagcaaaccaaggggttgtgctgtctccttgtctcccagggataaacccacatgacagtttacaaaaacaggtaatcataagaagcaaatggcccagatgaaacacagcaaaagaatgagaagtggtaacactgggagtgaaatttgaaccaagcgtaaatggagtgatcgtagaaatagctgactgtggaatgtggacactctctgtatctgcagcctgggaagcttaaagaaggtgaacttactgacaccagttagaaagtgactgtgatgaaacgatgaagatgctccagaggaagtgacaccagcaataggaaaaaaaaaacaaacctctcactgaaggaactctcggagatatttcatgacacagaaggcacaaaggatacaatattggcaactaatcgaaacttagaaatgatatgacagctcaccaaggcatagaaaaagatgcttgctctatcataagttatagaatgagaagaagcagtatatcagaaaactcaaatataactccacaactttttcaagagtttctttttgttttccaatggtaacgggagagaaaataagctgtcattatcggaatgatcaaacacagagagaaaagaggcagaggtgagaagatggagaagatgaatacatttgctttcagcaaaccaatggaagtccatttgcatgatctgaaaaggaaaatgagaagctaatttttctatacaaggcagaatttaagaaatacaattcctaaggactccagtggatacagctctggttcctggacttcgtgttttggcttggtctttctgctttttcaattttgtcactggagaggataatgagacatctaagtggcatagagggctggagttcagaagaaacacaggattcaagatatgcctttcagagtgaagaccagaaacattattgggggtcaggattcagtgatacctccaaaggagaaaatgtgaagactgaaatgcaggggttgaggaccattttgttaaaggaaagggtataatgagaacctgttaacacagaagaaatggagttctctgtcattcaagacaaagagctgcatctgagtcaaggtaatctgctctgaatagtgcttcatccaaaaatatctcctctttttttcccaatcatctttattgtctggttatgcaagtaaaccttctacctcttaagcctcaggttccacatccataaaatgaatacaatattactatctaccttccatggctgtgatgaggatatagtgaggcaaggggtgatatgcctggcacagagtacaaacccaaccaatgtgagctacccttatcattgtcattattattattcgtcacatttgcctctgtttaatcaataatcattcctttacaagatgagtatcccaaacttacttccaaatactttgtcatttttttcactcctcacttagcctttctgtctgattcaaatggcacggggaaagagagaatgactcaaacatcacagattgctgttaccctggcatggttaagataattatgtcgccatcaggatactggtttgactctgaagtctcatgttcagtggttactgtttcctctcagggactgtgcttaaggtttagagaaatcgtcgtcatctagatgatcgttgctcaattgaaacatttatttgctatattagttttctattgctgtgtaacaaatttaatgcctttaaac

SEQ ID NO: 1301 - DNA, 1747 bp, Homo sapiens; identical to SEQ ID NO: 1300

SEQ ID NO: 1302 - DNA, 18125 bp, Homo sapiens
gccaaccacgtccctcctttcagttcgtccaggctcggtcactgcacatctgttattcagttcactcacagacagcaaaccaaggggttgtgctgtctccttgtctcccagggataaacccacatgacagtttacaaaaacaggtaatcataagaagcaaatggcccagatgaaacacagcaaaagaatgagaagtggtaacactgggagtgaaatttgaaccaagcgtaaatggagtgatcgtagaaatagctgactgtggaatgtggacactctctgtatctgcagcctgggaagcttaaagaaggtgaacttactgacaccagttagaaagtgactgtgatgaaacgatgaagatgctccagaggaagtgacaccagcaataggaaaaaaaaaacaaacctctcactgaaggaactctcggagatatttcatgacacagaaggcacaaaggatacaatattggcaactaatcgaaacttagaaatgatatgacagctcaccaaggcatagaaaaagatgcttgctctatcataagttatagaatgagaagaagcagtatatcagaaaactcaaatataactccacaactttttcaagagtttctttttgttttccaatggtaacgggagagaaaataagctgtcattatcggaatgatcaaacacagagagaaaagaggcagaggtgagaagatggagaagatgaatacatttgctttcagcaaaccaatggaagtccatttgcatgatctgaaaaggaaaatgagaagctaatttttctatacaaggcagaatttaagaaatacaattcctaaggactccagtggatacagctctggttcctggacttcgtgttttggcttggtctttctgctttttcaattttgtcactgggatggtgtttcactatgctgcccaggcaggtctcaaactccgggactcatgtgatcttcccaccttggcctcctgaagtgctgggattacaggcttgagccaccacactgggcctataccattttcaaatagtggagccatccattacatatttgtaacatatgtgttgattaacaattaatactcttagttccaagctccatttggcaatataaaataaatggagggtttgctcacatctgatggatatgactttctctgtgaagactgaagcaagatcatctgagtgtaaggaggcagtataagttcggaaattaaggaaggtagagatgcttaaggtagctttgcagagaataggagcgcatgtccaccagacagatgttatagaattgccatggcttgaagtttgaaacccagctgtggatgattgagatgattcatgtatttaatgatactaatagaatgatacccgtgagcaagctggattcctaggatgcaaaaagaaaatagctttattcttcaccttcaactgcccatttgaatcttcttttaggccagttcttttcccctccccaacttcaaatgaaataatagaaaggtctttggactctctgatcatctcagataataaaatgccctctggtcacttcagttccaaaccacaacctcggtttataaattaatctgcccagaaactcccaacttcatcgtaggcttggcaatgctttagactaaggggcctatagtggggaatgagatacccatctctgtgttccctttaatgctacttctccatgaccctgactttgtttccccagcacttagctaccaatgggtcttccaggatgggaagcagagacagcaggaagggaagaggaagaaaggtcttatttgacctacataggtataagctggtgtagctgccctctggctctggctgatgtttcaagctgacttttatgctctcatctcagtatctgtagcctcctcagacactcaccttctggacctgtccaactggaattccttcactcaggtagtgcctcccctttaagcagctgtttacaatctccctctacttctccatccagtgaaaccttcaacctctttttgtcaaggacacctcatccattccaggaagccctctgggttagaattccttataaaacaactcagactcacattcctactgtggattttatttggtccccagaaaaatacaactttggcctggcataagccaaaaagtgcttacttcctaagtgcagccctctgctgtgctgatactgttcacttcagccagcctctcactcaaaggctttctcttttggcataagtcaattcctgcccgtgtctccaagtttcaaaagatacctaacaagatctctttgaagttctcacatgatggagggtctggggatggggtggtaaggagtgtcaaataggaagaattcacagctaaaggtaaagtacagatcacaaaacctattttcatgcacgttctttagaagtctttgatagatgggctaatactttgccttggaatttgacagtatttggcatctttggttttggggcccagtgaaaactagaacgaagagttctattttaactctatcttccttctgtgcaatttctccggtactgttcagcctcctagtagaagagaaagatggttgggtctaagttgtatcaaatagaaatgataaaaaatagagtagcaaggggctttgggctctggcaagagtgactgaattgatgcatcatagaatcaaactggagaaggaagaaaggaagaagattagtggcctaaagggctcaggaagttggagaatgtagaaatagttgagtaaacattctggaaagatactttaacagctgattggctaaaggaaagggaaacgagatacagtggaatggtctttgggatttggagccttatggatgagacagattatggaatcattcacaggattagagtactggggaagagaactggttttcagggcataatgataaacttcattttgaataaactgaacaggagaggataatgagacatctaagtggcatagagggctggagttcagaagaaacacaggattcaagatatgcctttcagagtgaagaccagaaacattattgggggtcaggattcagtgatacctccaaaggagaaaatgtgaagactgaaatgcaggggttgaggaccattttgttaaaggaaagggtataatgagaacctgttaacacagaagaaatggagttctctgtcattcaagacaaagagctgcatctgagtcaaggtaatctgctctgaatagtgcttcatccaaaaatatctcctctttttttcccaatcatctttattgtctggttatgcaagtaaaccttctacctcttaagcctcaggttccacatccataaaatgaatacaatattactatctaccttccatggctgtgatgaggatatagtgaggcaaggggtgatatgcctggcacagagtacaaacccaaccaatgtgagctacccttatcattgtcattattattattcgtcacatttgcctctgtttaatcaataatcattcctttacaagatgagtatcccaaacttacttccaaatactttgtcatttttttcactcctcacttagcctttctgtctgattcaaatggcacggggaaagagagaatgactcaaacatcacagattgctgttaccctggcatggttaagataattatgtcgccatcaggatactggtttgactctgaagtctcatgttcagtggttactgtttcctctcagggactgtgcttaaggtttagagaaatcgtcgtcatctagatgatcgttgctcaattgaaacatttatttgctatattagttttctattgctgtgtaacaaatttaatgcctttaaacaacaccccatgtattagctcacagttctgtaggtctgaaatctgggcaccacatggctgaaatcaaagtgtaagttgtgctgtggttcccctgggatgcaagaccctcctacaagctcatagttgctagaattcagttctgcgtggttgtaggactaaggttctgttttcttaagagctgttggctggggatctctctcagttcctagaggctgctcctctccatcagcaattcgctacatagctgtatgctttcttccaggccagcaattacatttctctctgatttcttcctctgctaccagtcagagaaaatgctctgctcttaaaggactcacctgattggtgcaggccacccaagacaacctcccaattgccataaacatcacaattaagagactgatacctcatcagattcctatcttccacctacactcaaagaggaggagattacacaagggcaagggtggttggaggccatcttagaattctgtctaccacatttacttatggaacagcgtttatgccctaggcattgcacaaagcactgtagggacaaagatacattacagttgcctttgagatgttcatgctgtagtccagcactatcaaatacagaagccattaaccacatgtggctactgagcatttgaaatgtgattgatctaaattgtgctgtgctgtaaatgtcaaatgcacagaggatttcaaagaattagtagcaaaacagactgtaaaatatctcattaatatttgtgtaatgactacatattaaagtgataacatttaggagatgtcgatttaaataaaatatattattaaaatgaatttcatctgttctgtttacttttgtaaagtgtctaccagggaacttccaatcacataagtggctcgcattatgtttctattggacagtgctggtctatgtcaagaaaaacaataatcacttcagagtgtactaggtgccataacaggagaagccagcagtgttttggggtcacaagagggagtggtcagtttagctggggaagagagtgaaaataggaaagacttcaactgcttggtttcccattcatagcagacaaggtagagcctgattttctatgcaaaaaatcctttcccaagagatagaaattctttatataaaactgcagagtaattactagagactttttattttagaaggcacaattcagagcaaaattttaaaacaaatacaaatgcccaaatgcacattagcacttctctgacaaacttttaactgttctgcctccgcctgcacctttcttgtctttctcttggacaccagcaggcagctaattccctctctctgagctactttgtagggtcaaaacttccagttgctcatcacaaagagcagcctgtcttcaaaattcctcataagcagtgattctctggcttttgatctctccaatagagggcagctattaccagcttaattggagtgtaattaccttctcggccctcccacttagttcaaagaggtctctttggcttcctagcttatgacaaatcagaaaaagaaatattgaaatgtgatctataaaacttttttctatggtggctttttgtcccattgggagtttctctatcagtttttgttgttgttgtttttggactaggccatacttcccataaggacccacgtgaatattttgtactcattagacaaatacttttacacgcaaatagttaatacttgttaagtacatgctatgtattagatgccttgctaagtacatcctctcatttaatcttttcagctcaaaaaggtaacaataataacataatactaaaagttagagtgcttgctatatgccaggtacttttctaatctccttttatttgtgatgagttaatttaaggagttaaggctcaagtgagctaagagatgggaaatgctaagaacagtgtctagcactaagtattcaataaatgttaattaatatttaatcctcgcaaagacgctgtgtcataaaaaatattgctatcattcctattttacagataagtaaactgaggcttaaagagcttaaggtccttgccctagatcagttgttctcaatctttaatgtgccccaaatatcatctggagggtttgtgaaaacacagattgctgggccccaccccgagattctcatgcagtaggtctccagcaggccttggggatttgcatttctaacaagttccccagtgatgcccatgatgctgcccagaggagctcactgctctagatcattgagttaataaagatttcacccctggctgggcacggtggctcatgcctgtaatcccagcactttgtgagggggaggtgggtggatcacctgatgtcaggagtttgagaccagcctagtcaacatggtgaaaccccatctgtactaaaaatacaaaaattagccaggcatgtttgtaggtgcctgtaatcctagatacttgggaggctgaggcacgagaatcgcttgaaccctggaggcagaggttgcagtgagaagagattgcaccactgcactccagcctgggcaacaagagagaaactccctctcaaaaaaaaaaaaaaagaaaaagaaagatttcaccccagctcttcatactctgcacgagtattcaacactctctctttgtcaggttatattaatggagcttgaaatgtctaacattcaagctaatgtcagaacatagacaactttaagtaaaccataaaagattttaaagagacagtagaaaatgactggcttacatcagatattggaaaagtctgaaccaaacagagcatcagctctctttctaaggagcatgccattcatagattctcatgaataagggtactttgctcacttccagcaactccattttttaaagttttctgttttagcaactcatagatgagttttagctacccatgtatgctggcaaagctgagtattatctttcctggctatgtatgtagatggaccgtggcatgtaacttatggcttgtttgtgtagaagagtgatacacaacaccttcatgagaagtgtttttctgcagagaggaaaggagcgctgtgggattgagaggaatttacaatgcttttaattaaaaaccaatgtttttgttcttaaaaaaatttttgaagcaattctagcaaaatgttggtatttgttaaaactgactggtaagtacacaggcatttattatactcttctggatatttttctaaatctttgaaatgttttataactacatattttttaaaggcccaaggcctactatttactacaaaaaaataaaaacgacaaaaacacagggagcacaagcagatacagccccagctcccacaggagtcactgccccctgaaggaaggaagtagcccataatcaaataatcatagataggcacatagttacaaactgcgatcagttttacaaagctaagggctggagtgctatgaaagcttctaactctggtacctgactaggactccaagtcaaggaatgcttctcagaagaagtggaaattcagctatgagccaaaggctacataggtgtttactaggacacgtgggttagggcacaaaaagaactatcaaaaggccaggtgaggccaggcacagtggctcacacctgtaatcctgcactttgggaggctgagacaggggtatcatttgaggtcaggagtttgagactagcctggccaacacggtgaaaccccgtctctgctaaaaatattaaaaaattagctgggcatggtgatacacacttgtaatcccagctactcaggagattgagccaggagaatcacttgaaccaggaggtggggaaagaaaagaaaggaaaagaaaagaaaagaaagagaaagaaaggaaggaagagagagagagagaaagagagagagagggagggagagaaggagggagagagggagggagggaaggaaggaagggaaagaaagaaaagaaaagaaaagaaagaaaggaaagaaagaaaaagaaagaaggaaagaaagagaaagaaagaaaaggaaggaaggaaggaaggaaggaaggaaggaaggaagagaaagagaaagaaagaaaggaaggaaggaaggaagaaagaaagaaagaaagaaagagaaaaagaaaagaaaaaagaaaagggagggaggaagggagggagggagggaggaaggaaggaagggaaaagacagagaaagagagggagaaagaagggagaaagggacagagagagagaaggaaagaaagaaaatagagtggaactacaaatgttaaaccttgagtattaaggatctgttctataaccagtgtcacaatggcaaactaactctccaaaataggggggaaacatgtaataaatcagaagaaaactatgatttcaatctaaccttgagtttataaatctcattcattctttgcttccttatgcgtagaatgaggaatcccttgcagggataaaaccttcattattttatgaaatgaaatgaggtcttttatgatcaagatttaaattatgttcattaacggttatagctttctagtttcattgtcagggcgtggggacacaaaacatctgccatctgcttgctagtggttgctgactcgtaaaatggcattttccctcttctctttacataatcatcactgagactagttaagtgatttgactttgcctttttaacacctagtcttgagcctactgtgaggagtcatctaataagtcaaatatctgtataactactgtaagcattttttatatccaaattttttttcctccaggacctaagattaattctaccattaaaattttaagtacctgattttctagagcctctctaggtactggcttactgtatgcaattgtctgaggtcctcaggcatccctggctttctaaagaagttgaaaagaaaaacataataataatcagggctgatgctatctcactaatcccagtttggtacaccatagctgttttcaatagcttttatgcttcaggttatacagaaagtagaattttccaattacaattttttttttaagactgcaatgcaagagtggtccctttgacaaaggagattcttaggcagaatctcccagcgtcattgacaatgggccacaataatttctcttctaaaatattcctacatgattcgtttattgcactaaataaaagtgaatggtggcacatgctcacatggaatatcatttgaaatctctccaagggcttcttattactttaaaaacaccccattacagtaatttattgttacaccttattcactcgtgcttgcttcaagggctgtaattagaacctggagagccatccaggggcacatggccataggttggccatattgctccaagagactttctaaatttttattatggacatgaattttcaaacataccccaaattagagagaatagcacaatgaaccaacatgtacccaacactcagctttgataattatcaattcatgacttttcatgatctcaccacctttccattcactcaatcatgttttagattccagagaggctttcaaaggaagtcgtggaatcttctgtggcaataacaaccattcacattcactcccggagatgtagactttcttgtggccttacagattgatcacagccatcaaaggaggaatgaacacgtttcctgaggcactctatttacatactcagggtttttcatcaatcatgtaaaagagagttacattttcaggtcaaagtgactcatcaagccagaggggtgagtcatggaagacatatgacgctttccagtttaacctgctgtgcgactatgaacacctgtaacagtcatcttgccataaatctctccctgacctttctgtgacaagagaaactgctaccaaatcctgaatcctacctgtatagtaagaaatgatttcagtgtttattgcagaaatcttctatttggagaatttaaatttaaatcaaattcagaggcaaattcatatcttactttagaagtaaagcaaatcattggaaaaagcactgggggagagagattgagatagagaaagagagagattctctttcaatcagcaattctgtgtctattagtttttcttgaaataagcaagtcttgaaagatgtatgtactgggtgtttattgcagtagattgaatattacgaaaatattgaaaattatccaaaaatctaaggctatgaaacttaattatggaatattcatacaatgaaatattatgaagtcttgaagaatgataggaaattgtgatatattgttttaaaagttgtatcttcaataaatagtgaaaagaggaagatatcagaaaaacctacagattaaaagagacttatgaaactttttttttaatgggggagacaagttctcactctgttgcccaggctggagtgcatagtgtgatcatggcttactgcagcctcaacttcctgatctcaagtgatcctcctgcctcagcctcccaagcagctgggactataggtgcacactaccatgtccagccaggaaacatattaaccagttgcaatgtactgcattgccctcataagtctaagcatgcacacatacagaatattaaggaaatgtaaacactgaccaattattgaattatactatggaatttttataattatttttaagtgtgataatggttttttttttagttctatattttagagaaaaaatactatgctgattggagaatgtaaagatatagatgaaacaagattgaggaagtttgaaagtttactatacacttctctctacttatgtacatgttgaaaatgatccatttgttaaaaggtttttttaagttataaaacagtgtgtatactgtgaccctatttgttaattattttaatatcttttttcttattcttctataaaagacatgacaatattttgaggtaaaaatactttttacttattcatgtatttattttttgagatagggtctcactctgtcacccaggcctgaatgcagtggcatgatcttggctcactgcagcttctgcctcccaggttcaagcgattcttctgcctcagcccctgagtaactgggattacaggcatgagccaccatgcctggctaatttttgtatttttagtagagacagagtttcaccatgttgcccagactggtcttgaactcctgacctcaagtgatccgcccgcttcggcctcccaaagttctgggattacagacgtgagccaccacacctggcccaaacatactttttataataaataagtaatttgacaacttgaactgatttactctagccattaatctctcaaaatttgctgttttcccattatatctaatatactactgagtttacagttcataaactattaaaaatgacagcgtgagatggactcacatgttgtctcaaattaagatcttctattatcataaggcccatccatcagttgtgaggtgacttttatcctgtggccagggagcctgataattcatgcctggggcaagcaaggagatcaggacaactcacgcgaaaccccggactttccagttttcatacaaagctggactttcataaacaaaacaaggaaagaaactgagcatcttaacaggcgaatttaggggaaaaaacaaacaaacaaacaaacgtcttttttatataaatgatttgagtaatttagaaaaattttaagggccattttgcctaaattaataagaaaatgtgattgctccaggtaccaattttgctcttttaagatggccgggtttacctcagctctcagaaaaaaaaacaaatcatcccaccgtaacattttcacactcctaaaataagctttaaattttatttatttatttatttatttatttatttttgagacaaggtctctgtttcactcaaattgagtgtagtggcatgatcgtggctcactgcagcctctaactcctgggctcaaatgatcctcccaactcagcctcccaactagctaggactgcaggcacgcaacaccacatctagctattttttttattttttgtagagatggggtcccactgtgttgcccaggttggtctcaaactcctagatgcaagtgatcctcctgcctcagcctcccaaagggctggattacaggcctgagccaccacacccagccaagttttgagtgggccttcctgaaagtgaaagtgaaagtgactgtgtgcatatacaatggaattggaataaattaaatgtaatgaacttctcacatcagcctctgttgatgggtgggctgtgctatgtacttgctcttgcttaaagacccaaccacacatcctgtgtgcaggaaagacagcagtttggaaattgcaggactgtgattctgctcatgccctccaaggctccaaactgtttgactagaaaattctgctttgcttctggtgttggtctccgcttgctaggtctctcaactgcaggccctgagccctatctcaggtaactaagttctgccccactcaacttctgagtccaagttcatcatctgtccagagtgagtctttgccacaccagagtagggtggagtgggccttgctaccctgccctgtagccagatgggtgctaggtctggaggcttctcccctgaccccttgtcattcacaatagcacctcgggacttctgttttggttttctgaatgttcccctggcccatacccagggggaagcccacagtctcagccccctagaagtggccccttttcatcctgtagtaaccacaggctgaggtctgattcccttcataagggaccacctgaaactacactgccccctcctggatgccattcctcttgctatgacatccatgcaagcaactggccgcccccctccacatgagacacccaaaaattttcttgggatgggattgaactctaatttgctatacctgtaaaacataattaggaccgtagggtatgcctcagtggtaatacagaagcaggagccgactgataaattttcaggatttttgcaagttggactgttaaacacccccagtattaaaatttgagtcatataaacttttaattaatctatactaaaaataaaggtcatactcaaaactcatcacttcttatcttactacattttactactgtctatgctctgagttatttacattgactgtagtgttatttgtatgactgtagtgttatttgtatggtggaaattactccacttatcaaatcatggttgaattgcaaccatcggttggctatggagacaagagttcagtaaaaatcaatgaaagcattctgtgagagtcaattggccatatgggacttaaaataagggtattgcatattttattattatttataaatggcatgctactcatccttttttgtatcaataaaatttataagttgatgtattttattttccaaagagcctattgttaagcatttcccagcacaccactgtatcccatctaccggactgtgagcccagttctatggtctcatccacaacttcggttctgctcacctcctgcactgactttgagactgttggagaacaggaggctcatacccaacccactcttaatttatctcatccatgtggcaggacatccattagcataacacacctggcttcggctccccgccacactcctctaggcaaactgacttacccggttggtgaatttggaagaaaaactgtgtcatatatagcttagcttttttccttttcttaggagctacccgcaggaggggcatctttctccagaggcaaagcctgccttgttctggtgttgcctgaggctgatgggcaagttggtcaaatcccaaagtttagttgataagaactgcacttgcttgaagatagaagctatgctttcccaagtagcattgatcaataaggagctacctgcaggtagcaggtttctcaggaggaatgtccagcatcccattcgaggtcctgggggagaaggtcacaaagaaaccagtacatacagagagagaggccacaggacttcatcaagctggggtctgcccaggcatgacctgggagctgggccctgtgtgaaaaatgcagcctttcctcagatggaatgtgtgcccgtcacctctgaatcaaggtttctttccctggggtcaatagttgtgtaaatagctcagggactgagcaaacagtttagcaattacttggggaatgactgagagaagaagaaaatatgtacatatcatgcattctcaatcaggtagtattgcccccaatggggtgaaaattggttcttgagaactcaaaaaaatacacagtatatctatgatattaaaatttcatagaggggttgattaagaaaaacatgtcttaaccggctccttaggagagcaatgatttttttaatggttgaaaaacatagatgaatataaagaacttaacatagcatgtgacacatagtaggtattcaatacatgagaaatgtagttgctattatagtcattagtcgttattatgattgttctacaaactcattagagaaatcatccagacccatcatagttagggcagagaaggttgtgctgtgccaagttcacagatgaagctagcttttggcggattttgcctgagctagaggtcagaactgcccagggttctagaaaacagaaagattcttgcacactgctgggatgagcagaaacatttgtgtacacagtgttaaaataaaatttaaaaagtggggcatggcatgaatgtttaggctgtgttcagactttcacaatgcctgctatcatcctctggggaaaggacatgattaaggcatgaatgtagggttggggaaaatgctgggcaacttctcatacatgctgcatgtgctctgcaggtttgtaaaaacctaaatatctaatgaatattgtttttgtttttggtttttttttttttttttttaggcagagtcttgctctgtcaccaggctggagtgcagtggcacaatcttggctcactacaacctccccttgccgggttcaagcgattttcctgcctcagcctcccgagtagctgggactacaggcgcccaccaccacgtctggctaatttttagtattttagtagagatggggtttcagcatgttggcaaggatggtctccatctcctgacctcatgatccgcccgccttggcctcccaaagtgctgggattacaggcgtgagccaccgtgcctggcccccaatgattattcttaaaacctatgtttgtatgactctcagtgtacaaatgtacacttatttaagtgtaaattaattaagtgtaattaaataaattttaaaatgtaaattatcaacaattgtggaaagcagtgtagtgattcctcaaagaactaaaaacagaactaccattcgacccagcaatcccactcctgggtatatacccaaaggactgtaaatcgttttaccataaagacacatgcatgtgtatgttcattgcagcactattcacaagagcaaagaatcaacctaaatgcccatcagcagtactctggataaagaaaatgtggtgtatacacaccatggaatgctatgcagccataaaaaagaacgagatcatgttctttgcaggaacatagatgaaactggaggccactagccttagcaaaataatgaaggaacagaaaaccaaacaccacatgttctcacttatgagtgggagctaaacaataggaacacatggacatgtagaggggaacagcaagtactggggtttacttgagggtagaggaggggagaagggagaggttcagggaaaaaaaaaatgttgggtactgggcttagtacctgattgacaaagtaatctgtacaccaaacccccaactcaggagtttacctatataacaaacctgcacatgtacccctaaacctaaaataaaagttaaaatattttttaaaaagtggtttcccatataatatcttatgaaatcatcataataaccctgcaaattcagtattagatccctacctgaaggatgaggaagcagaggctcagagtcctctcagttatttgttctttttagctacccagtagtaagtatcagagcaagctttatttctaccgtactccaccacctctttaaaatccctttcccacagaggaggaggacataggaaatgctaaagctatggagcaaaagccacatattgggacttggggactccctggtaagggatacgatagtgcctgtaagtggacataaccaaaccatgtaagaagtgggtattatgttcatggagtatgaatctagcatatggcagaacctactgaggctggtcaaagtcatctactgccaagttatagggaaatgaaaacccattaaaatagaatatggaagcatcacaaggtgctgtgaagctcaggacataaaagacttaggagcacattgagaataaaaatataatatgaaaaatcaatgactaggtacacagttggtgctggagtttattttaaggccatagcttcaaatgtaggaatgatggctatttggctaagagtggagagaatttttcaaagactgaaaagaatgtgtttagtcagagactaactcatctggccagaagggctgtaaatggaaaacagatgggaaaggagaaaaaaacacctagataaaactgaaacgggtttccatggatgatattaaggagggcctgggaagaatttcaacagtgagggaggtgccgcatagttcaatgagaaaacagctgggaaggacatcagaaacaaaacataggcagcagatgtccagatatcatgcacagaacatgagcaacgtggtaaccttgagattacagcacagggtgacaaacaagacctcacagataccactgagagttggcgggctggaacagatccatgggaacatagtgatagaagggtgtgctgtgtacaaaagacctgttgagaggaggagaagctgcactgtaggctgtgataacaatagattgagaggaatctctgaacacttggatgaagatgaaaggacagaggaacacaagtgacgtttttgtggaagcacagctgagccacatggaggaaagccacaaaattggcacagtacccacaattaatgaggataagattcaggatacttcattcagataaaagcagaggttttcacttgcctctctaacaattttatgtcctagaaggtagaggaaggaataaaaacaactgtgctctgactgattccaatccttaggaagaagccacctggcaaagtggaaaggatgagaactagagaatgtgcctgtcatcttcaggggagagcctgatggagctagaacaaaggtggatacaggacttcaggaagttagactccaaaatattttaagaaaatatggcggccaggcgtggtggctcacgcctgtaatcctagtactttgggaggctgaggcgggcggatcacaaagtcaggagatcgagaccatcctgactaacctggtgaaaccctgtctctactaaaaaaaagaaaaagaaaaagaaaatatggcataattccacaagtttctagaaaaggaaacagtatcaacaagcactcaaaagcatggctttggataattccaatgagaagacaagagagaaggggagactctcaaagaaactagtgatggcagagccctttaagcaaggacgtagaatggatgttcaaaaagatggaggtaggtgatcactgcatgagagtggcaaagaacaacagaaatagtagcagggatgttaatatcctggaaggatcaaagcatgcaaaaatgggaaggaccagagagagtgttatggggccaatgggattacaataatggatggtagaaagtatgcactatttctcaaatgatgtcacattcttttaggccctgtcgaggaccgtgattgtaggactgaaaaggttgtacaaaagtgaatacgtgtatgttgaaattcaagtttggggaaatgttactgatcctttttgaaatctaatctaggatcaaagtttctggtccacagtctgggaatcaaagagtatacatttgctgattttcaaacgttcttattcctaagtattatgaatcgcatttcagcaagttgatcttcaaattcatcttgcagaagcttgggagtgagcttgggagtgtaattcatttgggtgagaagaactgattccatttttcgatcatctgcatattctcttttattatcagaatttttcaactggatatgtccagctgaaagcttaaaactagctaactagctgcagaaggacagtttccaaggtcctcagcaggatgctgtgtgtatctctag

SEQ ID NO: 1303 - DNA, 18125 bp, Homo sapiens; identical to SEQ ID NO: 1302

SEQ ID NO: 1304 - DNA, 1507 bp, Homo sapiens
gccaaccacgtccctcctttcagttcgtccaggctcggtcactgcacatctgttattcagttcactcacagacagcaaaccaaggggttgtgctgtctccttgtctcccagggataaacccacatgacagtttacaaaaacaggtaatcataagaagcaaatggcccagatgaaacacagcaaaagaatgagaagtggtaacactgggagtgaaatttgaaccaagcgtaaatggagtgatcgtagaaatagctgactgtggaatgtggacactctctgtatctgcagcctgggaagcttaaagaaggtgaacttactgacaccagttagaaagtgactgtgatgaaacgatgaagatgctccagaggaagtgacaccagcaataggaaaaaaaaaacaaacctctcactgaaggaactctcggagatatttcatgacacagaaggcacaaaggatacaatattggcaactaatcgaaacttagaaatgatatgacagctcaccaaggcatagaaaaagatgcttgctctatcataagttatagaatgagaagaagcagtatatcagaaaactcaaatataactccacaactttttcaagagtttctttttgttttccaatggtaacgggagagaaaataagctgtcattatcggaatgatcaaacacagagagaaaagaggcagaggtgagaagatggagaagatgaatacatttgctttcagcaaaccaatggaagtccatttgcatgatctgaaaaggaaaatgagaagctaatttttctatacaaggcagaatttaagaaatacaattcctaaggactccagtggatacagctctggttcctggacttcgtgttttggcttggtctttctgctttttcaattttgtcactggtgtgatccagagaacatgcctttcactgtgaaaaccagcaccttcaaggccaggcgcagtggcttgcgcctataatcccagcatattgggaggccgaggtgggtggatcacctgaggtcaggagttcaagaccaacctgaccaacatggtctactaaaaatacaaaaattagcccggcatggtggcgggcgcctataatcccaggtactcgggaggctgagacatgagaatagcttgaaccagggaggcggaggttgcagtgagacgagatcacaccattgcactccagcctgggcaacagagcaagactccatctcaaaaacaaacaaacaaacaaacaaaaacaccacacaaaaccagcaccttccacagtgtctagcatacgttagtcaccaaaacaggtttgctaaatgaacaaatgaatgaatggcattttatgtgtcagtaaatatgcttcaaaatcatgatgtatgatgagtaagcaactctatcaaataaatataacgtaatttgctgtgagcacataatttgctgtgttctagtattgaacagttggactatttccatattttaatttttactattatgtttgaggatgatatataaatctt

SEQ ID NO: 1305 - DNA, 1507 bp, Homo sapiens; identical to SEQ ID NO: 1304

SEQ ID NO: 1306 - DNA, 8126 bp, Homo sapiens
ccaggctcggtcactgcacatctgttattcagttcactcacagacagcaaaccaaggggttgtgctgtctccttgtctcccagggataaacccacatgacagtttacaaaaacaggtaatcataagaagcaaatggcccagatgaaacacagcaaaagaatgagaagtggtaacactgggagtgaaatttgaaccaagcgtaaatggagtgatcgtagaaatagctgactgtggaatgtggacactctctgtatctgcagcctgggaagcttaaagaaggtgaacttactgacaccagttagaaagtgactgtgatgaaacgatgaagatgctccagaggaagtgacaccagcaataggaaaaaaaaaacaaacctctcactgaaggaactctcggagatatttcatgacacagaaggcacaaaggatacaatattggcaactaatcgaaacttagaaatgatatgacagctcaccaaggcatagaaaaagatgcttgctctatcataagttatagaatgagaagaagcagtatatcagaaaactcaaatataactccacaactttttcaagagtttctttttgttttccaatggtaacgggagagaaaataagctgtcattatcggaatgatcaaacacagagagaaaagaggcagagatttggcttctggcttgctctctttgtttgggtagctaggcatgaaaaagaatcatctgcaaccagagctcaacttaattcccagttcctctctggaaactatctgttggcatcatgaaatgttctgtgtaaaaggccatgctttgactgatcaaaagtgggatttcagaccctccatcagagtctttgtggatgaaactcagccaattctcggaaagtgacagaagaggcctgcacctctggcataatttgcgtctccccagcatctcactgttcctgccaatgacaaacaggaacccccgacaatttttcctctctctcctggcaatgcaatgatggcccagctgttttctcactataaaaaggcagtcacttctctctatcactacagtctatagcaaaaggtctacttacattactgattgaacaaccatgtatcatatgaaaaaccacaaaagaaattcacaggagaggctctaagattgctgatcattttatccacatcccagtgtctacatctgagcatggtgctcggtagatattgcatgaatgaaggacaagaaatttggaaaaatactgcattgtctactgttttcagaaatatttatgcagggtaattttaatgtctgccattttcccttgggtcagggaagccactgtatgatattataattgctttgatttgtatcgtgttacctactaggttcaagacacattcaggagtgttctgaaaaacataatagaaattgacagaaaaaagtgactgaatagactttcagaaaatatgaaagattgaatacagaagtttgttttcccttttccaagcccctctaaaatgacaggaaaaataaaaataaaacatggatcccccaaaacaaaggaaacagaaagggaaatgaccacagatgatagacagccacaaaattttggacatggcaacccaagaggagagagggatgaggctacaggaggaggagtcaaccagaagaagcaaaccaatttatagctcagaatccccagaaagtgtcaggaattgaggatgccagctgcctctgaaggcaaattgaaaacaagacaatcaattaaaaatctttgtaaggagtaggcaaattctgaggtctcctaatcaaccctttgtggccaggtagccaactctccctactccagcagagcaccaaagatgtcctccctggagatgtggatgaataggtattccagacttgggaacaccagacacagctgaggtaccacaattaaatggagaaactaagcaaaaaatcacattataaacaaaaaatctgacccaactccacgcccttctttatgtcaattctcagaaatactgcattgtcattaaagcttagaactgtagacaggagagagaaaactagtcataaataactagaaataagaatagcatcatcttctcaatagcaacaacggcagcttgatctcaatttactctgattcaatcccaccctcacacacctcaaaatacttggttctgtggctttgacttcatgcatagactcctataaaatactagtgcttgcctcttaaagcatagcatatccatccagcccctgtgaccaaagaaatggtcttggctctcatcctaaagagatattaagaagcagccttaacaaaggaaaagaccagcatggattgtgcccctagaccttctattctttggatagtactttacccttaattccctgttctcctcttttgattataacctaattggcaactgtagcagccaatctcagatatgttcttgatttctgcaatgtagccaaaggcggatttcatcacattctcctttttttactttttgctggtgatggaaggagcaattggttcatgagcttggtttgatgattaaataaatggcttggtgacatttggagtgtcagctttccagatctgcaatcaccacaaaactgcagacacagataacgaacctggggtggagttgctgggttcagagaccatagattggatattacctcaccattagaacatcagtcttgatttccctttcttggctgcatttagaggctagatgcccgctcctccacaactatgtaatggagacaagaaggtggtacaaagaaagtccaccacagtttatggagcctgcagaagccagtgtgcttgacacacactgtcatcctgttgttgcaagtattctttttatagtggaggaggaggacgaagaggaggagatcacattttaaaaagaatgatctcatctttttaggtgagaagatggagaagatgaatacatttgctttcagcaaaccaatggaagtccatttgcatgatctgaaaaggaaaatgagaagctaatttttctatacaaggcagaatttaagaaatacaattcctaaggactccagtggatacagctctggttcctggacttcgtgttttggcttggtctttctgctttttcaattttgtcactgattccagagaggctttcaaaggaagtcgtggaatcttctgtggcaataacaaccattcacattcactcccggagatgtagactttcttgtggccttacagattgatcacagccatcaaaggaggaatgaacacgtttcctgaggcactctatttacatactcagggtttttcatcaatcatgtaaaagagagttacattttcaggtcaaagtgactcatcaagccagaggggtgagtcatggaagacatatgacgctttccagtttaacctgctgtgcgactatgaacacctgtaacagtcatcttgccataaatctctccctgacctttctgtgacaagagaaactgctaccaaatcctgaatcctacctgtatagtaagaaatgatttcagtgtttattgcagaaatcttctatttggagaatttaaatttaaatcaaattcagaggcaaattcatatcttactttagaagtaaagcaaatcattggaaaaagcactgggggagagagattgagatagagaaagagagagattctctttcaatcagcaattctgtgtctattagtttttcttgaaataagcaagtcttgaaagatgtatgtactgggtgtttattgcagtagattgaatattacgaaaatattgaaaattatccaaaaatctaaggctatgaaacttaattatggaatattcatacaatgaaatattatgaagtcttgaagaatgataggaaattgtgatatattgttttaaaagttgtatcttcaataaatagtgaaaagaggaagatatcagaaaaacctacagattaaaagagacttatgaaactttttttttaatgggggagacaagttctcactctgttgcccaggctggagtgcatagtgtgatcatggcttactgcagcctcaacttcctgatctcaagtgatcctcctgcctcagcctcccaagcagctgggactataggtgcacactaccatgtccagccaggaaacatattaaccagttgcaatgtactgcattgccctcataagtctaagcatgcacacatacagaatattaaggaaatgtaaacactgaccaattattgaattatactatggaatttttataattatttttaagtgtgataatggttttttttttagttctatattttagagaaaaaatactatgctgattggagaatgtaaagatatagatgaaacaagattgaggaagtttgaaagtttactatacacttctctctacttatgtacatgttgaaaatgatccatttgttaaaaggtttttttaagttataaaacagtgtgtatactgtgaccctatttgttaattattttaatatcttttttcttattcttctataaaagacatgacaatattttgaggtaaaaatactttttacttattcatgtatttattttttgagatagggtctcactctgtcacccaggcctgaatgcagtggcatgatcttggctcactgcagcttctgcctcccaggttcaagcgattcttctgcctcagcccctgagtaactgggattacaggcatgagccaccatgcctggctaatttttgtatttttagtagagacagagtttcaccatgttgcccagactggtcttgaactcctgacctcaagtgatccgcccgcttcggcctcccaaagttctgggattacagacgtgagccaccacacctggcccaaacatactttttataataaataagtaatttgacaacttgaactgatttactctagccattaatctctcaaaatttgctgttttcccattatatctaatatactactgagtttacagttcataaactattaaaaatgacagcgtgagatggactcacatgttgtctcaaattaagatcttctattatcataaggcccatccatcagttgtgaggtgacttttatcctgtggccagggagcctgataattcatgcctggggcaagcaaggagatcaggacaactcacgcgaaaccccggactttccagttttcatacaaagctggactttcataaacaaaacaaggaaagaaactgagcatcttaacaggcgaatttaggggaaaaaacaaacaaacaaacaaacgtcttttttatataaatgatttgagtaatttagaaaaattttaagggccattttgcctaaattaataagaaaatgtgattgctccaggtaccaattttgctcttttaagatggccgggtttacctcagctctcagaaaaaaaaacaaatcatcccaccgtaacattttcacactcctaaaataagctttaaattttatttatttatttatttatttatttatttttgagacaaggtctctgtttcactcaaattgagtgtagtggcatgatcgtggctcactgcagcctctaactcctgggctcaaatgatcctcccaactcagcctcccaactagctaggactgcaggcacgcaacaccacatctagctattttttttattttttgtagagatggggtcccactgtgttgcccaggttggtctcaaactcctagatgcaagtgatcctcctgcctcagcctcccaaagggctggattacaggcctgagccaccacacccagccaagttttgagtgggccttcctgaaagtgaaagtgaaagtgactgtgtgcatatacaatggaattggaataaattaaatgtaatgaacttctcacatcagcctctgttgatgggtgggctgtgctatgtacttgctcttgcttaaagacccaaccacacatcctgtgtgcaggaaagacagcagtttggaaattgcaggactgtgattctgctcatgccctccaaggctccaaactgtttgactagaaaattctgctttgcttctggtgttggtctccgcttgctaggtctctcaactgcaggccctgagccctatctcaggtaactaagttctgccccactcaacttctgagtccaagttcatcatctgtccagagtgagtctttgccacaccagagtagggtggagtgggccttgctaccctgccctgtagccagatgggtgctaggtctggaggcttctcccctgaccccttgtcattcacaatagcacctcgggacttctgttttggttttctgaatgttcccctggcccatacccagggggaagcccacagtctcagccccctagaagtggccccttttcatcctgtagtaaccacaggctgaggtctgattcccttcataagggaccacctgaaactacactgccccctcctggatgccattcctcttgctatgacatccatgcaagcaactggccgcccccctccacatgagacacccaaaaattttcttgggatgggattgaactctaatttgctatacctgtaaaacataattaggaccgtagggtatgcctcagtggtaatacagaagcaggagccgactgataaattttcaggatttttgcaagttggactgttaaacacccccagtattaaaatttgagtcatataaacttttaattaatctatactaaaaataaaggtcatactcaaaactcatcacttcttatcttactacattttactactgtctatgctctgagttatttacattgactgtagtgttatttgtatgactgtagtgttatttgtatggtggaaattactccacttatcaaatcatggttgaattgcaaccatcggttggctatggagacaagagttcagtaaaaatcaatgaaagcattctgtgagagtcaattggccatatgggacttaaaataagggtattgcatattttattattatttataaatggcatgctactcatccttttttgtatcaataaaatttataagttgatgtattttattttccaaagagcctattgttaagcatttcccagcacaccactgtatcccatctaccggactgtgagcccagttctatggtctcatccacaacttcggttctgctcacctcctgcactgactttgagactgttggagaacaggaggctcatacccaacccactcttaatttatctcatccatgtggcaggacatccattagcataacacacctggcttcggctccccgccacactcctctaggcaaactgacttacccggttggtgaatttggaagaaaaactgtgtcatatatagcttagcttttttccttttcttaggagctacccgcaggaggggcatctttctccagaggcaaagcctgccttgttctggtgttgcctgaggctgatgggcaagttggtcaaatcccaaagtttagttgataagaactgcacttgcttgaagatagaagctatgctttcccaagtagcattgatcaataaggagctacctgcaggtagcaggtgtgatccagagaacatgcctttcactgtgaaaaccagcaccttcaaggccaggcgcagtggcttgcgcctataatcccagcatattgggaggccgaggtgggtggatcacctgaggtcaggagttcaagaccaacctgaccaacatggtctactaaaaatacaaaaattagcccggcatggtggcgggcgcctataatcccaggtactcgggaggctgagacatgagaatagcttgaaccagggaggcggaggttgcagtgagacgagatcacaccattgcactccagcctgggcaacagagcaagactccatctcaaaaacaaacaaacaaacaaacaaaaacaccacacaaaaccagcaccttccacagtgtctagcatacgttagtcaccaaaacaggtttgctaaatgaacaaatgaatgaatggcattttatgtgtcagtaaatatgcttcaaaatcatgatgtatgatgagtaagcaactctatcaaataaatataacgtaatttgctgtgagcacataatttgctgtgttctagtattgaacagttggactatttccatattttaatttttactattatgtttgaggatgatatataaatctt

SEQ ID NO: 1307 - DNA, 8126 bp, Homo sapiens; identical to SEQ ID NO: 1306

SEQ ID NO: 1308 - DNA, 1140 bp, Homo sapiens
ccaggctcggtcactgcacatctgttattcagttcactcacagacagcaaaccaaggggttgtgctgtctccttgtctcccagggataaacccacatgacagtttacaaaaacaggtaatcataagaagcaaatggcccagatgaaacacagcaaaagaatgagaagtggtaacactgggagtgaaatttgaaccaagcgtaaatggagtgatcgtagaaatagctgactgtggaatgtggacactctctgtatctgcagcctgggaagcttaaagaaggtgaacttactgacaccagttagaaagtgactgtgatgaaacgatgaagatgctccagaggaagtgacaccagcaataggaaaaaaaaaacaaacctctcactgaaggaactctcggagatatttcatgacacagaaggcacaaaggatacaatattggcaactaatcgaaacttagaaatgatatgacagctcaccaaggcatagaaaaagatgcttgctctatcataagttatagaatgagaagaaggtgtgatccagagaacatgcctttcactgtgaaaaccagcaccttcaaggccaggcgcagtggcttgcgcctataatcccagcatattgggaggccgaggtgggtggatcacctgaggtcaggagttcaagaccaacctgaccaacatggtctactaaaaatacaaaaattagcccggcatggtggcgggcgcctataatcccaggtactcgggaggctgagacatgagaatagcttgaaccagggaggcggaggttgcagtgagacgagatcacaccattgcactccagcctgggcaacagagcaagactccatctcaaaaacaaacaaacaaacaaacaaaaacaccacacaaaaccagcaccttccacagtgtctagcatacgttagtcaccaaaacaggtttgctaaatgaacaaatgaatgaatggcattttatgtgtcagtaaatatgcttcaaaatcatgatgtatgatgagtaagcaactctatcaaataaatataacgtaatttgctgtgagcacataatttgctgtgttctagtattgaacagttggactatttccatattttaatttttactattatgtttgaggatgatatataaatctt

SEQ ID NO: 1309 - DNA, 1375 bp, Homo sapiens
tcggtcactgcacatctgttattcagttcactcacagacagcaaaccaaggggttgtgctgtctccttgtctcccagggataaacccacatgacagtttacaaaaacaggtaatcataagaagcaaatggcccagatgaaacacagcaaaagaatgagaagtggtaacactgggagtgaaatttgaaccaagcgtaaatggagtgatcgtagaaatagctgactgtggaatgtggacactctctgtatctgcagcctgggaagcttaaagaaggtgaacttactgacaccagttagaaagtgactgtgatgaaacgatgaagatgctccagaggaagtgacaccagcaataggaaaaaaaaaacaaacctctcactgaaggaactctcggagatatttcatgacacagaaggcacaaaggatacaatattggcaactaatcgaaacttagaaatgatatgacagctcaccaaggcatagaaaaagatgcttgctctatcataagttatagaatgagaagaagcagtatatcagaaaactcaaatataactccacaactttttcaagagtttctttttgttttccaatggtaacgggagagaaaataagctgtcattatcggaatgatcaaacacagagagaaaagaggcagaggtgagaagatggagaagatgaatacatttgctttcagcaaaccaatggaagtccatttgcatgatctgaaaaggaaaatgagaagctaatttttctatacaaggcagaatttaagaaatacaattcctaaggactccagtggatacagctctggttcctggacttcgtgttttggcttggtctttctgctttttcaattttgtcactggtaagactggccccacctcacccatgaggagcacattttcaaggttaaaatgctgagttaattagagaaagtggtgttattaactgaatggcaatagagaagcagcagcaattgagggaaaggagatgataagttgttttggggcatggtgaatttgagatatcttgcagaacattcagatcaaggttcttatgacccctgaagttgtcacgtgttaaccagaaaacagatctgccaggtgcggtggttcacacctgtaatcccaacacattgggaggtcgaggcgggaagatcacttgaggccagaagttcaagaccagcctggccaacatggcaaaaccttgtctctactaaaaatgcaaaaaattagcctggtgtggtggcaggtgcctgtaatcccagctacttgggaggctgaggcatgataatcatttgaacctgggaggcaaaggttgcagtgagccaagattgcaccactgctctccagcctgggcaacagagtaagagtctgcct

SEQ ID NO: 1310 - DNA, 4336 bp, Homo sapiens
tttcaggcactgtgactgacttcctgccgcagaggctaagattcggctcgttcactccacatgtgcacacagctcctacctgcagaacacgcccacccttatgaaggccatgaaagcagtgacagtgctgtaggaaagagtaagctggaaaaagagaaggttcagaacgacagtgctgacgcagacatcacacagcgaacatcccccacttccctgaccagatacatccagaggggaggcaagtggagactggctgtctgtagggagtggagaaatggcaggtccagcttgggctggtgtcctcttcctcagaaagtgctgtgggtgaacccagagtctcagggagcagaagcccccctcgctggctttcttcacgcggggtcctcggcaagctgctctgcactgcggagaacgtgcgccttgtcctcagaagacgaggaagagcagggcctcatgccggggcagtacgatgttctccacagtgcgctccatggcgcgcacctgctccggggaggctgtcaggaacgccaggggcccgatgcgctgctccgcacaggagtggcagaggtagccccccttgttttccttcctgttgctctgtggtgatggacaagagagagagctaaggggaacaaccaaagaacatggattttccagcaaaaagcatggagttatcatcacagctgcccagggacaacgcatttggattctgatgttttcagaggggtgcacatcctcagagtaacacctcccacagcaccaccaactaggtggcctcaacacccccaaattccctgagctcagaaacagtcatttatccagtcaagataaagaaccaagaaaagctgcgctgggaccccagggaacagctctctctctaagcgtgtatcacaacccagcctcccagacctgcggcttcagcacagccaggcagcatcacgtgccctgacctctgaccctgggacagaccacacacctcttgtgcctctcatatgaaaagcccctaataaaggatcacacagctctctcttatctcctcacctacaacccagataagcacagagctcacaagcaaaaaatgcaaatggctgaattaagttccacagacagcagacgtacataggtgatgggcagcttcttcatggtaaggacggtgtcaacagggatggcattgttgcactgtcccacgcagcagcgcaccacgcctgtttttaagacgttgcttgtcagctctgcttgcaagaagtactcctgagaaagaaagagcgagaaagagagtcatggcgacacctccgttagggtctactggaaacactgatagcggcggctctgtgagaaccctttagatgcactgtaagtcccagagagaaaaaccccgcctaacccgttctcccttacttcctctaacttttccctgcctccaaagctatcgacagtccaactgacagtccaattgctttttaaatatatatatatttaacagataaacatgcaaaactattgcctgtaatgacatttccagaatatttctggattttattttatgctaaggtatccccagctcaatcttcagaaaactattgtgtattcacattataagccaggcaggcaacacagaggacatgaagaaaacttgccccaaacatccctgcgtatttccaccgtcccgtgctgctggctgtgctagtgagcaaatgacagcctcgctaagcctgtgtctttatccataaatgcagatggcacggtgcctgcttcaggtggctgctgaggagaagaaacccttcaatgcatgcaaagcactcacgcctggcacgcagggagcacccagaggaagcactagtgacctcccaggctggaaacaccacaaggacagggcactgtcagcttcgctgctgccctgtggggctccacatcacagactgatatgctagcaggaccgcacacatctgctgcccaggaaaggacggtttcgtattttctggattatgaccagctattgatctacttattctacaatctgtaacctacgttttgatttatttggtcttttctcttagacggcctgcctaccagctatgaaaaagaacagaaaaccaccaggcaaacactccagttatggccaacaagtactaacagctgacgaggtgaaatcctgtctgaagtcacagattttgctgaagtcccttggactgtcatctcaatttccttcccgagagacagccaagaccatgaacctggcgaggtccctccaacccacggtgaaatagcttctcgtttacacgtgtccaaggacacaggtctccttttatagatgtctaatttacatgaatgttacgcttctggcttcctcctcacctaggttttctaaaatgctgtagaggactcagtcacagcgctctcttgtatttcatttacccattcccttgctgtggttactcggttgtttccaaactatttccaacaatgcagcaatgaacatcctgtacctgactccctgtccactccagaagtttctccagggctaggctctcaagccgtttttgacgcagttaccattataatgctatacatacgcacatatgtaagaaacacacatggaagaaaagtttcacaaaacatgacttaacctaacatgcagtgttctctgatttctttagattttatgccatttaactctttttaagcctctcataacccaccagattaactgtttttatttatataaatttaaggggtgggggtcacacctgtagtcccagcactttgggagactgaagtgggaggatcacttgagcccaggagttcgagaccagcctgggcaacatggcgaaaccctgtctctaccaaaaatacaaaaattagctaggcatagtggtgcacacctgtagtctcagctactcgggaggctgaggttgcagtgagttgagatcgtgccactgcactccagcctgggcaacaaagcaagaccctgtatctaaacaaataaacaaaaagaatctaagattctgtgagaccaagaagctgtctttggccagacatagtggctcaagcctgtaatctcagcaatttgggaggccaaggcaaacggatcacttgaggtcaggagtttgagaccagcccagtcaatatgggtgaaaccccatctctactaaaaatacaaaaattagccaggcatggtagcacacgcctgtaatcccagctactctgaggctgaggcctgagaatcgcttgagcccgggaggtggaggttgcggtgagccgagcaagatggcaccactgcactccagcctgggctacagagagagactccatctcaaaaaaaaaaaaaaacaaaaaaaaaaacctgtctttgaaacataacttcatgtcacttaacacctcaacaatgtaataatttccttcactttcccaaaacttaaagaaacaaatgaacaaaatggcttctggtgattctattagctatattttctaagggggaggggtcaaagaaaaagaaggttgccctactcttgggagataaaggggcttatcgttctaggcagcgcaggaagcaatggctcgctttttatctccaaaacacccccgtccgtggctccactatttttaacacgctttcctagcctctgaattactgcccaactcgggatcttcattatccccatggccttccctcctgggcagagactggactcgacacttctgaaacaggatatccccaaatttattcacaggctgtgatcaacaacaacaaaaaaggctggacatggtggctcacgcctataatcccaacactttgggaggccgaggcgagtggatcacttcaagtcaggagtttgagaccagcctggccaacatggtgaaacctcgtctttaacaaaaaaaaaataccaaaaaaaattagccaggtatggtggtgtacacctgtactaccagctacttgagaggctgacacaggagaacagcttgaacccaggaggccgaggttgcggtgagccaagatcacaccactgccctccagcctgggcgacagagtgagactctgttttttaaaaaaaaaaaaaaaacagcagagtgcctccacttctaacaaggtcttacagccttaaaaaatctgttcccacaaataggcagtttttctgggacttcctcgcaggacccctgagggcagacagcccaccccagtctcagtaatggggaagtatttctctagattctgtattcttttcttctatggggaaaacaaaatgcatgcagcaaccaactgacaaccttccaatcagctttaaaaagtctacttcacttttttgtttgtttgttttgagacagagtctcactt

SEQ ID NO: 1311 - DNA, 535 bp, Homo sapiens
gagaagcagcagcagctgtttccttcaccaataaatatacttcattaccaagctagaagagaggggtgggaagagggactggggtgggaaggaagggggagaagctgccacctgtgttgctgggattaaagcaatgagatggtgccagaccccccaccactatcctcaccctccacttgtcttcttaaaactgtgaaaaagcttttaacatggccctcctgtctccagggctgctctgaagcctgactgagaggaggcacctggcagagacaggggctgagggagggagcgagggatagccaggagaggagcgagggtgctccacagcgacctcagcaggtggcctggtcttgcccactccagggctcccatccttcctttgggctccgctctaacactggtggctctggagggagggtgggacccatcctttttcaaaacctttcctgaagaccacaggggagctagccttgcaggctagggagcaagagtggcaacaggccaaggcgagcccttaccaattgggaatcccact

SEQ ID NO: 1312 - DNA, 1144 bp, Homo sapiens
tcccctagcaagaatgaggaagatgaagagctcgggtatctgagggctggtgtgtctgcatgcgtgtgtgttttgggggccgactgaaggaagagaaggctggagagagggaacatgggtctgagggcacatcgctaaggggtcaagaggcctaaaggaggagtctaaggctctccatcgaacttggacttggtctacattagactttaacctccatgaggcttggactttcaggcttcctccctcacaccgcgggcaggtgaggcgtctgctacaggcctggtctcgcagagggggcccagcgccccccgccgccgccttctcctggagtctgtgtgacagaatgggacctgtgggaaagcagcacgtcagcacccagccccgcttgcgcgccagcagctaattaaagccaggaaggtgatggcgattttcaactcattcccgttacaaacagccgaccttcctaccgagttcaagtaccttctgcctggcctggaagaacaatatctctctgtctccctcttccactggccctcacctgccttcccctgaacatgcattttgcctgacaggagacagaggcagttgagatggagtcttgctatatggcccagctggtaatgcctagattcttgagtccctccctggctcatccctgggagcagcactgaaccccttgtctgacacctgtctggaaatggagcctgcacattgaccctagatgcttgcagcttggtccaggaggccagcaggaccagagagaagaccacagcgacacatggggatggctgtcccacaggcagaaatgagcagccgggaggaagcccaggcagccagccacccagctccctccacatcgtggccctagaacggagtcttgaagaataagaagccacagcttgtcagggaatcaggctggaaaaatgttatgagactgagtaagaccagagtttctgggtcattggtgagactggatttcatagaagagtctttgctacagcaaaacctctcttcaagcaatacactattcaagctgctggaggctagattgaccagaaaaatggggccaatatcatgcctcttatggaggagcagtgttgaacttaatggagcatctctgcactcttcaagctgctggagaatg

SEQ ID NO: 1313 - DNA, 1144 bp, Homo sapiens; identical to SEQ ID NO: 1312

SEQ ID NO: 1314 - DNA, 1146 bp, Homo sapiens
ctccccccgcgtcttcagaggagcgctgtttctggaggagttaggggaaggaggctgcctggtaagccaggaaaggggcttctggccgttctgttggagcgcctctgactgacttcccccatgtgtccgtgtggccacaccgtgctactttcagaggcagtgggcttttcgctaagggataaaaagaagtaaaaccttgcctttagcgcagctctccttcactgggcagattgctctccctccccactctcccaggcccaaattggatctcagcgcctgggagctccaactttagcaagtgcgaaatcctgtcttcggttttggaattttcatccgcacagactatatcagccacggataggatatgtgagaataccagcatgtcaaggctgggaatcatccttaggcatcacctagccagtcctgcctctcattttaaggtgaggattccttcatctctgtgactggcttgcttgatggttagggtctgatcgctgcctgagacaccatatcggtactcctcagagttggtgatcacaggatctggtttgccactgaaaggaatcttgatgctgaccacttcacctcggagagcatgaactgctcccatgccttcaagagttttagtgggtaaccaggatggaactgcggtgttgcttgcaggagaagcttactactggtttctacttctccaacctcattggtggctatgcaggcactgtctccagactgtctatattcaacccagtatccaagaatttctttaccaccatcacattcaggtttctcccactgtagagtgacactatctttggatattgaaagaatctcaagttctcctggttggcttggtttatctgaaatattttaaaataatgaaaagggagtcagctttactggtgaaataaaaggaccaaacatggcttgcttctttaatttaaccccttcttctgaattccttaccaaatggatctttgcaaacaactggttcagaagcagggctggtctcactcaggccaacatcattctgtgcgatgatgcggaactgatactcagcatcgggaacaagccctgtgacagtgtacattgtggtggtgatctgagtcttgttgtgtctgacccacttgtcagtggatgtctctttgc

SEQ ID NO: 1315 - DNA, 5363 bp, Homo sapiens
ctgtaattttccattaccttcccaaatcctataaaacggccccacccctatctccctttgctgactctctttttggactcagcccgcctgcacccaggtgaaataaacagccatgttgctcacacaaagcctgtttggtggtctcttcacacagatgcgcaagaaatttggtgccgtgactcggatcaggggacctcccctgggagatcaatcccccgtcctcctgctctttactccatgagaaagacccacctacgacctcaggtcctcagaccaaccagcccaagaaacatctcaccaatttcaaatccggtaagcggcctctttttactctcttctccaacctccctcactatccctcaacctctttctcctttcaatcttggcgccacacttcaatctctcccttctcttaatttcaattcctttcattttctggtagagacaaaggagacatgttttatccgtgtacccaaaactccggcgccagtcacggactgggaaggcagccttcccttggtgtttaatcattgcagggacgcctctctgattatacacccacgtttcaagggtgtcagaccacgcagggacacctgctttggtccttcacccttagcggcaagtcccgcttttctggggaaggagcaagtaccccaaccccttctctccttgtctctaccccttctctgcttttccagggacagggcaagtaccccaaccccttctctccttgtctctaccccttctctgcttttccggggagagggcaagtaccccaaccccttctctccttgtctctaccccttctctgcttttccagggacagggcaagtaccccaaccccttctctccttgtctctaccccttctctgcttttctgggagaggggaaagtacccctcaaccccttctccttcacccttagcggcaagtcccgctctcctagggggcaagaaccccccaatcgcttatttccatgccccaacctctgatctctgcgccccaatcacttatttccatgccccaacctcttatgtctgtgccccaatcccttttttccacaccccaacctcttatttctgtaccccaatcccttatttccatgccccaaccctttctctgcttttctggagggcaagaaccccccaccccttctccgtgtctctactcttttctctgggcttgcctcctttactatgggcaagcttccaccttccattcctccttcttctcccttagcctgtattcttaagaacttaaaacctcttcaattctcacctgacctaaaatctaagcgtctcattttcttctgcaatgccgcttgaccccaatacaaactcgacagtagttccaaatagccagaaaacggcactttcaatttttccatcctacaagatctaaataattcttgtcgtaaaatgggcaaatggtctgaggtgcctgacgtccaggcattcttttacacatcagtcccttcctagtctctgtggccagtgcaactcgtcccaaatcttccttctttccctcccgcctgtcccctcagtaccaaccccaagcgtcgctgagtctttctaatcttccttttctacagacccatctgacctctcccttcctccccaggctgctcctcgccaggccgagctaggtcccaattcttcctcagcctccgctcctccaccctataatccttttatcacctcccctcctcacacctgctccggcttacagtttcgttccgtgactagccctccccctcctgcccagcaatttactcttaaaaaggtggctggagccaaaggcatagtcagggttaatgctcctttttctttatcccaaatcagatagtgtttaggctttttcatcaaatataaaaacccagcccagttcatggctcattcggcagcaaccctgagacgctttacagctctagaccctaaaaggtcaaaaggccgtcttatgctcaatatacattttattacccaatctgccccggacattaaataaaactccaaaaattaaatccggccctcaaaccccacaacaggacttaattgacctcaccttcaaggtgtagaataataaaaaaaaaaagttgcaattccttgcctccgctgtgagacaaaccccagccacatctccagcacacaagaacttccaaatgcctgaaccacagcagccaggcgttcctccagaacctcctcccacaggagcttgctacatgtgccggaaatctggccactaggccaaggaatgcctgcagccccggattcctcctaagccgtgtcccatctgtgcgggaccccactgaaaatcggactgttcaactcacctggcagccactctcagagaccctggaactctggcccaaggctctctgactccttcccagatcttcttggcttagcggctgaagactgacactgcccgatcgcctcggaagccccctagaccatcatggacgccgagcttcgggtaactctcacagtggaaggtaagcccgtccccttcttaatcaatacggaggctacccactccacattaccttcttttcaagggcctgtttcccttgcctccataactgttgtgggtattaacagccaggcttctaaacctcttaaaactccccaactctggtgccaacttagacaatactcttttaagcactcctttttcgttatccccacctgcccagttcccttattaggctgagacactttaactaagttatctgcttccctgactattcctggactacagccacatctcattgccgcccttctccccaacccaaagcctccttcgcgtcttcctctcatatccccccaccttaacccgcaagtatgggacatctctactccttccctggcaaccgatcacatgccccttaccatcccattaaaacctaatcacccttaccccgctcaacgccaatatcccatcccacagcacgctttaaaaagattaaaacctgttatcactcgcctgctacagcgtggccttttaaagcttataaactctccttaccattcccccattttacctgtcctaaaaccagacaagccttacaagttagttcagaatctgcgccttatcaaccaaattgttttgcctatccaccccgtggtgccaaacccatagactctcctatcctcaatacctccctctactacccattattctgttctggatctcaaacatgctttctttactattccttgcacccttcatcccagcctctctttgccttcacttagactgaccctgacacccattaggctcagcaaattacctgggctgtactgctgcaaggcttcacagacagcccccattacttcagtcaagcccaaatttcatcctcatctgttagtcatactcctattcactgttctcaactactcacacatgccctgctcttgtttacactgccggtttacactctttctccaagacatcacaggtgatatctcctagtgctatccccaaactgccactctaaactcttgaagtaaataaataatctttgccggcaggactatgctgaatctccttaggcactctctaattagatggcctaggtcctcccaattcttagtccttttatacctgtttttcgccttctcatattccatttagtttttcaattcatacaaaaccgtatccaggccatcaccaatcattctatatgacaaatgtttcttcttacatccccacaatatcaccccttaccacaagacctcccttcagcttaatctctcccactctaggttcccacgccgcccctaatcccacttgaagcagctctgagaaacatcacccattctctctccataacacccccaaaaatttttgccgcctcaacacttcaacactattttgttttatttttcttattaatataagaaggcaggaatgtcaggcctctgagcccaagccaagccatcgcatcccctgtgacttgcacgtatacgcccagatggcctgaagtaactgaagaatcacaaaagaagtgaaaaggccctgccccgccttaactgatgacattccactattgtgatttgttcctgccccaccttaactgagtgattaaccctgcgaatttccttctcctggctcagaagctcccccactgagcaccttgtgaccccccacccctgcccaccagagaacaaccccctttgactaattttccattaccttcccaaatcctataaaacggccccacccctatctcccttcgctgactctcttttcggactcagcccacctgcacccaggtgaaataaacagccatgttgctcacacggagcctgtttggtggtctcttcacacagacgcgcatgaaactgtcctccggggtccttggtccaactaataggtggacacagatcctttgtcaacagagcagggctggctgtgagcacagagtaggaacctcagcgctacctggggggtcaggcaggcttcctggaagacgtgaggctgtgctgggctcgaagggtgagcagcagtgccagtgccagggagaagggaggctgaggctgtacagagggagagctgtggaggtcaaggcccgggctccagggccagacttcctggagcttgtcccagcttcttcccttaggagcttcatagacttggactagttactccacctcgctgtgactcaatgtccttttctgtaaatggggcgttgcggcccaggggctgtggtcagatgaagctgcttagagcacatggagtgcttggagggggccctgagtgcagggggttcgtggcgtggctccgggctttactggggaggttggttccaggctgcctggagcccagcttctgcgggtcagggccacactgaggatgattcctcctggccctcagcccaggtcagacccaagaccatatgcagcgggcacacctgtgcagggcaccagcaatggtgcagggccgctgatgcgtccctggggccatctccgcagtgctggtccagggcggtcccacaggccatgttctggaacacgggcccttgggcatcctgtgaggctccccggcctcccgcaggcactcggacagtgcggcccaggggtgtgctctgagctcagaaagccgctgccccatccagacacatggcatcctcagtagcttctgttctgcaaaacatccagaaccctccggatcattgacctttatttaaaaaataaactgaaaaaattttaaagtcagtcgtttatggtgtagaaagaaacggtttaaattattgaagagctacttaacggttgaagtgaagcccgtagcaggtgacgcgtgactgtggtgcctacgggccactgcaagctgggtgcgaggagcatgcccagaccccagacagag

SEQ ID NO: 1316 - DNA, 9926 bp, Homo sapiens
tataaaacggccccacccctatctccctttgctgactctctttttggactcagcccgcctgcacccaggtgaaataaacagccatgttgctcacacaaagcctgtttggtggtctcttcacacagatgcgcaagaaatttggtgccgtgactcggatcaggggacctcccctgggagatcaatcccccgtcctcctgctctttactccatgagaaagacccacctacgacctcaggtcctcagaccaaccagcccaagaaacatctcaccaatttcaaatccggtaagcggcctctttttactctcttctccaacctccctcactatccctcaacctctttctcctttcaatcttggcgccacacttcaatctctcccttctcttaatttcaattcctttcattttctggtagagacaaaggagacatgttttatccgtgtacccaaaactccggcgccagtcacggactgggaaggcagccttcccttggtgtttaatcattgcagggacgcctctctgattatacacccacgtttcaagggtgtcagaccacgcagggacacctgctttggtccttcacccttagcggcaagtcccgcttttctggggaaggagcaagtaccccaaccccttctctccttgtctctaccccttctctgcttttccagggacagggcaagtaccccaaccccttctctccttgtctctaccccttctctgcttttccggggagagggcaagtaccccaaccccttctctccttgtctctaccccttctctgcttttccagggacagggcaagtaccccaaccccttctctccttgtctctaccccttctctgcttttctgggagaggggaaagtacccctcaaccccttctccttcacccttagcggcaagtcccgctctcctagggggcaagaaccccccaatcgcttatttccatgccccaacctctgatctctgcgccccaatcacttatttccatgccccaacctcttatgtctgtgccccaatcccttttttccacaccccaacctcttatttctgtaccccaatcccttatttccatgccccaaccctttctctgcttttctggagggcaagaaccccccaccccttctccgtgtctctactcttttctctgggcttgcctcctttactatgggcaagcttccaccttccattcctccttcttctcccttagcctgtattcttaagaacttaaaacctcttcaattctcacctgacctaaaatctaagcgtctcattttcttctgcaatgccgcttgaccccaatacaaactcgacagtagttccaaatagccagaaaacggcactttcaatttttccatcctacaagatctaaataattcttgtcgtaaaatgggcaaatggtctgaggtgcctgacgtccaggcattcttttacacatcagtcccttcctagtctctgtggccagtgcaactcgtcccaaatcttccttctttccctcccgcctgtcccctcagtaccaaccccaagcgtcgctgagtctttctaatcttccttttctacagacccatctgacctctcccttcctccccaggctgctcctcgccaggccgagctaggtcccaattcttcctcagcctccgctcctccaccctataatccttttatcacctcccctcctcacacctgctccggcttacagtttcgttccgtgactagccctccccctcctgcccagcaatttactcttaaaaaggtggctggagccaaaggcatagtcagggttaatgctcctttttctttatcccaaatcagatagtgtttaggctttttcatcaaatataaaaacccagcccagttcatggctcattcggcagcaaccctgagacgctttacagctctagaccctaaaaggtcaaaaggccgtcttatgctcaatatacattttattacccaatctgccccggacattaaataaaactccaaaaattaaatccggccctcaaaccccacaacaggacttaattgacctcaccttcaaggtgtagaataataaaaaaaaaaagttgcaattccttgcctccgctgtgagacaaaccccagccacatctccagcacacaagaacttccaaatgcctgaaccacagcagccaggcgttcctccagaacctcctcccacaggagcttgctacatgtgccggaaatctggccactaggccaaggaatgcctgcagccccggattcctcctaagccgtgtcccatctgtgcgggaccccactgaaaatcggactgttcaactcacctggcagccactctcagagaccctggaactctggcccaaggctctctgactccttcccagatcttcttggcttagcggctgaagactgacactgcccgatcgcctcggaagccccctagaccatcatggacgccgagcttcgggtaactctcacagtggaaggtaagcccgtccccttcttaatcaatacggaggctacccactccacattaccttcttttcaagggcctgtttcccttgcctccataactgttgtgggtattaacagccaggcttctaaacctcttaaaactccccaactctggtgccaacttagacaatactcttttaagcactcctttttcgttatccccacctgcccagttcccttattaggctgagacactttaactaagttatctgcttccctgactattcctggactacagccacatctcattgccgcccttctccccaacccaaagcctccttcgcgtcttcctctcatatccccccaccttaacccgcaagtatgggacatctctactccttccctggcaaccgatcacatgccccttaccatcccattaaaacctaatcacccttaccccgctcaacgccaatatcccatcccacagcacgctttaaaaagattaaaacctgttatcactcgcctgctacagcgtggccttttaaagcttataaactctccttaccattcccccattttacctgtcctaaaaccagacaagccttacaagttagttcagaatctgcgccttatcaaccaaattgttttgcctatccaccccgtggtgccaaacccatagactctcctatcctcaatacctccctctactacccattattctgttctggatctcaaacatgctttctttactattccttgcacccttcatcccagcctctctttgccttcacttagactgaccctgacacccattaggctcagcaaattacctgggctgtactgctgcaaggcttcacagacagcccccattacttcagtcaagcccaaatttcatcctcatctgttagtcatactcctattcactgttctcaactactcacacatgccctgctcttgtttacactgccggtttacactctttctccaagacatcacaggtgatatctcctagtgctatccccaaactgccactctaaactcttgaagtaaataaataatctttgccggcaggactatgctgaatctccttaggcactctctaattagatggcctaggtcctcccaattcttagtccttttatacctgtttttcgccttctcatattccatttagtttttcaattcatacaaaaccgtatccaggccatcaccaatcattctatatgacaaatgtttcttcttacatccccacaatatcaccccttaccacaagacctcccttcagcttaatctctcccactctaggttcccacgccgcccctaatcccacttgaagcagctctgagaaacatcacccattctctctccataacacccccaaaaatttttgccgcctcaacacttcaacactattttgttttatttttcttattaatataagaaggcaggaatgtcaggcctctgagcccaagccaagccatcgcatcccctgtgacttgcacgtatacgcccagatggcctgaagtaactgaagaatcacaaaagaagtgaaaaggccctgccccgccttaactgatgacattccactattgtgatttgttcctgccccaccttaactgagtgattaaccctgcgaatttccttctcctggctcagaagctcccccactgagcaccttgtgaccccccacccctgcccaccagagaacaaccccctttgactaattttccattaccttcccaaatcctataaaacggccccacccctatctcccttcgctgactctcttttcggactcagcccacctgcacccaggtgaaataaacagccatgttgctcacacggagcctgtttggtggtctcttcacacagacgcgcatgaaactgtcctccggggtccttggtccaactaataggtggacacagatcctttgtcaacagagcagggctggctgtgagcacagagtaggaacctcagcgctacctggggggtcaggcaggcttcctggaagacgtgaggctgtgctgggctcgaaggcccaggtcagacccaagaccatatgcagcgggcacacctgtgcagggcaccagcaatggtgcagggccgctgatgcgtccctggggccatctccgcagtgctggtccagggcggtcccacaggccatgttctggaacacgggcccttgggcatcctgtgaggctccccggcctcccgcagccctgaggggcactgagacagggctccagggagacgctgccgcccagctggggctgaggacgcagaggtgccacccgcacgccagcagcacacatcggacggttccctgtgtgtggtcttggattgactcttccacctgggatcggaaccctggaaagaaaaaccttctccatcccagctttaaccaaaagaaaggctttggcctccatgccagaggccctcccaggccagctcccccagccgtgcttacccccacacctccgctcccctcagagccagatttcttgaagggggtttgctctcctctgctctacacggtcacctctgctctgaaacaatttagctcttccctctgctgctgcccaattgcttaacttcctggtcaccaaccccatggcccttccggccccagcaccttcttgcgctttccatcagcttctagaaaactgcgcttctctgcatgcagagctttgccctctggatctcctacctctctaagggtctccctcgtctgccgctgcccccagtgtgggctttgccgggacctgtcttcagcctcccctccactgtggcctctcccctcaggaaggggctacgtggtgaggaccaacccctttccaccgatttccactcacttcgcccttccttaactaagccttaactaaggctcaatgccagtgtggttggccacggagctctgctgggatcaggggcagcagcattggccgttgtggaagtaggaagagcaagggtgggcttctgagctatggccggtggaagtcctggctctacccctcacctgctgtgggctgtggttacgataggcaaggctgctgtgcccgttcctcattgtgtaatgtggataataatcataaacacaggaacaccagtggtgcctattgcatgctggacagtgtttatttatttaattttgtttgtttgcttgtttgtttgttttgagactgagtctccttctgtcgcccaggtttgagtgcagtagcgccatcctggctcacttcccaggcctcgacttcccaggctcaagtgatcctcccacctaagcctcccaagtagctgggattacaggcgtgcaccaccatgcctggctaatttttttgaaattttcttgtaaagatggggtctccctatgttgcccaggctggtctcaatctcctgggctcaagggatcctcccacttcagcctcccgaagtgctgggattacaggcctgagcacactgcaccatgcctggacagtattctaaatgctttgcacctatgagttcacttcgtcctcacaaaaattcctatgtgatagatatattattgcccccatccccacccactgagctgcagcatctgaggcacagagaggcaaagtaacttgtccaaggtacacagctcacagatatcaaagctagaatttgaagccaagcaactctggccccaaaatctaaactgccttctagatttgaaatgaagattaactaaggctcaatgctaaatacttctccttctggccctgttttataacaataaagtcctcatgaaactgaaaccacctttgctatgcttctaacctccaagctgtccttgttcattctcgggtgtaggctgaactaactttaggagaaacttagtttatagtttaaacaaagaacagtaacagcctttccccaaagcagacctccttcttacctgaggactagattgcctttgtaggactaacattagccacaggattagaaattctagtttaggagtcatgcagctggaggctacaagattctgaccctccctaaactgctcctaagatcagtgcttgagatattttgcagatcctgcacttgatggatcagctggcaccacccagatcaataaactggctcatatgatctttcggaccccccacccagtaactgaatcagtgcaaaaagacacgactccctatgatttcatctctggtcaatcagctctcctggctcactggcttccccccacccaccaagttatccttaaaaactctgctccccaattgctctgggagactgatttgagtaataataaaactccagtctcccacacaaccggctccgcatgaatttctctttattgcaattcccctgtcttgatgaatcgactctgtctcacagcgggcaaggtgaaccccttgggcggttacaaaacccaaccaattttcaatatttgaggtcaaatattatgagctcaagccacgctttaggtgtccactgtgctctgcgtgtattatctagcagctgcgattcactgagggctaacacacgccatgcgttatgtacggaatttagattccgcatctctaatccaacaataacaaccctgaaggtagatttgaacgtttccccattttacagatgaggaaactgaagccgaaagagctttcgtgagaagctgggccaagattcaatttcaggtatctgtggcttcaaggcctgaggcctttccttcccggggtctcctgcctccacggagatggctctccttgttggttcctgtgtctgacttcagactctaaaccctttgggatcactcctgtttgtatccccaggctccagcacagtgttaggcaggtgacagacaggtgacagaacttgttgtttgttgggtaagtgggtaagcagtgagtgaatgaatgggctaagccctgggcccttctgtccaagagcgcagaaaaggccccctgcccagaaacgttgctcctgctggccccaggaccagggcacatcctgctacaaagagctgcagagctgtcctttatccagaatgtggtgccccctccccaagccctctgccaccctggcccccaggtctgttctctgtggagtggccattccacactcaccagttacaggatgggccttctcgtgagtcctgctctcgctcacagaaggaactggctctgtgccccttggccccgaagaccagggcctgtctgcagaagcagtaagtccatgagcagtgcaggaacaggcggtcccagcccccagaggcaagaggccaccctgcccgcaggccagggcgctctggaatgagccacgcactgctgaacagtcaccatccgcaaatgcctgtggacatttcccccagtgtggggttggggcctctacctcccactgttcctccttctcctgggatgtttttgggtaatggtaccatcatcctcctagtcaccccagcgtgtgtgctcagagtcaccatgtccgctatgtgccatcaatcactgggtgctgcagagtccttctgactagcttggtctggcacccaagcccaggcccctctgtctctcctcagccaagaatgggacttcctctgtccctgagccctctcaggtgccctgtgctcctgcctggccggccaccctctctctcttccccaaaaagcctcgccctctgtctttgccttggcgttgctgttcctcagaattcagcacagccccaccaaccactcccgagtcccccggattcactccccactccccactccccacctccttgtttccctcctccttctccctttccccaggagggaaattgaagacagttaaaaatagaacaaatcgaagtgcaccggccaaagccaagcaccactcagcaggaagcacctgaggctcggttccccctgctggaaggcgccccaggcaggcctcaccctcccctccctgctgcctcctccgtatgttcaaatcctgccagacttgcacccagctgggagagatgatgttcagaccgcaggctgctggcggtgcatggggggccaggggctcgggcactcatggatttcagagcagttctgcccaggctcgctggccgccgccaccttgctgtgctcctgaagcaggtcagagcccacccccagggcccttctgtgagccctgggctggaagataatggcaggggagggaggccggagcaggcggctagggttgcagataaaaggcagacacccaggcccagttaaataaatttctgagcaattacaattatttgctagtacaagtatatcccggcaatatttgggatatatttatgctaaaaaagttaatttgttgttgatctgaaattcaaattttaccagatgtcttgttttgttttcttctgttttctttgcctacataggtgctcagtcaggctaccctgggtagtcccaggggcaaccctgccaggcctgttccccatccaggcccggcactccagcagagtggaggcaaagagaagtgggtgggagggagtattcatttcctagggctgccttaacaaagtgacacaaactggagagggggtggaggtaaaaacaacagaaagttgtctcacgttctggaggctggagtctgaaatcaaggcgcgggcagggccttgcgctctctgacggctccggggggaggaagctgccttgcctcttgcagcttccggcggtggccagtgtgccgtggcttatagatgtcactccactctcggcctcagttggcataaggcatcgtctcctgcgtgtccctgggtctctgtttcctctgcttctaaggacaccagtcattagatgagggcccaccctaatccagaatgatcccatctgtgtctgcaaagaccttatttccaagtaagagtgccttctcaggtttcagggagacacgaatctggggggactcttcaacacaggagagagaactaagtctgacttcattctgcattcacgcacacccacctcactgaaaactttcagatccaggtgaccataaaactgaccagaaaaaaaaaaaaaaatcaaatatctgctccagaagtccttaaaggccaaacccatgcaactccagggcggcaggagctggcactcagtgacacctcgggcctgagtgaggaggctggaacttgcctccacctgcttcttgcaaagaacctttcagaaggggcacccaccccaccccagacactagcaaaatggtgccagcatcactacaagaaagctctggaggcagtgtgtgtgttcttggggccattagtcaagtctgtgcagggcggaggttctgtgagaggctgagttcctgcggagggaaaggaagagctgtgcccaggcctgctgagaggctgcacaggccaggcgcccccacgccctcccaggcccagagtccatttcagccatgtgcctggagcctggctgagggagggagtgccaggctgatgaaagtgagaaggctcagcccggcgcagtggcccatgcctgtaatcccagcactttgggaagctgagat

SEQ ID NO: 1317 - DNA, 9926 bp, Homo sapiens; identical to SEQ ID NO: 1316

SEQ ID NO: 1318 - DNA, 4148 bp, Homo sapiens
tagtctcttctgtagttgtcagggttctccagagaaacagaaacagaagcaataggagatatatctcttattacattaagtctcctattgcttctgtttctctggagaactctaatacataaaagattatgattagaattatgcttgaagaaggttaatcttataatggcatgcagagcggagctgggcaaggccagaggctaaatatggagccagaaagatactgcagaaagtgagcaaaaaggatgagtggatggcctggggtggaatccgtgaaaaagggcagattgtcagtctcaggaaatcaacaggactgagttctaacttcagctgggctactatgccctggggaaaaatgcaatagacaaaggagaaacagccagagaccttgaccaacagaactatattaaaccagtaaaacaaaaagtattccatgtgtgctccagtaagaaagaagaaaggaaggctcaacatttctatcatgaggacttcttccagcagagaggctccacaggagacctttcattgaccttcactgagaaataccgaatatgtcatgactttcttcaactccacctcttcagtccatgctatcagttgaggtttatgagagctgagctatcatttctaaagacagaggaatttgttccaaaaatatctggctttccacccccaccttcatttataaaacaaaccatctaagtctttcaggctatttttccaccagcttgtttataatgtggtaatgattatgctaataccagttgggaatacattctatgtggacatgttgtgggaatgtgattggagtgtgtgggggagaggagagggctgtataagtgcatgaggagagctattctataaaattatagtacatgccctctttccatatttactagtttttgtaagctccttctcaaatgggaaatagaccatgcttcctttccagaaggatagttattgaataacgaacaccatgtgttctgctatgtcttatttgtctgagcactctgcagctattttctaaaccaaattaataacagtatactaaactgatttccctagtgaaaactgctggctactaccaatgtcagtatgtacaccccactgctccccaaagcttaggtaatcactgcataaccaaagtctacaacagccccagagtgggggcaaggcagctttcatggtacacaagggaaaattgacagcctctaattaaatgagactgtttacacaagcgatagagtattacaacactttccctacaaaaagaagagaatgtgaaatttcagaaaagacagatttaatgtggaacttgtcaccaccgtcagcttcggcatgataaaatgcacatggaaagtcccttgcagcaagcccgctgcaaagaagattcttccttcgtctgggtcagagggtgtggatgtctctaaagaaaatgctacctctcctttgctcacacacccacttgcggcacagtgagctttccacagcatatatgggatctgtgggctgaatgctggagacacaggggccagagcctggcagtgaagactcctgggttatggaggaaaaaggaagtatctcctttctacaaattaagaaaatgcacatccacatgacagcttaacacaggacaccgggtgtgtacagaaactgccctaaaaaaaaaaaaaaaaacctcccaccttcacccaagccaagaatcagaagattctccctaacattggagtccaaagaagaggagccaccatctccttaactacaaaacaactgagagaagaaatgtctccctttagtgccagtgaagagttttgcttctctagaacaactgtttatttttgatcttatgaaacgcgtgacacttgtaactgatttgccttctttttgcttgctgctagaaatctcagaaccaaattcgaggtcatttctgaatgtgctggactacacagcatgaattctgtgtcctctcacctcattcatagatacatttttttattcctacccatcttttcctttccccagattttcctattgctcttttatcatcttgagtaaagaaggttaaactatgaataaaaagtacaatctcaatgacgagtcagggaaaagtaagttttggacttccatttagagccatttataggtcagcaatcttttgtctctgtgtcttctttctgccctgaacaaccaaggcatcctagtcagtctctcttcatctgcataccactttaaagagcccaggggtcttccaagtacagtcactactaagaaaatgtcttcagtaaattttttttttttttttttgagatggagtctcgctctgtcgcccaggctggaatgtagtggcacgatctcagctcactgcaagctctgcctcccgggttcacgccatcctcctgcctcagcctcccaagtagctgagactacaggcacctgccaccatgcccggctaattttttttgtatttttagtagagacggggtttcactgtattagccaggatggtcttaatctcctgacctcatgatccgcccgcctcggcctcccaaagtgctgggattacaggcgtgagcccccgcgcccagccttcagtaaaattttaatgcatgttgcttatcattctttgtattgtaagcaccaatccttaatctgtgctgtggtttttgttcagaaacatttctttaaaaaaatttccccagacgctcagccttcatattctaatctttattattctgaactacctacaaagctaaatataccttgtctacatgcagtgcttatgtaacaatggtgcttattttgttttacattgcttcaacctctgaccagaaacttagaggacagaatgccctgcttttacaaaaaatgtggtgaccacaacggtaaccttatctaattgagaccattttaggaaggaggggaggagatatttttactgcaaagactgagtcataagccttcattttttaccctgggttgtgcagaaactttaaactttctatattatttcatttcttccataccaggacatttatttcctattcagtgacaatcttgatgtcttcatccttcaaactgctctctaacatagtttcaaaatccaagcattaaacattattaatgctcaggggatgaatatgttcattacctttactgtagtgatgatttcctatggcaaaatgttaaatgatgtaaagataaaaataattatcatagttattaatcatagcaataaaactggactacctaaagcacagtttatggtataatatttatgaattaagagcaacacaaataataatgttaattgctcacctacagatgaatgcaaatgaggatataacagagtcgaaataaactaagcaaaggaaacaatgtttcatagctatcgtgttcattattctaaccaaaaaaaagaacacagaaatcagatatatgcaatagggtacactgaaatgattctcaatgattatataaaacatatatacattattttctcaacttcctgaaacatcaattctcttgctcataatgtagttaaatcgtctaagattagcctcatgtgaccatgtttggacttcttaaaaaaatcgcttcaggaacattacattttcatgatcagatagtttcctgaaagtattaaacaaaactaggaaaagtgtttaatagttatttggattacatttcattaaaaatctttacgatctctgttaacagtccagtacatttgaatgttaaggaggaccctgcactgaaggttttataatgctttatctattccaagttatacaacacaaaaattttctcaaacaagcacatgtgactttgcctacatctgcatttaagattctaatgtacatttttttattcttttgtttaaattattaactatcaacactagaattgagcatggtatgtattcagaattatgttcaagtaattagtggctattttgttaataaagatgaagcttcaattgtagatttgataattttaccctaaaatttttaaatatataaaaaatagcattttttaaaactataatggtaaggcaaaatgttctcatcagattcggtgggcagatgggacagggaacacagctttcctgaacctggaactcacagttctgccacgcagctatagcaaaa

SEQ ID NO: 1319 - DNA, 2709 bp, Homo sapiens
gcacgtccaggcaactgcccagggccagctcagctcctcctgcctgatgaggttgagccccgagggctgtggacaccggttctgccgcctcttgatcgtgcccggagccaaaccagtgcttatttcagcccacctagaccttctaggatctcctggaccccctgcgcccatcgagagtgtcttgactgcccagatgagactctcactgtgcccctggagaaccctgagcccagcctgccccctactccagttaccgcatcagccagcacctggatcccttagaaaccacccccctctggccccaggtgctctaatagccagactctgggtgtcttcatctcagtcctcagccttcccttatctgagctgaggactcgccctcgagaccacatcctggctggtacctcctagccctggctcaggccggcatgtaggtacttctgttggatgtgagcacttgcttcctgagggagaagcctgggctcctccacctgctccttgcttaatcccatctcaggagtgtctcgggccaggtgccaggtgaggctcagacaagaaaaagagcctggagtccctgggacaaaggcagggctccctggaaagtaccgtgtgtatttttccttcctctgggacacagcaggcctggggatttctcccttactcaagcagcaaggagatggcctaggagtgtccctggcacccagcctgaaccctactgagcctcaggcgtcctcatcccttttcacctcggagctcagcgtcttcctcagcagcacttccatgtcatctgccccgtgaaatcagcctaacgccgtttctcaatgacgtggatcgccctaggccaccgcaaccttccggaagctctctcagctcagttcccattctcccaccatctcttggttctccttctacctcaccggttgctagtcctccgcttcgcagctgaaaatgtgcccggggcctactgtgggcctagccaggcctgcttacgcagtgcagtttcccatgaatgatgcccagtcattatcacataacctgtggcaagccagcaagatggccctggtgacagcaaaagaaactgcactaggacctgaatgtagatctcagtcatgttccttactaacagcacgttttgcaaccatgcgttaaagaaacatctgactcacaacaaaattttaaagggtttatttgagtgaaaagcaatttatgaattggggaacacctgactgaaagagcgttagtattccagagacaaaacatcaagtgcaagtttttattgggaaaatgtagaagcacaataaagaaattatttgattggttacagttatagagttgctttctttggcttatcctgttggaaagtcagtagttatataatcatgatagttggttacttatgattgggtagattaaaatttatctctgtctaatggaagcatttatcagaaacaactcagccaggcatggtggctcacgcctataatcccagcactttgggtgggaggctgaggtgggcagatcacctgaggtcaggagttcaagaccagcctggtcaacatagtgaaaccccatctttacaaaaatacaaaaattagctgggcatgatggcaagtgcctgtaatcccagctactcgggagggtgaggtgggagaattgcttgaacccggtaggcagaagttgcagtgagccaagattgcgccattgcactccagcctgggcaacagagaagactctgtctcaaaaaagaaaaaaaagaaatgactcatgcctgtaatcccagcactttgggtgtgaggccgaggcagggcagatgactagtctttgagaccagcctgggcaacatagcaagaccttgtctctactgaaaaacaaacaaacaaaataatggctcaagttaagtttcacttatgttttcaatttaagcaaggctgaagtcacttacgagacctaacttgttttgtctgcttagggattcttcaggcctggtctctattttaatatttagctcaggtaaggtaattatgctggggtttcacagtaatctattatagtctggaaaattaagtcttcctggaatacaacaggacctcaccgcagatgtcaaatacgagtccaccagcttaagggtccctggtgaggatgacagaaacttgagaagctacacttatcaaacatcccacaacctaactcatgaaagttggctgagacgcctaagtgctgagcgtcggaggctgtcacttgtttatgatccacatatcagagtgcttgtttctgccacgtctccagcccgggagtactgcagggccctggggctctttacccacgtgcacaccctcagtcaggggcagcaaagtttttgtgcgaagagctggattgcggctgtttttgcctctgcaggtcacacagtctcttgcaactactcaagtctgcacaaaaccaaccttaaaaaataaaaggatgtggctgtgttcctataacattttattttttatttttatttttatttatttcttttttgagatggagtctggctctgttgcccaggctggagtgcagtggtgggatctcggctcactgcaagctccgcctcccgggttcacgtcattctcctgcctcagcctcccgagtagctgggactacaggtgcccaccaccacgcccagctaattttttgtatttttagtagggatggggtttcacagtgttagcc

SEQ ID NO: 1320 - DNA, 2709 bp, Homo sapiens; identical to SEQ ID NO: 1319

SEQ ID NO: 1321 - DNA, 2709 bp, Homo sapiens; identical to SEQ ID NO: 1319

SEQ ID NO: 1322 - DNA, 2709 bp, Homo sapiens; identical to SEQ ID NO: 1319

SEQ ID NO: 1323 - DNA, 2709 bp, Homo sapiens; identical to SEQ ID NO: 1319

SEQ ID NO: 1324 - DNA, 3737 bp, Homo sapiens
ggagatgctgcctactgcagtgtggagaatggattggaggggtcagaatgaatgtagagagaattcaaaggctcctgcaggagtccaagcaagaggattgcagattgtagcctggaagaggccagtagctgtggtgacaatggacaccaggtggatatgttggagagacacttagaagggtctcactctgtcacccagactggagtacactggtgtgatctcggctcactgcaacctccgcctcccaggctcaagtgattctcctgcctcagcctctcgagtagctggaattacaagcatgtgccactaccaccctgctaatttttgtatttttagtagagatgcggtttcaccatgttggccaggctggccttgaactcatgaccttaaatgatccacccgcctcagcctcccaagtgctgggattttaggtgtgagccactcgcctggcagaaagactgtcttctgaaaaggacttttgggagtgaaataacatcagctctaagtgactcatgtgcctatatccacctggttggtggtgaagaggagttgaaaggaatgaaggattctaggacagaaggttcctattgagaagacactttcggctataaccactgttacgtgtgtgtaatttattcaacactactgtgtatataacggacaaacaaatcatatttaaaacatcatctagtctttttagatgtttagaagtgcacaaagtatgttaaaagtagaggtaaataacacattttgtagatatccttttgatgtgaaatattgtcttttggaaattgagcaaaccaattccctgagccgtacacattattatatctgtgtcagtttggggaggaaggaggagcagaaagtacaaagggcttttcaccagtgtgtttatggtgaggcacattgactattatctttttttttttttttttgagacgacgtctcgctctgtcaccaagctggggtgcagtggcgcaatcttggctctctgcaacctctgcctcctgtattcaagcgattctcctgcctcagcctccagagtacctgggactacaggtgtgcaccaccacacccagctaatttttgtatttttagtagagaaggagtttcaccatgtttgccaggatggtcttgatctaagtctgcattttctttgtgctgtgtagatagcgtacataagaggacaaaccaatcctaatctatatcatctagtctttgtagatgttagagaggtccagtgcgtgacaaaagtagatttagtgaattaaaacactgagtacgttttgtgttaaaattcatagggaagactgttgttaaaaacatagaagtgggcagggcacggtggctcacgcctgtaatcccagcactttgggaggctgaggtgggcagatcacttgtggtcaggagttcaagaccagcctgaccaatatgatgaaatcctgtgtctactaaaaatacaaaaattagctgggcatggcagcgggcacctgtaatcccaggtacttgggaggctgaggcaggagaattgcttgaaccctggaggcagaggttgttagaatcctttctacacaatacatttggcttatagctgtccacagggtggacagaggttggaacgggaagggttctaggccaaaatgttcaggggaggggtgctaggccagaatgttcgtatttagaagacactttcaaattacagtctatgttatgtatatgcaccatttattcaatgctactatgtatatagtggaaaacctaagtcctctttgaaacatctagtctttctaaatgtttaaaagtgcacaacataggttagaagtagagggctaaagtgacaccctttaagcattttctttattactttttaggagtgtttgcatttggaaatggaatggttaaacttgatgctttggactgttcatagggtgatggtgggtgtaggaggaggaagtatgcaaagggaagggttctgtgcccaagagttagattagttcacatgatctaaccattgttctatatgcattttagttaatagtgttttgttttttatttttgatggagttttgctcttgttgcccaggttggagtgcaatggtgtgatctaggctcactgcaacctctgcctcctgggttcaagtggttctcctgcctcagcctcctgagtagctaggattataggcacacaccaccacacctggctaatttttttggtaatttttagtagattcggtgtttcaccatgttggccgggcttgtcttgaactcctgacctcaggtgatccacccacctcagcctcccaaagtgctgggattacaggtgtgagccaccgcacctggccaatagtgggtattaaaagataaacaagtcttaatgctcaaagtatgttaaaaatagatgtagtaaaacaatccgtctacaaatgttcttttgttatattttaggaggcctgtcttctgggagtgacctttgttattccacctcttggagctaggcatagtcctatacctagtcactgggatggtggaagagggagaaaaggaaggatgaaggaaagagctatttgctagtatctccacatctagaagatggttttagatgataaccataggtctacatgagcatttttagtaaagtgcttgtgtgtaattctggacaaagtttattattttgcactatctaagctttatgaatgtcctggggtgataatgtgtgataaaaagtagaactagtgaattagccaatttgtaaattttttcttgttataatttatagaaaagatgcaacttggacatggaactgttaaaccatctctgagctttgtatgccaggacttgttcattaggttggcagcagagcagcaaaaggaagtataaagagagagatgtatgcagatgtgtcgatatttacattttgatgatagccattgttgtatgtgcatctcttttagctgtactataggaatacattaggtatttcaatgaaaacataccttgctaatatttgaatagtatagatctgctaatggattctcttagaaacattatacttagtgtattctattgctgtatatttcattttaaagtgagcactaaaggaatgcggtattttaataaaaactctgccaacgcttttacttagaggcgtgttgccaatttttgtcttttatgaaaatttggcccaagaaaggcaggattacattgtttttccaacagattgagtgggtgtagtgtattcttgatgatcaaaatactcatatagctttgagattttgaattggtaaatactcaagatgtgtgaaaaagcatgatacatactatatgatctcagtcccataaaattgactattgtatctacacccacacaggacctagaaggacatgttaaactgtaaactgcttgtgattgtggatgacctttttcgttgcttcttgtgtttttcagtttcctataatgcacatagtaacttaaaaaaataaagattatttttgaaacctaaaaaaaagaggttacagaattgaatactccctgagataaggtaaaatcatcttatgctaacggttgcaagataatggtataagtaagctttcgtcgtacatatcaatgaactttaagatttggaagacaaaattcagtttatgtattcaattaaatgtgctcagattgtattgtgctagataggcacattattctaacataatatgaatgaatcaataaaatccttataatactgatg

SEQ ID NO: 1325 - DNA, 4209 bp, Homo sapiens
ggagatgctgcctactgcagtgtggagaatggattggaggggtcagaatgaatgtagagagaattcaaaggctcctgcaggagtccaagcaagaggattgcagattgtagcctggaagaggccagtagctgtggtgacaatggacaccaggtggatatgttggagagacacttagaagggtctcactctgtcacccagactggagtacactggtgtgatctcggctcactgcaacctccgcctcccaggctcaagtgattctcctgcctcagcctctcgagtagctggaattacaagcatgtgccactaccaccctgctaatttttgtatttttagtagagatgcggtttcaccatgttggccaggctggccttgaactcatgaccttaaatgatccacccgcctcagcctcccaagtgctgggattttaggtgtgagccactcgcctggcaggtgattatttaaaagcagaagtagtataatcatatttttttgtaaatagctttttaaaaatggatgggaaataatatttggaagtggagttgttgaactacctctgtgaacagcatactctctctaattgttcattgggttgagggtggtgagagggaagaaattgcaaaagttgctttgctagtgtttattagcacgttgtgcacgtgtatcctaaaacttaaagtataataataataaaattttaaaaaaaggttttaaaaaaaaagaaaatttcagcttaatccattgcctgtatgttacatgcgtttcatttacctttgctgtactgtatatattgtgtatatactgaacaaatgagtcctaattttataatatttagtcgagtctctagagagtaaaaaggttgccaatgtatgacagaaagagttagtaaactagcataagttgtatgctttgttaaaattcacagaaagactgtcttctgaaaaggacttttgggagtgaaataacatcagctctaagtgactcatgtgcctatatccacctggttggtggtgaagaggagttgaaaggaatgaaggattctaggacagaaggttcctattgagaagacactttcggctataaccactgttacgtgtgtgtaatttattcaacactactgtgtatataacggacaaacaaatcatatttaaaacatcatctagtctttttagatgtttagaagtgcacaaagtatgttaaaagtagaggtaaataacacattttgtagatatccttttgatgtgaaatattgtcttttggaaattgagcaaaccaattccctgagccgtacacattattatatctgtgtcagtttggggaggaaggaggagcagaaagtacaaagggcttttcaccagtgtgtttatggtgaggcacattgactattatctttttttttttttttttgagacgacgtctcgctctgtcaccaagctggggtgcagtggcgcaatcttggctctctgcaacctctgcctcctgtattcaagcgattctcctgcctcagcctccagagtacctgggactacaggtgtgcaccaccacacccagctaatttttgtatttttagtagagaaggagtttcaccatgtttgccaggatggtcttgatctaagtctgcattttctttgtgctgtgtagatagcgtacataagaggacaaaccaatcctaatctatatcatctagtctttgtagatgttagagaggtccagtgcgtgacaaaagtagatttagtgaattaaaacactgagtacgttttgtgttaaaattcatagggaagactgttgttaaaaacatagaagtgggcagggcacggtggctcacgcctgtaatcccagcactttgggaggctgaggtgggcagatcacttgtggtcaggagttcaagaccagcctgaccaatatgatgaaatcctgtgtctactaaaaatacaaaaattagctgggcatggcagcgggcacctgtaatcccaggtacttgggaggctgaggcaggagaattgcttgaaccctggaggcagaggttgttagaatcctttctacacaatacatttggcttatagctgtccacagggtggacagaggttggaacgggaagggttctaggccaaaatgttcaggggaggggtgctaggccagaatgttcgtatttagaagacactttcaaattacagtctatgttatgtatatgcaccatttattcaatgctactatgtatatagtggaaaacctaagtcctctttgaaacatctagtctttctaaatgtttaaaagtgcacaacataggttagaagtagagggctaaagtgacaccctttaagcattttctttattactttttaggagtgtttgcatttggaaatggaatggttaaacttgatgctttggactgttcatagggtgatggtgggtgtaggaggaggaagtatgcaaagggaagggttctgtgcccaagagttagattagttcacatgatctaaccattgttctatatgcattttagttaatagtgttttgttttttatttttgatggagttttgctcttgttgcccaggttggagtgcaatggtgtgatctaggctcactgcaacctctgcctcctgggttcaagtggttctcctgcctcagcctcctgagtagctaggattataggcacacaccaccacacctggctaatttttttggtaatttttagtagattcggtgtttcaccatgttggccgggcttgtcttgaactcctgacctcaggtgatccacccacctcagcctcccaaagtgctgggattacaggtgtgagccaccgcacctggccaatagtgggtattaaaagataaacaagtcttaatgctcaaagtatgttaaaaatagatgtagtaaaacaatccgtctacaaatgttcttttgttatattttaggaggcctgtcttctgggagtgacctttgttattccacctcttggagctaggcatagtcctatacctagtcactgggatggtggaagagggagaaaaggaaggatgaaggaaagagctatttgctagtatctccacatctagaagatggttttagatgataaccataggtctacatgagcatttttagtaaagtgcttgtgtgtaattctggacaaagtttattattttgcactatctaagctttatgaatgtcctggggtgataatgtgtgataaaaagtagaactagtgaattagccaatttgtaaattttttcttgttataatttatagaaaagatgcaacttggacatggaactgttaaaccatctctgagctttgtatgccaggacttgttcattaggttggcagcagagcagcaaaaggaagtataaagagagagatgtatgcagatgtgtcgatatttacattttgatgatagccattgttgtatgtgcatctcttttagctgtactataggaatacattaggtatttcaatgaaaacataccttgctaatatttgaatagtatagatctgctaatggattctcttagaaacattatacttagtgtattctattgctgtatatttcattttaaagtgagcactaaaggaatgcggtattttaataaaaactctgccaacgcttttacttagaggcgtgttgccaatttttgtcttttatgaaaatttggcccaagaaaggcaggattacattgtttttccaacagattgagtgggtgtagtgtattcttgatgatcaaaatactcatatagctttgagattttgaattggtaaatactcaagatgtgtgaaaaagcatgatacatactatatgatctcagtcccataaaattgactattgtatctacacccacacaggacctagaaggacatgttaaactgtaaactgcttgtgattgtggatgacctttttcgttgcttcttgtgtttttcagtttcctataatgcacatagtaacttaaaaaaataaagattatttttgaaacctaaaaaaaagaggttacagaattgaatactccctgagataaggtaaaatcatcttatgctaacggttgcaagataatggtataagtaagctttcgtcgtacatatcaatgaactttaagatttggaagacaaaattcagtttatgtattcaattaaatgtgctcagattgtattgtgctagataggcacattattctaacataatatgaatgaatcaataaaatccttataatactgatg

SEQ ID NO: 1326 - DNA, 3502 bp, Homo sapiens
aagaaaaagaaaagaacaacgcggctctgcgagtactgacacaaatccccagcataaaaagtgaaaaatgcacacctttgtggaaaagtgtgaatagtctgctcccatttctattagcaaacacacctgtgtgcacactgagctttctgtccagtctggaaggggagggcggggccttcccgggagtgaaggggatggggccgacccggaccctccagggaacgcccttgagtaactcccgcacttgggaccccgtttccacccaggaccacaggctcaagatggcctggtagatgcagccggcacgcgcctctcctccgacgggaacagaaggagccggtaggttttcacacttgcagcagatccgctaagagaacgagggattcagccgagaagccactgggagcccgaggagtggagcagaggcacccaggcagcctgcgcggagaaatcggatcggctgggacggcctgcagcccccgcgcgcggggaaagggaagaagtcctcccctacaaagcgaattcacaaacggaagaagtgactgttccacaggatgcgcagatctcaacggaaggacccaggagacatgaaaaagcaaggaaatgtgacgccttcagaagaaaccagtaattctccagcaacagatccccatccaaaagaaattcaggaaagctcaaacagagaattgagcagagaattgaccggactgattgtaaagaaggtcatcaacatggaagagtcttttgaacaacaacataaagaaatgaggaaaagaggtggggagatatatgagatgattacctgccagaaagaggttttaaaattcaacagaagagtatttctggaactgaagaaatcattggatgaaatacaaagtacactcaaaagcttcaatgatagactagaacaaatagaagaaaaactctcagggcataaaatctgaagcatttttctcactttaaagattcatgggttgtactctggccattaatgtgaacaaaacctgctgggttagttcttattctggggtcttgggtaatcgttagagcgaaataaaaataatttcccttagagatggtcgattttgcaagattagttatcatccagcagttaggtaaagatgatctgattcagttactgaatctgatcagtactgaattcagtaggcacagtaatcctaacaggtgaatgtagctgaagtacattgtcatggtcaagaaaagccactctctctaacagattgcccacacagctacatgtcagccctcctcgctgcaaacctgacaaacactgtagcattttattatttatttatttattatttagagatgtggtctttctgtacccaggctggaatgcagtagtgcaatttcactgcagcctccattttccgagctcatgcaattatccagtctcagtctcccaagtagctgggactacaggcatgagccatgaggcctgtctaattttttttttttttttttttggtcggagctttgctcttgttgctcaggctggagtgcaatggcacgatcatggctcactgcaacctccgcctcccaggttcgtgcctcagcctccagattagctgggattacaggcacccgccaccacatccagctagtttttgtatttctagtagacatggggtttcccaatgttggtcaggctggtcttgaactcctgacctcaggtgatcctcccgcctgggcctcccagagtgctgggattacaggggctgagccaccatgcccagcctcctggctaatttttgaacctttttgtagaaacagggtttcaccatgttgcctagtctggtcttgaactcctgaactcaaagtggtctgcctgcctcagcctcccaaagtgctgtgattgcaggagtgaaccacactttgccaagcacaccctagcatgttaattcatcattctttttttttggagacggcgtttttgctttgcaggagccgagatctcgccactgcactccaggctgggcgacagagttagaatccatctcaaaaaaaaaaaaattaaaattaaaagaaaaaagcatccaaaaatgcatacatcaacgtaaaggatttttttttttttggtgagatggagtctcgctcttgtcgcccaggcaggagtgcagtggcgcgatcttggctcactacaacatccgcctcccgggttcaagcgattctcgttactcagcctcccaagtagctgggattacaggcgcccgcgaccacgcccggctgatatttttatttttagtagagacggggtttccccatgttggccaggctggtctcgaactccctacctcaggtgatccacccgcctcggcctcccagagtgctggaattacaggcgtgagccaccgtgcccggccaaatagtctatttatattagcaaacacacctgtgtgcacacggagcttgcggaccagtctggaaggggagggcggggccgacccggaccctccagggaacgcccttgagtaactcgcgcacttgggacccattcccacctaggaccataggctcaagatggcctggtggatgccgccggcacgcgcctctcctctggcgggaaccgaaggcgccggtaggttttcacacttgcagccgatcggctaagagaacgcgggattcagccgagaagccactgggagcccgaggagcggagcagaggcacccaggcagcctgcgcggagaaatcggatcggctaggacggcctgcagcccctgcgcgcggggaaagggaagaagtcctcccctacaaagcgagttcacaaacttggaagaagccactttcacaggatgcacagatctcaacggaaggacacagaaaacatgaaaaagcaaggaaatggggcgcctccaacggaacccagtaattctccagcagcagatccccatccaaaagaaacagaagacattttggagagagaattgaatatacatattatacagttgtgggcataatacaagcatcatttggaaaagaacagagaaaaaagatggaaggagttaccgtactgcaggaaaaaattatcaactccagtgatattattaaatacaacctaacgacacttctgaagctgaagaaatcactggatgaaatacaaagtaaactcaaaagcttcagtgatagactagaacaagaagaagaaagactctcaaaacttgaaatctgaagcatgtttcttaaagatttaaagggttattatactctggccattaatgtgaacgaaatctgctgggttaattcttatactggggtcttggataatcattaaagtgaaatgagaataatttctttttgagatgatcaattttatgaggtcgattttttttttttttttttaatgagactgagtcttgctctgtcgcccaggctggagtgcagtggcatgatttcggttcactgcaacctccgtctcccaggttcaagagattctcctgccttagcctccagagtagctgggactacaggcgtgtaccacca

SEQ ID NO: 1327 - DNA, 996 bp, Homo sapiens
cgcggctctgcgagtactgacacaaatccccagcataaaaagtgaaaaatgcacacctttgtggaaaagtgtgaatagtctgctcccatttctattagcaaacacacctgtgtgcacactgagctttctgtccagtctggaaggggagggcggggccttcccgggagtgaaggggatggggccgacccggaccctccagggaacgcccttgagtaactcccgcacttgggaccccgtttccacccaggaccacaggctcaagatggcctggtagatgcagccggcacgcgcctctcctccgacgggaacagaaggagccggtaggttttcacacttgcagcagatccgctaagagaacgagggattcagccgagaagccactgggagcccgaggagtggagcagaggcacccaggcagcctgcgcggagaaatcggatcggctgggacggcctgcagcccccgcgcgcggggaaagggtgagtgagagaccccggggctccgcagtcccgctaccgacttccacagccccccgaccctcgcgggcctccagaatgggcagcggccgagagattccccagcggcgttgcaggagcccacgtggagcccacgggcttccctgccctgagcagctgcagctgcagcccccgccaccccgagagtccagccccgagggcagctcctgccttgcctgcggttaccgccgccgccagctgagggccaaggagggagaggggaggccaggcgctctcaggagtcccaaaggacaaataaccccgccgctgccgcgggacccagacgcgagccagctgctcgcccgccctgccccgcctgagctttccgccggcagcctggggcccagcccttccctgtctgtcacagccagagcccaaaccccgggggcctgaggacagtccgctggcggttccgtcccgcgaggactggagcacaggggcctggggattggtggctgcgggttttgtccgtcaccgttggcg

SEQ ID NO: 1328 - DNA, 5446 bp, Homo sapiens
aggtcccctttctgcaacagagagctttcttcattcacttattaaactttcactccgacctcaccctttgggtccatactccttaattctcttggtcttgggtgatacctcacaaggagagactgctacattgtggtgcattggtgagactgtaacagactcctttccaagtgtttggtgtctgagttttcagaaggtttgacatgcatttcttcatttaatgcttagaacagaccaccaccaataataacaactccacatcttatttttcagatggggaaactatgattcagaatgataacaattaatacaaagctgaagcaagattcaaatccaagtcttctgacttgaaatcctactttcttgccactttttaaactatttatctgatgttggcaattcatggcaatcagaggatggatgaagggctctggaggttttggttacagtcagggagcattagaaagaacaagtgtgcttagatgaggcgggaaagcccaggtacatgaaggaaaagaataatttgcctaagttgcctagtttaaaatcatttttaattggaaaggtatttttatcttcatttacagatgtggaaactaagattcagaatgattattcaaaaatcacatagctagtggcaacctcaaggattgaaaccaggtgtgtctatctctaaatatagtgataaaaagcatgcattttgggttgaactctgctctccacatagatcttggtccagcccgccccctaaccctggtgtcctcatgtgaaatgaggctaataattgccaggcctctgagcccaagccaagccatcacatcccctgtgacttgcacatatacgcccagatggcctgaagtaactgaagaatcacaaaagaagtgaatatgccctgccccaccttaactgatgacattccaccacaaaagaagtgtaaatggccagtccttgccttaagtgatgacattaccttgtgaaagtccttttcctggctcatcctggctcaaaaagcacccccactgagcaccttgcgacccccactcctgcctgccagagaacaacccccctttgactgtaattttcccttacctacccaaatcctataaattgccccacccctatctccctttgctgactctcttttcagactcagcccacctgcacccaggtgattaaaagctttattgctcacacaaagcctgtttggtggtctcttcacacggacacacatgaaatttggtgccgtgactcggatcgggggtcctcccttgggagatcaatcccctgtcctcctgttctttgctccgtgagaaagatccacctacgacctcaggtcctcagaccgaccagcccaacgaacatctcaccaattttaaatcaggacctaccagtctgccctgctcatacttgatctggatgagactgataccctgcgagacgcaacagaatcagctcctgggattgtgttagcagaatgacgggagtgtgagatccaccacatggcgaggcaccccaggaacctgttttcttcttgaagagcaaccgagaactatttccaagttatccttcactttgaggacagcatggaggtgtctgatttctgcttgggctgaggattcaggagaagatgtgtggaacacagcctggacatgccccaacctggttgatgaattccaccccaagtagtggaagaaacacacctacaacatgagcagagaagatttttcttctgtactttccaggacttgaagctgctttgttttttggtcgctgggtggggaaggaggaacaatagtatagcttccagaagagagaagagagatatctcttgagtgtgaattaagcagtaccaagaggcctcaagctagctctctctcctgctttaaattctactgttaagagtttttctttaagtttaaaaccttgaaagctccatgatgctcctgagtagaacaataaagccattagtagtcaatggccgtctttaatatttttcttccatttcaattttagttctaattttatctgactcctaaaaatatgtttcatattctcatgagggctgggcccatatgtgtaaatggttgaaacatcttactttgttgactgaactagtctaaatagtcagtcaaattttttttttaggcaaaagtgaatttcatcaaattggttggcccacaatttcttaaattcatcattgattgattatctgtgatgtgccaatccctgtgcaagttcctagggcaacagaagtaaaaatccataatctctgtttccaggactctatcagtttgatagggacacaggcacataagcagacaatcataatgcagtggtagtagggatatgccactctcatccaggcagtgtattgatgaccatgtccttgagttcccaagtacattgaaaaaggtgtaataaggagatgctaaattagcaggtagtacttatatgaagttctactgtgtctactcctgtgccaggtgtttcggttgggaatgagtattgggtaagaggagaatagaagatggaaaggcagaaaacaccaactcagctgatatggttgggatgtttgtctcctctaaacctcacattgaaatgtaatccccagtgttagaggtggggcctagtgaaaggtattggatgaggggagtggatccttcatgaatggcttagtgtcatccccttggtgatgagtgagttctcgttctgttagtttacacaagatctggttacttaaaagggtgtggaacctccccctcctctctcttactccctctcaccatgtgacatgttggctccccttccccctcatcatgactgtaagcttcctgaagccctttccagaagcagaaaccggcaccatgcttcatgtacagtctgcagaaccgtgagccaattaaacctctttccttcataaagcacacagcttcagatatctctttgtaacaaagcaaaaactgactaacacatcacccattaaagagtttacaatttatttagaggaaataagatggaagtgtagggagttattagaaagcaagacaacctacaaatctgtaaagtataagcatcaaactttgtgaacaaagagtatgatgtaggtattgagaaaagaaaaagtgggatatagggtggaacagtctcagaaaagtcctcccaaaggacacaggtaagagaaagacatggaagaactggtccaacttacattggtagaatcagagggcttaggtcttttttttttttttttctttttttttttgagacagtttcactcttgctgcccaggctggagtgcaatggcacaatcttggctcactgcaacctctgcctcccgggttcaagtgattctcctgcctcgcctcccaagtagctgggattacaggcgcccgcaactacgcctggctaattttcgtatttttagtagagatggggtttcaccacgttggccagggtgctcttgaactcctgacatcaggtgatctgccctccttggcctcccaaagtgctgggactacaggcatgagccactgtgcctggctgggcctaggtcttctaagcagtggaaatggcagaggcaagtgtccagagctgggaataaggggatgttatgtgggtatcatagggatgggggcaggggacttcacaataagacaccagccagtctaaagttgagtttgtgtaggattttttactcatatattattgagggccatgcattgaactacatattatggataaataattaatacattcctgccatcttgaagtttataatctagtcctacaaagaaacttatcagagaggtttctctgaggcttagtgtgttgcggtctatgccttttcatttcatccttcaaatactgtctactcaatgaaatttacctggcctgttcagccaaaataatttataaaggcaataatagctaacattattaacactctcctagaccagtgtactgtactaactactttgcatgccttattcataataagttaaggtctcttatatttttcagtgtactatgcaccatgttatggtctttacaaagattacatagtgtaatctttacactaaactttgcaagggtgtactactattatccccattgtctctatgagaaagctgaggctctgcaaggttaaatgatttccccaaggttctcttaaacttcgtaggggaagatggaggatgcttagagagtggtatgaacaacattgtgtgcctcctgatgtgatacaatgtgcagcacatagcaccgcttttgaagtactgcatgcttgccaaaagaaaaattgaacataaactttcaagtttattgaaaatggagggtccaggagtagtgactcatgtctataatcccagaactttgggaggccaagccaggctgatcacttgggccaggagttcaagagcagcctagccaacatggtgaaaccctgtctctactaaaaatataaaaattagctgggcatggtggctcatgcctgtaatcccagctacttgggaggctgagacatgagaatcacttgagcctgggaggtggaggctgcagtgagctgagatcacgccattgcactccagcctgggcaacagagcaagactctatctcagaaaagaaaaaaaaatgagaaaagaaaatggagggataaaggattaagataaatgatgccacaaagaagtaaacagaaaaatttagaattttggagtgcagggactgcaggacaactgaccaaatttcttcaacatgtcaaatatatgtgtgtttgtgtgtgtttattctataaatataataaaaatatttttatataaaagtatattatatataaaagaaaatttggattggattaatgtaatgtttacagttatggtaatggctatgttaatgtaatgtaatgttaggccttgtttagttcctgatttgaacgaactaatttttaaaaaggcatttttttaataagtaggaaaatttgaatatggactggttattggagggtacagggaaatattctcaattttcttgggtgtgatcatggcactgtagttatgggagaaaatgctaatattttttagagatatgcacaaatgtgttgggaagtcacatcaaatgtgggatttgcttaaaaatatttagcaacaataactacaacagaaaagaataagtgatgcaaacatgatgaatgcttgctaattgttaaagctgggtgatgactacataaaggatcattgtattagtctctcaatcttcctgtgtttgaaattgttttaaataaagattcatttaaaatgcatggcttaaaatagccaatgaggctgaaaacagattctcttgtaccactgagcccagttctatgcacacagtaggtgcttaataggtgtattatgaattactagaattggagcatggaaaacagctacaggatgaatgaaaatcaccctgttct

SEQ ID NO: 1329 - DNA, 4554 bp, Homo sapiens
ccatggcctccatggtccccatggcacccgggcatcaggggatagaaattatgatcccatgcccaggaaaccctgagattcagagaaaggcagaggttgctccaagccacccagatggaaggccacaaagtgtgggtgccttgcttctcccatcatcagccaggggcacctgttggccagcagaaaggggcttttcggggaccaacatccccttacttcactgaggcctcccggacacgtgggcaggagggcagtgtctccagcaggtacagggcactttcctgagaaatgctgttgtgactcagactagaagggaaatggagatgagaatgggagtgagggcaggacctccttggagccctgcccagccccctccatctcccttccagctgtcatttccaagaagagaagcctccatgtctaagcatctattctccagatggacacactgaggcccagaaggataccatccccacacaggcagaactggcaccagaccctgagtccttgagcgctgcactcaccctgcccgctgcccctgtggtctggggtctgggcactggcaaggccaggctggcagctctagccccgcatgggtcaaggactcccgagcacgaagctcagttgcctagcaacaagtggtgtcctggagctggctgtcactccagcaggtcacgggagagatggggcaaccatgtggatgacttcctaaggccccttgcctgccacagggacatctccacatttatgttccacagattgggtcagaagaatttcagggacgggatggaccaggagccaggcagctgcaatcccgcatcagctggttggggatggaatgttgcttccctgtccccaggtcagtttggctgtaggggtgtgtcaccctgccacgaatcacagcctctcttgggtgtttggtggaggatctgcccatggtgggtgtgagggacagaggaaaggacccaaggccaggggagtgaaggcaagggaagaattgccccttgccctccacagtccttgtcctctggtgctctgggggatgccctcagaaggagcccccatcatgcttttggcctaggggagccttcctccttgctatctgtcctttatgctgctttccacttactcaagcaaaccggagatgggcacctgcggcagacattccagaaggcatctgagtccgctgtcgcccagcaggtttgctgagagactgtagggggtaaggagcagtggcggggatcagaggtgcctcctcagcctgagatgctcctcagtcaccaggagcctgcatccactgtcactgctactggaccccatgtcagggtcaccagcgccaccaccatcaccaccatcaccagtatcaccaccatcaccaccaccaccaatgtcaccaccaccagtattaccaccatcaccaccaccactttcattatcaccacaattctacaccaccaagcccagtaccaccatcaccatcccttccatcaccactagaatgaccagcaactcctacgttctctgctactatcccctccccagcaccacagtaaacccatcctcttggtcctcttccatatcgggtgaccactcatagctcaggtgcctccagcaggctttcaagggttaaagaaaaaccaatttgccttcaccacgcccttggccggcatcatttgggatccacagtttttgaatgagaggaaattcaggaaaaaaaaatgtttgcaggatgcattaaacccatagatttcttcttttaatctgggaatgcaatatcaatattggaaacctcacctgaagtttcttacttcccttcattgcagcattctgtggttttatttatttatttattttgagatggagtcttgctctgttgcccaggctggagtgcaatggcacgatcttggctcactgcgacctctgtctcccaggttcaagagattctcctgcctcagcctcccaagtagctgggattacaggcatgtgccactatgcctggctaattatttttgtatttttagtagagacgggttttcaccatgttgatcaggctggtctcaaactcctgacctcaggtgatccacccgctttggcctcccaaagtgctgggattacaggcgtgagccaccacgcccagctagttttaactacagtttcagaaataatataaccagtgtgtcccggaacatctgattttcctcctaggtctgtgacatttttgatgtttgttaatttcatcttttcctgagaaacgtcatttaaaaattggtctgtcttatgaagccacttaataaaatagtctttaaaataagaaaaattggctgggtgcggtggctcaaggctgtaatcccagcactttgggagggcgaggcaggcggatcgcctgaggtcaggagttcaagaccagcctggccaacatggtgaaaccccgtctctactaaaaataccaaaattagccaggcatggtggctcatgcctgtaatctcagctccttgggaggctgaggcaggagaattgcttgaacctgggaggcggaagttgcagtgagccgaaattgcgccactgcattccagcctgggcagcagagaaagactccatctaaaaaaaaagaaagaaagaaaagaaaaatttccctctataatgaaaaacaaaaaactcaaagacatatttcttattcatatctgtttaaaatacattccaagcacagcggctcatgcctgtaatctcagcaacctgggaggctgaggatcacctgagctcagaagtttgagaccaacctggggaacatggtgagacttcatctcttacaaaactaaactattagccaggcatgttggtgtgtgcctgtagtcccagctactccagaggctgaggtgggaggatcgcttgagcccaggagttggaggctgcagtgacctatcattgcaccactgcactccagcctgggcaacagagtgagaccccaggtcttaaaaaaaaaagaaatccatgattttatcagtcacatttttcttctctgccacatcacaacagaaatgaaaattgtgtggcatttttggcggactgctctctctatttcccactggtcctaggctggattcccaatgcgtctgagcagggactctgcattttactagctgtgtgaccttgggcaagttcttacaccctctgtgtctcagttccctcatctgtaaaatgagaacaatactagtatccagggatatgggaaacataaaaagaacatgtcaagcacttagaacagtggagaaagtgctcagtagctgttagctattattattccacccatgcaggggctgactatttgaatatccaagacaggccacgcagataccacatctcaacaatacaagagactgcaagaccccaccctggctggctctgcgtccctcctcaggcagagtcatccggtacttttaaccacctgctgggccaacaatgaatcctgcgttttagcccccatctgccagcagagcttgcacatacttgaggctgagggctgcccaagtcagagggcacaccatggaactagctccaccatggcgagagtgggggcgggagagagaaaattgattcagggaagctttgggtatgtgacccaggcatccctgacagctggtcctgagaggtgtaggcaggcacacatgagtgtatgtgcacacacggaccctcatacccccttcagtgcccctcaggcatgcgtccatgctcctctccttcctcctcctccctcaacttactccacctggctgaggtctttacacttgctcagcaaccagcagagtgactctacgtgctcctggctgaggctgcagcctgtgaacctgctggacggaggtaaaggggacaagcaggggatggggcgtttggccactgagaccccctccggcctggctagcccagggcacagcctctgggctccaggtgggtctccactcaagcttggaccctctggaagtgtccagaatccactgctcccacccccacagtagatcccacccggacctgtgtttcttcatgctgggtgaaacaagtccctctgcagggttgttccaggggaatgttttgtggtaggcagtctgcatactgctctggccacccaggaggcagatctactggtccccaacatcaactagctgcctaggcatggttcaagggggcttacccacagcacacgccttcctcctcctcgttggatctgaagtgcaaagttgcatggtgcagggacctggatcagacaggacctgggtcagacagctgtggccacagcctcaggatgcccccacggggccagcacccctcctccggaagcccagcctctagttgggtcctactgtcttcatcctaccccctcatacccaccagactccaggcacaacccttcaggacgagtcctggctgtcccaggggaatgcccacctgagatccacctttttaacccgtggacacaggcttaaggtgttggccagcaggaaggggcttttcggggacagtcccgtctggctcagcctgaaaaggaaagggggtagatccggc

SEQ ID NO: 1330 - DNA, 4554 bp, Homo sapiens; identical to SEQ ID NO: 1329

SEQ ID NO: 1331 - DNA, 4554 bp, Homo sapiens; identical to SEQ ID NO: 1329

SEQ ID NO: 1332 - DNA, 1780 bp, Homo sapiens
ctccaaacctccaggaggggctgacaactgaagatcttagagatgtcaaaaggaagaggacaaaaatgaaatgaagatgaacaaacagcagcactttcaggactattaaaaattatgtattcatgaactcagagccctctcacctttttggcagcctatcttgcagttttctccaatattctgtagttgctccaattcattagaaagagttatgaaagcactactgaaaagcaagcaatcattactatgatgactatttataattatcatgttgtattttgctgttgtatgttgtgttttgccattgtatgttgcattgctgtcataagaacatacagctcaatgccatataattgcattttattattttaatgacaattgtgtaatgtgtattgatagtcactaactccattttcggattaaatacatttaacaggccaaatggaattttgcacatttaaggggcactaacatctattatttacaggagaaaagagatgccctaaccttagtttacacaaaacatctttatttgatgctaatggtggccaaggagcagttggccagcaaaggcagttcctgtcatatgctttgaagttccagattgcctagaacttcaaattggaatgatgcctgttatggcaattttcaggagaagtgaaaaaggaatcttaaagatcaaaactaatttttgggaccatctgccgtaaattatttttgtactagttttttcatatataaagaaatctttcatgcataaatacatacatattcatatataaaactatacaggcagttcttgctgtgcacattttgatatgcatgtatttcagttatcatagttatagtgaaataacaccagtctctcaacaatatggtccaaatttcacttaccatcatatattaactattagtagttacaggaagtaccaacatctctgctagctctttagtccatcagatatcatgtgagggacagaagcacatcatgcctgggattcacttctttcaaagcctgtcagctattgttcattgcacatttttatgttactcagtttgctcacagacagcaaaatgtgtagttgtgttgtttccttgttgtctccttgtctcccagtgataaacgcccatgacattttacaaaaatgggcaaaagagggcagtggccaacaaagataaaagtgcgacaaataaataaaaagtaatgctgaaagtgaaatctaaatagaatataaatggatttggagaacaaaaaggctatctatagaaataatactgccattgttctagatatagccagaggaaattagtgaatgtagatttatctacacaaataagaaacacagttgtgatgagaagactgtagatatcccagaggaagtaacaggaactgaaatctttgcagtaaaagaactctcagagatatttcgtcacattgaatacacaatgagtaaaatgttagaagctgatcccaacttagaaagaagcaaggcaatttactatgtcatagaaaagatgtgtgtttagttttgtaatttttataacaagaaggcaaacactgttcaaactatccttgatagtttatttttaaaaagaatatccttatataaccatagtactctgtccaaacaaggaaactgacattggtaaactgtgacatccatagaacttattcagattttaccagttttacatgctcacatcttctctctgtgagtgtgtgtgtgtgtgtgtgtaattctatacaattttattacgtgtagatttgtgtaacctccct

SEQ ID NO: 1333 - DNA, 1780 bp, Homo sapiens; identical to SEQ ID NO: 1332

SEQ ID NO: 1334 - DNA, 1780 bp, Homo sapiens; identical to SEQ ID NO: 1332

SEQ ID NO: 1335 - DNA, 6181 bp, Homo sapiens
aaaaaaagaaagaaaccctctgtccctgataaccagagaaagaactctgaaatgcaagctctctacctctgcccctccaacttcatgaagcaagtctttgcatcacggcctgctgaatgcattcctatcacccaactgtcctccacattttttgtatgtgacatcctgaacctacttgggtgattctaaaacatttccagtgaaagttaatcttgtcccttttccaccctggctcattagctccaaatagcccaggtaagacaggtccaagcaagttctatgactgtgaactcatagaaggcctattcacacctcaaagcctacctgctgccctccacttttcatgtacatcctgtccagtgtactctctcagctgagctgagaacagtgctaagggagtcaaaatagttagcaggtactgctgacagtcaggagaaagacagcaaaaacaaaacaagtaaaaactttttcttctcctatatcctccacagatcctttcactaaccaacagtttctgcatggatagcaacagcaccatgcagttcactgctatatcacaacatcaaacttgaagccttgtgcccaaaggtcctcggcctttaactgcacatgtgaaacaccctctgaaaaaagacatggcctctttctttaaaggtgcctccagttccaagtggcctccctccatcctgtgagatagttccgtctggaactgttaacccaagcttcacgatgcgtgtcggtcctttaagcatccacagatgactgtgaaatacagattacacttagcaactatctataagtgagtgaaatgcctgtaagcatgctagcacattaacgggtaacagttctgtgtctaacctctatacagagctgactgaccaggtctccagtgcttcaagaccaggactaaggcaggctaaaaacttttgaacacttttattagtgggagtgctcctgcaaaagccaactttagcaggctttcctcacatccacctcagacgacttttattacctatgcaccttcatgtggccaaaacagctcaggatttagatcttgggtcctctcgcttagtagaggcccatcctgccaggaaactagaggttcactaagggtaagactggccatatcatgaggggaacttccagttgagctaaacctcttaccacaggggtagcctcaacatctgcagaaaaccaattatttttcctctgtcccacagctgaaaagactgtcttcagattttaaagatgtgacaccccatcaccttctgtcctccagccccaagactcccaaagactgtagggccctctgagtcaccactggcaagtgagaaaggcacaacaatgacagcagacaggagactgctctgagttcaatccttagttcctagtatggggctcagcctctatgtggtaaaggaatcagagttcggattgagtcctgcaagtaggcaggctcaaagccacaaaggcaaggatacaatggatgaaaacaaaacagtatgagctgaaggatgccaaaccaactgcttataataaaatgtctgagacaaaaggaaatgtctgagagaaaaggagagggttgggagccacggaaataaaaggtagctgagcctaggtatatgtaagccacgcatatctaagcaaaatgcttagacagggtagcctccagaatgtgtcagtttctgagcactctcagagacagaagtttggagaaaaacagccattgaaaggaacaaaataatgccttttgcaacaacatggatggacctggaagccattattcaaagtgaaataacacaggagtggaaaaccaaaacccctatcttgctatgagtatgcaaaggcatacagagtgatataacgggcttcagagactcagacgagggaggttgggagggggccagagacccagatgagggaggttgggagggggccagggataaaaataactacacattatgttcaatgtacactactaaggtgatgggtgcactacaatctcagaactcaccactggataattcatccatgtaacccaaaaaacacctgtatccaaaaaaattactgaattttttcagatttattttaatagaagaactacagagaaaaagtttattcttaactgttgaatagcactctaccacaagaaaacctcaactctaccatctgtctgctcagcagtcttgaccagtcataatttgtaattacatcaccacctactacaacatgcctgccccattgacaccctttccatacaatcttgactgcaaggtgaagcctcctgtcattctccaaaatgaatgtcaaatgtgaggctcccctgagagcattctacgctgtccctctcaaaccacagataaactcttcgcttcaagtttccactgccctttgtacaacacctacacaaactagtatgaaatctttcccagctggcctccctcagaaacagatctaactgcccaggttccatcttttctgaaacttaaacttcaactgcctattccctccacctgtcttcttccttgcccaccaaaaaggcactagtctccccactcatggtcttgatcatctccttttgcaccagtctccaattctctaaaacaaatgggcaaacatcacccactatctcaaaagaaaatccctctttctgcctctttctagtcactgtcccgtatcttctactttgagaataactgtcacctttatgagattcagtcttctcaacgttcaagaatggtaatccataaacccaagtctctgtttggttggttactctgattttctctttttgatttctttaaccagtattttctacttttcaggaaacagaacctgcaccacctagaccctgttcataaaccttctgcaatatgaaatctccctctccccatacacacctatcactgaacacaagctgcccagtatcaatgaggtttctgtgccaactattcagacagcatctactgtaactcttttgagcagtgtttcagtcctctatttcagtcagcacttacttctgtcttatcatctatttgcaagttgcaaggcaagctgaacccaaagcattaaggtactgtccttccatccacaactctctcaagcatccatgtatttcaccaagatctgcagctaccatctccttatcctaccaccaaatattcaatcaccctgttccacatgtgcttcctccacaccacagctggggatgtatattctaaacccctgtcttctttgccatcttccaggtgatacttgtgctctctacccccactcacaatgggaacaggcactgccttagttcccattactcgtgtgcaagttcatcatgggctcacccaaactctttctttttctcccatccactgtaatggcaatcacccacaaaaacagacctaatctcccattcttaaatccagtgacttccatttccttggtcttcaacaactaataccaagttgttacggggaaatattatgtctgaaatccatcaggctgttttcccaagacccacaaaataccacttttctagtcttattttcaagggtggagggctgtttggatgttctgtctctccactaacctatgctacctggtggattaataaactatgaaaaggctccctggtgtgtccctgacataactgacgtcccaggagcctctgattctccactctgaactcgctgtgtccttggctcaagccaagctaaactgggtggggtttgtgacagggaatgctcccttccagctgcccaaagaaacaaccagcaaacaaataagctcaatcaaaacttcccaagtctctcacctgttacacaaggataaggccaataccgtaacccagggcaaccatttggcacttctcgctactatgcgatagtctcctggacacaaggtttttacaccctggctggccaatctggtagggccagtactaggtattaacaacactccagtatctccttgtcccactccatctccccctacttaaaaattcacagggactaccaatctgcattgtctcttgagatccaaattccatacaaaagcagaaaccagtcatcagatttgatttcctctgtgctttctaccttttaggtacaaaagaatccaacaccctacgcgactgaacacactgcatgattcaaggcctagttcctatcatctaaaacaaagtacctcctgtgggcgaatccacaaaaacagaatggaccctgcatcaagggacacgaccaaataagtcagaaacaaccaaacaaccgatatttgtcaattcctttagggactctaatgtgtttcccccagagaaataacagagaaaaaggcaagctggttaaactaagtagaaacaacatccaatgaaacgttgtgattcacttacagaatgcatctcatattcagatggcatctggtcactgtaagtgattgggtcatgtgaaaaacaaagtcaccccatgaccctaaatccagggaaaagaggaatggatgactgaagggtgatcctggtttccaaagaggtcttccctacacagaaaaatggaaggtgctgtccacacagaaagcaactcccttgaaagtttccttgaaacttcagccattaaatctggggagggaagagggagttttaagggcagaggcagacatcaggcagtcaatcatcttctatgtctagcaagtgcaaggcagcactactactaacatagtcacagaaacctggcaggaaagcatattatcaccatttacaaggaaaacaaagactcaaaaaaggttctatgtactgttgcctgcagttacacaattaatcaatgacaagaaatctggatttctacccaggccttcctggtcaatatcacagatctttcctgtacagaaatatcttgtccttcagagaactccttacttgtaatcccgtttctaaaacagtcttgtgtggaaaatccattactttctatcagtgtgcacctacatgcctggattaaacaaccagacaaacaagtagagataggaaatattcccggaatctggcttaaacaccctctgacaaacttagcaaccgacctatctgtctggaaattacaaagctcacttgacttgtgcaacatacctttgcctcttccactgtgatgcggtgaacagcaaaacggcccttggtgtcatagaccaggcggaaatgttcacctgtcttctcgatgctgatgacatctgatcacaaaagggtataaggaacatcgttaacacaaacacaaagtttcttttgcctgcacagcaggaacactctatgccaggttgaacctgagaacgttttagcagcctaggagtccccagggcttggcggaggtgcttgaatgaaaccaaccaacccctgctcctctcccaatacatgtcatccaacaaaagaaagtgaatacatttatggctgctctattgcttcctatgttcttgtgcaatagctgcttgagactgtgtgctgggttaacgcactcaggatcctgaggagaaaacatacatgagcacacccacaaataccaggaaaccaaatgaacaagcagacctcacatttaagcaagcaaggctccaggctcagcaggctgcccaatcaatgtcctggccccatttacgccctccatgacttcgcttatcaggagtcctgcctcactcaggatttggggttttgagaaacaaagcaaaatgctaaaaaaaaaaaagaggaaggaaggaaagtaagaaaaggaaggtctgtcttttctaactcagtggctggatcctaggaatgtccggcctggaaccccatccactcggtagcatccacacctgacaaagtaatcatccccctgctttctggacaatgctaggctaaaaagctgtactgagcctttcaccatgaaaagggtgaacaaagcactaggtcagaattccttacctttccctaccttccctcttggtacactttttccctagaggtgtgtgacccttctgcccctcctccaccctccccgccaaaaaaagctgcaaatccatccttggagatccagaatagttaagtcatcaacgaagtgggaagacagagccaaaaccctgttcactgacaaagattctctccttgaccaatcgttagccagtttcctctgagccctcttcttggctaagcttcaaccttgacctatgaagacctcaacactaa

SEQ ID NO: 1336 - DNA, 6181 bp, Homo sapiens; identical to SEQ ID NO: 1335

SEQ ID NO: 1337 - DNA, 6181 bp, Homo sapiens; identical to SEQ ID NO: 1335

SEQ ID NO: 1338 - DNA, 642 bp, Homo sapiens
tttctctgtctcgctcttcctccgccccccgaccacacccccttaaagggccagcccctctacaggcccctctcccctactccgcccccgggcaggggtaggggagggtctattcggcagggggtggcctagctgtccgtactccccaaacgcaaccttccagtcccaaacccaggcgttctaagcgctcaggacgacgatttgcgctcacgccaggaccctagtcttcattggacccttcctcattctgtcctcattgaggccatctgagaataggggctatctgagaatgcaggggagtggacatcgtgtgcagacagggagtctgattgtgagtgccacggggctgaggcctgcgccgacctggtctgctggtgctaccaggcttgaacagtcttcaaatccactgctattaggcaaattacctggctcccgctgaactccagcacctagaactatgtcacactcgtagtaggccgctgcattggttgaacaaatgattttgaaagaatgaatgtcttcctctgtgcctgcatttcctcagaaggctgtaacaaagattaaataggaaaattcgtggaaagttcaattactacaccacagagggttggtgtgaaggtctccagccatgtccgtgtccac

SEQ ID NO: 1339 - DNA, 642 bp, Homo sapiens; identical to SEQ ID NO: 1338

SEQ ID NO: 1340 - DNA, 642 bp, Homo sapiens; identical to SEQ ID NO: 1338

SEQ ID NO: 1341 - DNA, 1849 bp, Homo sapiens
cgggcgcgtcatcctccgggggcggggcccgggccgcattgtctcgtctagggccggctggacgccccagaggccggacctgggcaaccccagcctggaggtgccggggccggagctcccagagggctgggtgcgaggcctaggcggggtcaggttcgggttcctaggccatagcggagctgcagcccaggcggccggagcggaacccagccccgctccgagtgccacgtctccaggaaccccctccttactcttggacaacactccgcccccgcccgggcctccgtcccccaaaccgccctcatttgtgcagcgccagatccttcggacacatccctaggtgtctccatcctcattcggtccatccaactcccagacctcacgtcaaccggctgcaccccactttccagcctgcgccccagatctgcagccttcgcccctagatacacccgcctggtgatgaggcgctcctcgcgttccttccgtctccagtgcaccggctttccctcgtcctctgcgcagtccatctcagctcatctctccaattcaatgccatcatctctcctcaccatctctcggtgccctggaatgtttgctgtcagatgtcccctgtgaaacccacaaacgcttgcgatttggcctccttgttttattttgtgtagtcctacaacgtcttgttactaccccctattacaacacttataactcagtatttgtcttttttccgcggtgtccctgcactctccccatacatattcctctcctgccagattgtaagcctctagagggaagaagtaatgtctctctccttggcaccaggcacgtggcacacgctccacaaatatttgttgaaagggagggtaaatggccttgagtttctgtggctaccattggctgaggatggagctttgggctggacaaagaagaatctggttgaccacatgaagcaggaaggaggctcagaacggtgttgagggagcctccacaatgggtgggcaccacagtggcaccaccagcacccctaatttgggtctctgggctgaggggcccctggcagcatgctcaatggccttggatagctggaatgtttggaattgcctgcatcttggatgaaagtcttaacaatagaatgaaaactgctgcaacactgtgtcagcactttacagaccaccactgtaaattcccagttgaaactgggaatttggaattccatgttcaaccaaatcatgctgagtgcccagcacagcgtctgacacactaaatgctacaggtgaattccctttttcctctttcctggcaggaagcggggataggggaaccactagaaatactgtaataacatgaataagacaaggccattagccgggagcaaatcatagaacatcagccctgtgaaatgagtggtattagtgttaccatttttcagatggagaaattgagactcagaaaggttaattagccaaaaatcacacagacagtaatagcagagctaggaaaagaatgttcatcctagtacctaactttgatcttcccaaaacaccaaactgacttctaaagctgaagaaagaggacacagaagcttcatctcagatctcaccaccagctgccccttaatctgccaacatcgaaccattctctcccctctagactacagtggcttcaaactttgacttatctccagtatttttttgtacatagcaatagcaacaaaagtttcacaaaacaatattacctttgtatggccaggcacggtggctcatgcctgtaatcccaacattttgggaggccaaggcgggcagatcatgaggtcaggagatcaagaccatcctggccaacatggtgaaacccc

SEQ ID NO: 1342 - DNA, 1849 bp, Homo sapiens; identical to SEQ ID NO: 1341

SEQ ID NO: 1343 - DNA, 1963 bp, Homo sapiens
cgggcgcgtcatcctccgggggcggggcccgggccgcattgtctcgtctagggccggctggacgccccagaggccggacctgggcaaccccagcctggaggtgccggggccggagctcccagagggctgggtgcgaggcctaggcggggtcaggttcgggttcctaggccatagcggagctgcagcccaggcggccggagcggaacccagccccgctccgagtgccacgtctccaggaaccccctccttactcttggacaacactccgcccccgcccgggcctccgtcccccaaaccgccctcatttgtgcagcgccagatccttcggacacatccctaggtgtctccatcctcattcggtccatccaactcccagacctcacgtcaaccggctgcaccccactttccagcctgcgccccagatctgcagccttcgcccctagatacacccgcctggtgatgaggcgctcctcgcgttccttccgggctccaggtgtccgtgagcctcccttccgccctggcctccggtctctgccttgctcgtgcttctaccaccacccttcccctcccaacccggtggatcctctcgtctcccccagtctccagtgcaccggctttccctcgtcctctgcgcagtccatctcagctcatctctccaattcaatgccatcatctctcctcaccatctctcggtgccctggaatgtttgctgtcagatgtcccctgtgaaacccacaaacgcttgcgatttggcctccttgttttattttgtgtagtcctacaacgtcttgttactaccccctattacaacacttataactcagtatttgtcttttttccgcggtgtccctgcactctccccatacatattcctctcctgccagattgtaagcctctagagggaagaagtaatgtctctctccttggcaccaggcacgtggcacacgctccacaaatatttgttgaaagggagggtaaatggccttgagtttctgtggctaccattggctgaggatggagctttgggctggacaaagaagaatctggttgaccacatgaagcaggaaggaggctcagaacggtgttgagggagcctccacaatgggtgggcaccacagtggcaccaccagcacccctaatttgggtctctgggctgaggggcccctggcagcatgctcaatggccttggatagctggaatgtttggaattgcctgcatcttggatgaaagtcttaacaatagaatgaaaactgctgcaacactgtgtcagcactttacagaccaccactgtaaattcccagttgaaactgggaatttggaattccatgttcaaccaaatcatgctgagtgcccagcacagcgtctgacacactaaatgctacaggtgaattccctttttcctctttcctggcaggaagcggggataggggaaccactagaaatactgtaataacatgaataagacaaggccattagccgggagcaaatcatagaacatcagccctgtgaaatgagtggtattagtgttaccatttttcagatggagaaattgagactcagaaaggttaattagccaaaaatcacacagacagtaatagcagagctaggaaaagaatgttcatcctagtacctaactttgatcttcccaaaacaccaaactgacttctaaagctgaagaaagaggacacagaagcttcatctcagatctcaccaccagctgccccttaatctgccaacatcgaaccattctctcccctctagactacagtggcttcaaactttgacttatctccagtatttttttgtacatagcaatagcaacaaaagtttcacaaaacaatattacctttgtatggccaggcacggtggctcatgcctgtaatcccaacattttgggaggccaaggcgggcagatcatgaggtcaggagatcaagaccatcctggccaacatggtgaaacccc

SEQ ID NO: 1344 - DNA, 1963 bp, Homo sapiens; identical to SEQ ID NO: 1343

SEQ ID NO: 1345 - DNA, 1963 bp, Homo sapiens; identical to SEQ ID NO: 1343

SEQ ID NO: 1346 - DNA, 1963 bp, Homo sapiens; identical to SEQ ID NO: 1343

SEQ ID NO: 1347 - DNA, 2167 bp, Homo sapiens
cgggcgcgtcatcctccgggggcggggcccgggccgcattgtctcgtctagggccggctggacgccccagaggccggacctgggcaaccccagcctggaggtgccggggccggagctcccagagggctgggtgcgaggcctaggcggggtcaggttcgggttcctaggccatagcggagctgcagcccaggcggccggagcggaacccagccccgctccgagtgccacgtctccaggaaccccctccttactcttggacaacactccgcccccgcccgggcctccgtcccccaaaccgccctcatttgtgcagcgccagatccttcggacacatccctaggtgtctccatcctcattcggtccatccaactcccagacctcacgtcaaccggctgcaccccactttccagcctgcgccccagatctgcagccttcgcccctagatacacccgcctggtgatgaggcgctcctcgcgttccttccggtaaccgcgttgcgaagaccacgctgccgggttgcaaacttggggggacttcctccctcccctccccctgggcgccgtgcaactgccctgggaccgggttctgggatgaggggggcagaccgggctccccagcggccggcgcagcacgtagcgcacgtgtagggtccgctccccaccccctcgccgcctctgacaacttttcagggctccaggtgtccgtgagcctcccttccgccctggcctccggtctctgccttgctcgtgcttctaccaccacccttcccctcccaacccggtggatcctctcgtctcccccagtctccagtgcaccggctttccctcgtcctctgcgcagtccatctcagctcatctctccaattcaatgccatcatctctcctcaccatctctcggtgccctggaatgtttgctgtcagatgtcccctgtgaaacccacaaacgcttgcgatttggcctccttgttttattttgtgtagtcctacaacgtcttgttactaccccctattacaacacttataactcagtatttgtcttttttccgcggtgtccctgcactctccccatacatattcctctcctgccagattgtaagcctctagagggaagaagtaatgtctctctccttggcaccaggcacgtggcacacgctccacaaatatttgttgaaagggagggtaaatggccttgagtttctgtggctaccattggctgaggatggagctttgggctggacaaagaagaatctggttgaccacatgaagcaggaaggaggctcagaacggtgttgagggagcctccacaatgggtgggcaccacagtggcaccaccagcacccctaatttgggtctctgggctgaggggcccctggcagcatgctcaatggccttggatagctggaatgtttggaattgcctgcatcttggatgaaagtcttaacaatagaatgaaaactgctgcaacactgtgtcagcactttacagaccaccactgtaaattcccagttgaaactgggaatttggaattccatgttcaaccaaatcatgctgagtgcccagcacagcgtctgacacactaaatgctacaggtgaattccctttttcctctttcctggcaggaagcggggataggggaaccactagaaatactgtaataacatgaataagacaaggccattagccgggagcaaatcatagaacatcagccctgtgaaatgagtggtattagtgttaccatttttcagatggagaaattgagactcagaaaggttaattagccaaaaatcacacagacagtaatagcagagctaggaaaagaatgttcatcctagtacctaactttgatcttcccaaaacaccaaactgacttctaaagctgaagaaagaggacacagaagcttcatctcagatctcaccaccagctgccccttaatctgccaacatcgaaccattctctcccctctagactacagtggcttcaaactttgacttatctccagtatttttttgtacatagcaatagcaacaaaagtttcacaaaacaatattacctttgtatggccaggcacggtggctcatgcctgtaatcccaacattttgggaggccaaggcgggcagatcatgaggtcaggagatcaagaccatcctggccaacatggtgaaacccc

SEQ ID NO: 1348 - DNA, 2167 bp, Homo sapiens; identical to SEQ ID NO: 1347

SEQ ID NO: 1349 - DNA, 2167 bp, Homo sapiens; identical to SEQ ID NO: 1347

SEQ ID NO: 1350 - DNA, 2167 bp, Homo sapiens; identical to SEQ ID NO: 1347

SEQ ID NO: 1351 - DNA, 2167 bp, Homo sapiens; identical to SEQ ID NO: 1347

SEQ ID NO: 1352 - DNA, 1119 bp, Homo sapiens
tagaggcctcccttccgaggaggcggtgctggggcgggcgcaggactgcaggctggggctccgctccccggcgggagcccgcgcgtggttcccagcgaagtccccgcgcggctgggcccagcgtgagtattctccgcccgctgtcctccccctggaggcggcagcgcccgtttatttgaggcttctaatgtgaggaaaaacacggaatgacaagtgtgggaaagagcaagcactaaattactgtcagaaaaataaacggagtagcacagtgctgctcggtgatttacgggggcaattagtcaccaccccacggcgctgctgaggacagcacggcagcagacaagtcaggcccatgaggaagaagaggctttgcactgctctccagacaacttttcaaacaacaagagaggatatttgagcacattaggttttgtgtcttcattctggccgtgtgaagatgtgcctgcttcgccttccatcatgactgaagtttcctgaggcctccccagctatgctccctatacagcctgcagaacggtcggctgcctccaatcctgaggtcatcactcatcaagaggggataatcccagggacagcaggatctgcttcgttacttggatttaggagccagaaacccatcaggcaactaaacagtaacaatgacccgccattaaacacactgagagaagagcatgatgaagagtttgtacaagaagaagccaggagcacttgctgacaatgcttacagagacgcaggcttctatgagctctgcctgttgaactgcagtaaaaatagatctccttccccagagaggcttggatgtgggcacaatatcagttcagacgatggtcaatgcatgtacttaatagagtgaaaagactttggactgtgaagtcagattacctgggtctgaattgttattcttctacttctttgtagtatgctttcaccacattaaaaattgtctgagcctcaatttttttatctgcaaaatggagctaatacctacacaggggcttttaagagaatcaaatgcaacaatgtttgaaaagcaacatactcccctttatggaaaaagagcctgtaaaggaaccaatacaatggctgggcgtggtgac

SEQ ID NO: 1353 - DNA, 1391 bp, Homo sapiens
tttttgtattgggtttcaccgtgttggccaggctggtctcaaaactcctgacctcaggtgatccacccgcctcggcctcccaaagtgctgggattacaggcgtgaaccaccgtacccggcccccaaatgagttttattctggtctgggtatcctggcaggaacccttgtagagcagtcaaagtgaaagttactcaaaactagaaatacctgaaaggccaccaagcacagaaaaaaaaccttaagttggaagcgggggcaaggtgccattttgtagcctcattcattctttagggatctggagttttggaatgaacctacaattttcattcttgggtctccgggcaggagtactttgttgtactatacctaatctgaccccagaagtatttaaagatgttaactttcaaagcctcactacattaaatacagaattctcccttggatctaccagtcctggaggcatcccagaggggttgggctgagccacaggaccccaaaggaatagaagcatgaaaaaggccagtttaaggggcagggtgaaccagattgagccactgtacgccagcctggacaacagagcgagagtctatcttaaaaataaataaataagcagaaccaaaacttaccagttaggttcaaggattcagtaagttagtatgtggagtatttacagcagcaacagccattcccccgttggttttgagggttatggggtaaataagggtccctggaatcttgtggaacactcagcaacctctctagcaatagctgaaaaaggagatatactggaaaccccccccccccccaaaaagaccactgctgggtttccttaagtctgtctttccccagaaggagacacaggagggagacacaaaatttaatttaatagaaattttgtttgtagttcttacattctcagtgtgagccaatctgggacccactgccccacccagaagtggcccagtcctgggggcaggggagaaagggaggggtgaaatgagaagagccccgttcttcctcagtgctggggggttggaggggagctaagagatgagagaaggggacagaggcaagaaaagatgttgatcaagaaagatgagaaccaggggtgagggctgaaggagaatcaaagataaaataccagtttaaaaaaaaaaaaaaaaaagggcggggagggggtgggggagagtggaggaggggaacaaaaccaaaatccaccccaaatccgaaccagcctggaaaaaaatgaaagttctcgagtctcacagagacattatttggcgcggccagctctgcggcaggagcgctcaggcctcagtccagccctggaggcaggcctctctacagctcgtccttggcctggccggggacatcttcctcctcatcttcc

SEQ ID NO: 1354 - DNA, 1391 bp, Homo sapiens; identical to SEQ ID NO: 1353

SEQ ID NO: 1355 - DNA, 1391 bp, Homo sapiens; identical to SEQ ID NO: 1353

SEQ ID NO: 1356 - DNA, 1391 bp, Homo sapiens; identical to SEQ ID NO: 1353

SEQ ID NO: 1357 - DNA, 1471 bp, Homo sapiens
cctgcggcctctacctttgacgtcttcccccgggaggtggcgggggtctgcgaccgaatgccggcgggactctgggtcagggcttctggcgggccctgcggggggcagcgaggtgaccgtgaacctgcggctcatggcgcggaaaggagccaggcggccgcggcaaggtccgggatcgcacaagtggctgcaaccaggctctaggagggagaaagagcggatcccccaaccccctccgcccgcccgccccccgcgagacgcggcgccgcgcagggtcctagtgcccgctgtgcgaagggttcctgaatctggccacttcgctgggaggccctgggctccccagtgccacccgaagggcctgaggaggccatctgcagaatttgaccactcactaagaggagcttagtgtggtgtctcacgaagggatcctcctcagccctcacctcggtactggaagacgtcgtgcgtgtccaaaggcaccccggggaacatccggtccacctcgctggcgctccggggatccaccatctgcgccttcacgtcgaacctgcgggcaggcgcggaggagacaggtgctgagccggctagcggacggaccgacggcgcccgggctccccctgccggcggccgcggcggcgctcacctccagaggcgccgcccgctgaacagcagcatcttccccctgccactccggagggccccggtcacctgggccacgtcggctcccaggcccagcttgtccagacgcctcgggcccagcaccgacgcgcctgtgtacacccacacctggcgccctgcaggggaggagggtcacgtcggtttgggggcgcagagggagcacgtactcctagaacgcgaggagggagattccggcgaggcctttcctagcccgcgtgcccgcagtccctgcaacccaggggcagaggcgctgggtagagcgacgcgagggcgtggagaggagggggcagaaactcagccgcccctacgtttgctaaactgcgtccgccagggggcgtatttttctaaaacgcacaagacgtttcgtgggttatcgatggtctcttgagcctccttgactgatggggattgaccgggcgggggagggaaagtaggtaactaaccagagaagaagaaaagcttcttggagagccgctcctcaaagaccgagtccagcttgcggggcagcgcgggccacttgtcggcgataaggaaggggccctgcggccggctccccctgccctcagagaatcgccagtacttcctgagaaagcgaggagggaaaggacgggctctaagccttggacacagggccagtgggcgggaagggacgggcagcccctccgcaaagccccctcccgcatccacacaaccccgcctcctcacccatccttgaacaaatacagctggttcccaatctccgcgatggcgtcgaagatgttcacgttgcaggcatcgtccaccggactcaaag

SEQ ID NO: 1358 - DNA, 2041 bp, Homo sapiens
ctttggagggcgggactgaatgggggttaatcagaggatgcgattgctgaccctttgcactttggcatggcccatcccctaatttctgaccagaagccctccctctaccctaagctcgtgcgtcacgacgccgccagctgatcggagcctggagccggtgtgtgctgggtgccgagaagagacagcgccgccggccgtggggagcggacgcagtgatttgctccccctcgtgcagcaacccccacacccagcaccaggcccccagaactctccttccagctgaactccctgggaacaagtcagttgggctgatcactgaactcacatttctggacctgaggagcctgttcctctcacgccctcacctggctgagccgcagtagttcttcagtggcaagctttatgtcctgacccagctaaagctgccagttgaagaactgttgccctctgcccctggcttcgaggaggaggaggagctgctttccccatcatctggaaggtgacagaaatgggctgggaaggtccgaacagcagggtggatgatacgttttgggcaagttggagagcctttgcccagattggcccagcaaggagcggttttagattagagacactggctggattgaggagtagaaggctcaaacaacccaagcggctacaggaagctgtgtctgttcgatttggtgggaggagatgtgcagggagctgtatcttgtcctccgcttgtgaaaaactcaaggatgtggagaagagtagaccgtggaaccctgctcttctgcagccaagctgaggggcaggatgcgtgtgggacagtggtagagaagcaggggatagactcataggctgcaacaaaggtgactctgtccctggacactgcctccgtactttctccttgcttcactggccacagcatctccctccagccctcgctatgtgcctctgccatcttcacccatcatggagcagaggtgaggagaggcagcctgggaatatggagaccagtgaaggaccaggcctggagagcacagggtcctacctgggcatccagcagaggagcccctaaaggccaggagcaccccaagaggagggagggcagccagcctccattgacggcgagcctccagccctctcctactttgatcaccatttctctccaggctttctgcctccgagatgtggcaccatagtgcggtgccctgtggcttcaccgccctacttccacctccgcccagcctgtaatgtttatataagcagcctcaaggaccaagaaccatctgcgaaaggacacacacaggaaattcataaaagaaatctgaatggataaaaccatgaaaaaaagtatgcttcattagtaattaaagaaaggcaaatagagctggaagcatttttcccttagcaaaccataacagaaaaaaataagacccaatattggcaaagagactactgaaaaaacattcccatacattgcgtgtgggagtatacatcggtgcaggcttcctggatgacagttgggtgatatgtgtcatgtggcctaaaagcctccatgtcatttgacctacgaattctatctttgggaatttatcctaagaaaatacttaaggatttagttagtgataagatgttcatcccagcattgcaatggagaaaaatgggaagcaatggtttggttgggaatttattccttttctgctgtaacgaaagtttgcaataggggattgcttaagtaaattattgtatctccatccagatggtggagtaccgcgcagacattaaaagtcatgtaaaagaacatctgactgaaagaaaaatgctccttgaatattaaaaggttgtaaaaatagtgcatgttatgtgatttcaattttgttttttaaaatatgggtgtatgcttgtatacgtagagcagataaaaaagacggaaggcatactaaaaaatgttgagtggttatctttgtatggtggaacaaagtcactgtaattttcatctttggtttttctgtaatttccaaattttccacattttgtatttcatataatataa

SEQ ID NO: 1359 - DNA, 2041 bp, Homo sapiens; identical to SEQ ID NO: 1358

SEQ ID NO: 1360 - DNA, 2041 bp, Homo sapiens; identical to SEQ ID NO: 1358

SEQ ID NO: 1361 - DNA, 2041 bp, Homo sapiens; identical to SEQ ID NO: 1358

SEQ ID NO: 1362 - DNA, 2041 bp, Homo sapiens; identical to SEQ ID NO: 1358

SEQ ID NO: 1363 - DNA, 2041 bp, Homo sapiens; identical to SEQ ID NO: 1358

SEQ ID NO: 1364 - DNA, 2041 bp, Homo sapiens; identical to SEQ ID NO: 1358

SEQ ID NO: 1365 - DNA, 2041 bp, Homo sapiens; identical to SEQ ID NO: 1358

SEQ ID NO: 1366 - DNA, 2041 bp, Homo sapiens; identical to SEQ ID NO: 1358

SEQ ID NO: 1367 - DNA, 2041 bp, Homo sapiens; identical to SEQ ID NO: 1358

SEQ ID NO: 1368 - DNA, 2041 bp, Homo sapiens; identical to SEQ ID NO: 1358

SEQ ID NO: 1369 - DNA, 2041 bp, Homo sapiens; identical to SEQ ID NO: 1358

SEQ ID NO: 1370 - DNA, 2158 bp, Homo sapiens
gttcatttcactttttgcccatcccccgctcatctagactctgattggcccctggggaaggagcagcctgctcattggtctccaccttcgaatctcttccctaagtaggcctgagtcagtgaagagctttggagggcgggactgaatgggggttaatcagaggatgcgattgctgaccctttgcactttggcatggcccatcccctaatttctgaccagaagccctccctctaccctaagctcgtgcgtcacgacgccgccagctgatcggagcctggagccggtgtgtgctgggtgccgagaagagacagcgccgccggccgtggggagcggacgcagtgatttgctccccctcgtgcagcaacccccacacccagcaccaggcccccagaactctccttccagctgaactccctgggaacaagtcagttgggctgatcactgaactcacatttctggacctgaggagcctgttcctctcacgccctcacctggctgagccgcagtagttcttcagtggcaagctttatgtcctgacccagctaaagctgccagttgaagaactgttgccctctgcccctggcttcgaggaggaggaggagctgctttccccatcatctggaaggtgacagaaatgggctgggaaggtccgaacagcagggtggatgatacgttttgggcaagttggagagcctttgcccagattggcccagcaaggagcggttttagattagagacactggctggattgaggagtagaaggctcaaacaacccaaggaagctgtgtctgttcgatttggtgggaggagatgtgcagggagctgtatcttgtcctccgcttgtgaaaaactcaaggatgtggagaagagtagaccgtggaaccctgctcttctgcagccaagctgaggggcaggatgcgtgtgggacagtggtagagaagcaggggatagactcataggctgcaacaaaggtgactctgtccctggacactgcctccgtactttctccttgcttcactggccacagcatctccctccagccctcgctatgtgcctctgccatcttcacccatcatggagcagaggtgaggagaggcagcctgggaatatggagaccagtgaaggaccaggcctggagagcacagggtcctacctgggcatccagcagaggagcccctaaaggccaggagcaccccaagaggagggagggcagccagcctccattgacggcgagcctccagccctctcctactttgatcaccatttctctccaggctttctgcctccgagatgtggcaccatagtgcggtgccctgtggcttcaccgccctacttccacctccgcccagcctgtaatgtttatataagcagcctcaaggaccaagaaccatctgcgaaaggacacacacaggaaattcataaaagaaatctgaatggataaaaccatgaaaaaaagtatgcttcattagtaattaaagaaaggcaaatagagctggaagcatttttcccttagcaaaccataacagaaaaaaataagacccaatattggcaaagagactactgaaaaaacattcccatacattgcgtgtgggagtatacatcggtgcaggcttcctggatgacagttgggtgatatgtgtcatgtggcctaaaagcctccatgtcatttgacctacgaattctatctttgggaatttatcctaagaaaatacttaaggatttagttagtgataagatgttcatcccagcattgcaatggagaaaaatgggaagcaatggtttggttgggaatttattccttttctgctgtaacgaaagtttgcaataggggattgcttaagtaaattattgtatctccatccagatggtggagtaccgcgcagacattaaaagtcatgtaaaagaacatctgactgaaagaaaaatgctccttgaatattaaaaggttgtaaaaatagtgcatgttatgtgatttcaattttgttttttaaaatatgggtgtatgcttgtatacgtagagcagataaaaaagacggaaggcatactaaaaaatgttgagtggttatctttgtatggtggaacaaagtcactgtaattttcatctttggtttttctgtaatttccaaattttccacattttgtatttcatataatataa

SEQ ID NO: 1371 - DNA, 32757 bp, Homo sapiens
aggctagtcttgaactcctgacctcgtgatccatccaccttggcctcccaaagtgctgggattacaggcgtgagccaccgcgcccagccacgtaggttcttttttaaagactcagttcacacatcttcaggaagccttgcctaaccctcaggcacttaggggttagttcagtatctttatcacactgtttctaatcatccatttacttgtacaggtacctcctagactgtaaagttctctggggcaggatgcatgtctgattcatttctccattcccaggagtccagcttggcatcactgtttgctgaatgaaagaattaatgaagaattgttatgacatttacctttcatgaggcgattcgctacacaagggtgggacagagttggtttcattcactgaggttgtggtgcatgtacaggcctggcaggaagtaggaggtcagcaactactggctgaaggctgggtgtggtggctcacatctgtaatcccagcactttgggaggctgagggggcggatcacttgaggtcaggctttcaagaccagcctggccaacatggtgaaaccccatctctattaaaaatacaaaaattatctgggtgtggtggcatacacctgtaatcccagctacttgggtggctgaggcaggagaatcgcttgaacccaggaggctgtggttgcagtgagcagagatcgcctcattgcactccagcctgggcaacagagtgagactgtctcagaaaacaaaaacaaacaaaccccaactactggctgaatcaatgaatgaggattaaatgagatcctgtgaaaatgctctgaaactctacagatactgtttttattgttctgttcacatagtttccagccggcatccttttttttgtccatttggtcaccaccgactctacctccaggagccgaactgatgatggcaagaaagaccatgaagacactggaaaatcttgtggctgttttttttcctgtttgggaaacagcacctgcccttccagtcacaccatgattctttccccttccaacatctgaactggggagagcggtagaattttcactcactccatcagccaccatctagagcttatcaataagaagccttccgtgggccaggctccaggttactgccaggcacatggatgatttagacccagttccccactcactgggagtcctccccacatcacaggaggtgacgccgtcatcaagtagctgcagctttttcaaggccactccactccagagcttgctggggttgcctgcctgatgggcactgaggacagaagccagagagccgggaggtgctgaaggagccgtggctcctcctgggctgaggggggcccttggcaaggctcagctcccaccccaggaaaagcccttccttgggggagctcagagctcaggaagcagtcaccctcttgccttcagagtgggcaaataaagtgggtcaaagttcttcagaaattatgttcctgggacaaagacagtgacatcgatgcagagaagtgggcattctctaaagtgggccaagtcccctctatctgctgcctcacagagctagctagcactgacagcttccaaagctccctcgcacactgcgcaggcccccttccttcagctctggcttcctggagtcagggccgtggccccctcttcctaacaggcctgctcatctgtcccagccccactccccttcctcccggggctagaccgaagtctcccccgggatgccccctgcatcaccgctggagcgcagcctgatcctgcggtgccgccgccctcccttcctccttctcatctctatatatctgtctaatgaacatttcaataagccgagcacagctttttccacttaataagcagagtgctgacttcattgcgggtttgctcttcacttatctgttcagggccttaaatcattcccaggaaaaagcttagcacagggaaacctggcatcctggctattggctgctcctgtcagcacctgccctgctagggccgaggggaagccctgcttccacagaacagcgtggcagtgtgaataaaactcctgggatacccaagcatctggaaggctgaggactggggctgggggatgttggagccatcaccactgaaggaagttctggaggcaaggtggaaagggcaggggagtaggggagaactagaaagcaagtgaggttctggagcgagaaggcaagtttaatgagcacttactatgtgttgcgcattgggctaggcgctagggacaaaacactgaacaaaactatcattgtctctgccctcacggagttgccttctaacaggaaaggaacacattacacaaacaattgcctaaacaacagctgtgagggaaagaactggctttatgggaatgcatcatgggggctggagaaagcttcccttaggaaacgaactttaagctaaggtctgaaaaagttgggttgagacaggtgacaggtaacctagaagagaccaaaacagtccaataactgatctctttcaccggggctataacatgtcatgttgattgctatatgttgagatcatgtaaggtggtggcaaaaaacacaggctttggagtaagacacacctaggtctgaattctagctccgtaaactttctagctgcgtgatcttgggggaggttgtttaacctctctgcttcatttatcatttatcaaatggagtaaaaatactcaccttgcagggctgttgtaaggattaaagttgatactcaatataaaggatgtatataaagcacctggcatataggacatgtttaatatgcagtagatgctaccactaatggtactatcatatgtgtctatttcttccccaagcctactaggaggtctttgaaggtttagacaaagtcttacacattttatatctgattgaattagacagggagcagtggaaaagattctgatatttcacctggtgccagaaaagagccctaggcatccagccaaaggtatggcccttggtgtgcatacgcatatacagtgggggctgggccatagatgttattctctattctccagcatccttttggatttagttggcaggatgatttcagggcaaaagggtacagactcaattaaatgtgggcaagtgcaaggcaatgccttttgtgatgaacacatcaaaaccccctctccagtgctcaactctgcatggtcagccacggttctggcaaaggacctagaaatccttcttcatttagacagttccctgaggctgttggccaaaaggctaagagaactgtgaataagatgtgacggaagaaggagaacatgttccttgaggtgcccagctggaacagtcctacccgcagggctcagccgtggcactctgtcccaccctggagaagacgcagggcatgcaaaagctcctcagtggggaagggtcgatgactcaccacccagtctggaagtgagaaggctggtgggggatgtgaaggaaatcacaaatcacaaatggtgtagagaaggtgactagaaacttattcacaagatcctgaaactgtaggcaaagtgggtttgctttgaaactcgaacacatttgggatgaataaaggtgattttataccgtggccagtgaacttaagaaattcattctcccaaatggtgggtctagcagaaaacataaatgaatttaaacatctttggacaaatttatgagacacagtcatgtacatcccttaatcagtttgttcagtgaatgaatgaatgaatgaacgagtgaatatggatgatcctagttttcaaggtatttcagttcagagtgcctactatgagcaaagcattgtgcaagatgtaaaaatgaacagtttcgctctccttccttccttccttctttccctccctctctccctccctccctccttccttccttcctctctctctttctttccttctctttctttttcttccttttttcctttttgacagggtctcactatgttgcccagaactggtctagaaagaatacctaggctcaatcgatgctcccatctcagactcccaaagtgctgggattacaggtgtgagtcacctcgcccagccaacacaaacagtttctatcaagaagcttatatatatatatataaaatatatattatatattaatatatacatatgtatatatattatatatacatacgtatataaaatatatatacatatatacatatacatacatatatacacatatatatgtatgtggattgagaaagaagctccttcaactcagcccctagagagatgcagaatgagggcccagggtcccctattagcggagggattgtttcagccatttcgggcaccctggggttctcactgggcaaagacattcagctcagtgatatagtgagcaccatgggttcccctccctgtctagcaacatctgtaaagaggagaactttgcttaaaaatgaacaggaagaggccgggcgcggtggcttacgcctgtaatcccagaactttgggaggccgaggctggtggatcacaaggtcaggagattgagaccatcctggctaacacagtgaaaccccgtctctactaaaaaatggaaaaaattagcagggcgtggtgcaggcgcctgtagtcccagctactagggagactgaggcaggagaatggcatgaacccgggaggcggagcttgcagtgagccaagatcatgccactgcactccagcctgggtgacagagccagactctgtcaaaaaaaaaaagaacaggaagagcagacaggaaaaggcaagagagggaaggagataccctaaataggtccagccagtctgagggagttgcattaaaaagagggcaggtttaccagaggacagcaggtagagaggggtgtcatttgttcattcaggtcatcattaattgactagggagcatgtttgatgtgccaggcactgtgctaaagctaaggaaatacactacctttctttaagaagcacatagcactgggtgtggtggctcacacctgtaatctcagcactttgggaggctgaggctgatggatcacttgaagtcaggagttcgagaccagcctggccaacttggtgaaacctgtctctactgaaaaaacaaaaattagccaggtgtggtgatgcacgcctgtaatcccagctacttgggaggctgaggtacaagaattgcttgaacctgggaggcggaagttgcagtgtaccgagattgtgccactgcactccagcctgggcgacacagagagactccatctcaaacacacacacaaaagaagcacatagtctggtggggagaaaaacatgtggacagataattagaaaatgatgtggtgatagaaatacattctgggtaggggcacaaaggaggagacaattaacgacatcaaggaaggcttcaagaagggtgtatcactttagctgggtcttgaaagattagtaggagttcaacaggcagatgaaggcatagaagacattctaagcaaagggaaagctatatgcccagtcacagaggtaaaaataaattggtacattcaggccaggcgcggtggctcacgcctgtaatctcagcactttgggaggccgaggcaggcgaatcatgaggtcaggagatcgagaccatcctggctaacacggtgaaaccctgtctctactaaaaaatagaaaaaattagctaggcatggtggcaggcgcctgtagtcccagctactccagaggctgaggcaggagaatggcgtgaacccgggaggcggagcttgcagtgagccaagatcatgccactgcactccagcctgggtgacagagcgagactccatctcaaaaaacttaaagtaaataaatacataaattggtacgttcagtatagctggaatttagggtatgcatagaggccataggaactgagactgggcaggtaggtggggtcagatcatacaaagttgaaagccgggtggagtggctcacccctgtaatcccagcactttgggaggccaaggcaggagaatcgcttgagtccaggagttcgagacattcctgaacaacaaagtgagatcctgtctctacaaaatgtcaaaaacttagctaggcgtggtgtcgtgtgcctgtggttccaactacacaggaggttgaggtaggagaatggcctgagcccaggaggtggaggctgcagtgagctgtgttatgccactgcactccagcctgggcaacagagtgagaccctgtctcaaaaaagagtttgagtgctatgctaaggagactggagttgatcctataggcaaaaatgagccattgaagaaagttaagcaaggggtaagacatgactggatttacatgctagaaatatcactcttgaaacagtgtggaggaggaattaaggaatcagaattgtgggcagggagactagtaaggaagctattgcaaaaatctaagaggagggacaaagacaggtctgaactagaacaaccaagcagtggagataaaaaggaagagaccaaaaaacgagtgaaaaggtgggtggtgaaggtgagctgggagggccgttgccttctacctgcttgctatgaaattccagctggaactcagactggctccccacctggctgcatgcaaggaactgctctgatgcagggcactgggttcccaagccccacaggtttgcttcagatgatttctagggaaagggtagatcttcctgaccctccattctcttctcagctgattccaagtcccagatcaatgggatccccttcagcccaactgtttcctgtccttgggtctgacattggagcttttttctccaggacagagagctttattgagtatgaatacatcagagagcacaatcttgaaattcctgccaggattcctattctgtctcagcttgggatccagttctaggctaggggagtaagacagcaaaggagtaagggtaggcgagaaggacatgtcctaagcagtggcaagcattcctcaatttttttgcccaagtccctcctcaatgcctaccaggctgccagctcccaaattctgggctttgcctctttaatggctcttgctctctgtcctgggtgaagcctgagtggataagaagacccagccctcctcatctccatccttcctccattcctgggggcaggggccagagagatatctgttcgcttctgcagatacacacatcacccttctccattctgttctgtgccctgaaagctgatttctgtcttctgccccaacaaccaagcttgcttgccttcaggattcctatggggtttgacacatggaggacattagagaacgagaggagagaagcagttggggtgagtattgccctggctccttctctgccagccaagggttagcattcctttcctgaaagtcacagctcctcctgcagccgtggtcatagccgcagttcttcctgggtgctggtatatgctccttcaatcccaggggtagtaacagctcccctgtcgttgctagctctgaagtacttcaccttctctttataaatcgtcctttccttaaactttcctttgttaccccattcgtgggcctctgtttcttgctagaacactgactagtatagcaggcattctcagagatgggacactaactggaccatatatttattccagaaagttttcatcagtcttatcctactttgtctaccatgagtctttcaatactaagtgcctcctcctgttgatgggcagagtgtagagaaaccaaacagcaattgaatcccacgcccttggcctaggcagcttctcatagccactaggggttcatttctacaggtttgcagagagtacaacaatgaaaaagaagtcatctcgtttttagtgagagagaaactgagactcagagaatgtcaggactgggtagctggatgccatgaagcattcattcattcattcattcattcattcattcattcattcttatactcagcaaatatttgtagggcacttatcatgttcaagatactatgctagtcaccatggataccacaagcaataaacaaaatataatcctgatgtcactaagaacacaattttgttggagagaccgacaagcagggaggcaattacaagaagataaccttattagaagagtgggtatgaggagtgctgtggaaatacacaaaagtggcacctatcctactcttgtggggtggacagaagaaagcttcccagaggaaatgagtctaagctaagatctgaaggaaatcttggagttgacagggggaggaagagatagggagaagaagaagggaacagtatgtgcaaagagaggagctggaacacagtgccttgggaaaaggaaagtaactcagcacggctggaatttgtagctcaaggcggggcgtggtgagagattaggctggaaaagtggtagagatcagatgacatgtggtcttctaggctgcattaagaagtttagaggccgggcgcagtggctcacgcctgtaatcccagcactttgggaggccaaggcgggcggatcacgaggtcaagagatcgaggccatcctggctaacaaggtgaaaccccgtctccactaaatatacaaaaattagccgggcgtggtggcgggtgcccgtagtcccagctactcgggaggctgaggcaggagaatggcgtgaacccgggaggcggagcttgcagggagccgagattgcgcaactgcactccagcctgggtgacagagcaagactctgtctcaaaaaaaaaaaaaaaaaaaaaagaagaagtttagaatagcagggagccattgatgggtttttgttgttgttgttgtttgtctgtttgttttttgagacaaggtcttgctctgttgcccaggctggagcgcagtggcacaatcatggctcactgcagacttgacctccgaggctcctacctcagcctgccaagtatctgggacttgtatgtgctgccacatctggctagctttttctattttttttgtagaggtggggtctcactcctgttgcccaggctggtcttgaactcctaggctcaagcaatcctcccaaagtgctggacttacaggcacgagccgccacacccagcaggagtttcattttcattcatgatggacacatctgagacagcctaaaggaggccattgtgaggatctggagttttcctgctcacaagttctgagcctgctgcggagcctttttgaaatagtcttagatgaggcttataggacccaaccaagtagcctctatactccagtttcagtagcctgctgtccacggtttggtggcatataccaggcactagaggggcaatggcttccactggcacacatcaaatgacttccagcttggagtcaggccctcagaggaggtggctgccaaccatgccccataaggaggtaaaaatggaggtatgtgttaggaggagactagatctaaagcatagcttgtgggaatgggagcttgaggtgttcagtttatgcagcaggcaagttggggagcagagctgaaggattctgagtgaagaagtgcgtggtaaaatctcagtcttaggatgtataacctagtgattattaacaaggtgaattggaggtggggagaccaatgggaggttgctaccataatgcagaaagattttttttcccctttggctaatcaaattagtaaagatttaaaaattgataatgtggatgatggtttaagaaaatgggtataatcattcattgatgatgagattgtgaattggtataacctttctagaaagcagtctatcaatacgtatcaacagctttttaaaagtttataccttttgacccaataatttcttttctaggaccctaacctaaggaaattatcagacattctcaaaaatatgaatcctcatcagtcctattaataataacaaaaaaaatggccgggcacggtggctcacgcctgtaatcccagcactttaggaggctcaggcgggtggatcacatgaggtcgggagttcgagaccagcctggccaacatggtgaaaccacgtctctactaaaaatacaaaaattagccaggcgtggtggcccgtgcctgtaatcccagctacttgggaagctgaggcaagagaattgcttgaatccagaaggcgaaggttgcagtgagtcaggatcatgccattgcactccagcctgggcgacagagcgcctcaaaaaaaaaaaaaaaaaaaaaggcaagaagtgaagatgacagtaaacttgggtgacacttccagacctacaaaggataggagaggggccaattttggcagggtttagggggaagacaatgactttagtttctgctctgctgcgatggaggtgctaggagatatccaaatcccctgaatgcctgagtgatggatctgggctctggaaagcatggttcaagtgtgtcatgtgacactaggagaccagacacatgggggtggtgagtgaaatgaacagggggtccaacctggccatggagaagcattgcagggactagaacaggcccaagaacgccctgagcatctccactgagttgctgctgaagctacacatacactcagaactaaacgggctggaaaccttcattcaaagcctagctatgttatactttggtacagctcctgtagctcaacctcaggctgggataaggtaaggtatgaatgtggggcaagtcctgagctgccatgattttgtattgtagagaggttcctactcgtaaggatggaaagcaacctttctgcatctcttcaaggtatcttgctctcctgattccccatttcttattcctcctatcagcccatcactgttgagagggccgcagattctcccatgcacctaggggagatttgctctgttgtccctgatttcagggaactgaatgctgtccagaactctgcaaaaccaagaccagctgcatggtactcaacagccttcccagctaatgtgcagcccgagagacacagcaggctcctccaaggggatgtctccataaccccaagcatctccacccaacacctgcctctcttggttgcagtagagaggtcaagtctgggtcatctgggcttcttctcgagccttcttggcccacttctccaaaagcccctggccctcttggctttgccaaggggactgtggagggacaccagtcaggaatcaggagggctcaggcctacgctcatgctatctttttggcctatttgctctctttctatccctttgggcaattgagccatagggcctgaaacattcccaggcttctaccctgcaggggacaaactcccaactccgcttggctctaggtcctcgcagagctgcaggctgaggacagggcttctctggtggcttggagtccttgctgcttcactttttggagacaggacagatggagcccaggcgtaggataaataaaccaatgaaatctgagaaaacaatgtcctgctacttctcttcagagctactgcccaccccctactcagggcgaaggtgggtctgtctgccagctaagatgctggtgtgggattctccccatccctggctggagacccctcattcaggcggcccctgcagcttggcgtgtttacctaacgtggtgaacacatgctctctctggaggatcattgttttccctctgaggcccttcagtcacactggagtcccccagttaagaagcagcaggaggaaggggaggaaggggtcactagaatggggaagcagaactgggagggaagagacatcaggctgatcacgctgggcaaggagggaagagagagagggagttccaaggcttcaggacctgctggctggtgaacacctcttactgttggaaacaccaggattctaggaatgatgggttgcgagcaagagactatcactcttggaattcaccctttttgagaaccacagaaaaggtggagagagaaaaattccccttggtgataaaagttcctcatgtgcgctctgcctccttcgcttaaacttgaccttcacttagcaattgttcagagagcctcctatatgcaaggcattgtgctagggactggggctaatgaaatgaatagttgggaaagatggccttgtatatcaacattgcaatgctacatcatagctgtttttgtttgtttgtttgtttttcccgagacagagtctctcactctgttgcccaggctggagtgcactggtgtgatcttggctcactgcagcctccatctcctgggttcaagtgattctcgtgtctcagcctcctgagtacctggggttataggcatgtgtcaccatacctggttaatttttgtatttttagtagagacagagtttaaccacattgcccaggctggtctggaactgatctgcccgccttggcctcccaaagtgctgggattacaagcataagccaccacgcccggccaatcatagctgttttgagagtgtcaagaactaagtacagtagttgcttactagaaagaaagggtttccacttatgtttggaggggttagggaagacagcatctctgagctgggttttaaagaatgaggctgggcgcagtggctcacgcctgtaatcctagcactttgggaggctgaagtaggaggattgcctgaggccaggagttcgagaccagcctgggcaacacagcaagaccctgtctctacaaaaataatttttaaaaattaagccagatgtggtacctgtagtcctagctacaagggaggctgaggtaagaggattgcttgagtcctggaggtcgaggctgtggtgaggtgcaatcataccactgcattccagcctcagtgacagagtgagaccttgtctaaaaagaaaaaaaaagaaaagaagaattgggagagtaccagaggctgaatgaaggagtctaggtggggagcctggaaggaagaaacattccaggtaaaggaaatcttgtgtgcaaatgctaggaggcattagagagctctgatgtaatcctggaagcaatgaggagctgttggagtgttttagacaggtgttagagtcacgttttaggaagatcatgtgagcagcagtggggaggatggacggcagggagaaagactggatggtgaacattggtcagaaggattttttagacagtataagtgagctacagggaggacctgaactaagtcagtagcaggggctagagataaggggacatatataagggacgataaggaatccacaggatttcgtgactaacgagacatgggggatgtgaggccaagagagaagacggtgaggatgcctaggattctggcttaagggcctgggacaatagcggtactgttcgtggtagagagaaaatgaaggaaagagaacaagttgcgagttgatgtgtgcgggtgctgggggtaataagactgtgttaagagtctgggttgagatactcagtatgcagtaggtagatgggcctagagcagctataccaaagaccacttcaagatctcatgactggataactgagaggatgacaatgtcatcaacagaaataatgaccgctgaaggtgaattatcatgggagttggggctacatggcggattgaattttgagatgtctattggacaaagcgctgaagatattcaccaggcagttggaaaaatgggaccagagcagcacgaggtcagatttggagctttatattcaggagtcctctaaataaagataatagctgcagctgcaggaatggatgagctcatcagattaaagtgtgcaccgagagaagagggtcaaaggtagaacactgggaaacacctacttttatttagggtggcaggagggcaaagagccagagaaggagctgtctgcaaggagaaccaggaggtggtatgagagatgccgagagagaaaagtgtttcaggagggtgaccgcagggttaggcgaagagatgttaagaagggtgaacaccaacatggacttggagatgtggatgaacaatctttaggagaacagattcaccaaagaggtaaggactgtggcagaaatgagccagtggagagaatggaagtggttaaatataaaaaagcctttgagcagtgaggcagtgaaggggacagaagctcaaggagtgaggagggtttaaagaatgtgttttttaaaatggggaaggcttggtccagttgcatttttgtgacacacacaaggagacatcttcacttcagctctgtctcacagggctgttggcaatgccttttcccatcctgggggctctcgtgtccacagattcccagggcctaatgtgccaggcaccctggaggaagcatccctctcaatgtgtgacaacatgaacaccttggttttcttctcccttctttctgccctgcttccttctcttcctttgcttatttacttgctgaacccctccttagtgtcatctgccttgaggggtatgactctgggactggggcaggtgagagaggaccgccaggaggcgcctggagaggctgctgtagcaatgcagttgtccatagcaggtgggctggagaggagagtggatgtgggagagggatttgagactaaccagacatgggtggagggaaatgcaggggcagagctggctcagaagtcccagctttggggtgccagcgaggggtcaggagtgatgcccgaggtcttacttttcagagccagagctcggtgcatcaatgactctgaagcaagcactccatctcggggtaacatgatcctgtaacgcagggctcctctgatgtggtctgcttgccttttacagcattaggggagcaacatttcatggaaaattcaataaatccccctgtacagccagacgtctgtaaacaatggcttccaaattcaatcaggctggggacccgcagcagcatttatgagctctaacgtggaatattatataggggagtgagtagcagggggctgggggaagggacttcctggaagaagaaagctcctgtgtggctcctgctctcagatgttgcggtggaggtgattctccaggtagaagtcctagccatgcgacctcttaggctgggcctggggggccactgagccatggctctgggcctggggaggaggacagggatctggccttctggtactggccatgaagaggctgggtggccggaagaaccaggaccgagagtgagctcgccagcttctcctcccacgtcctgcagcccatgcttacctggcaagcagtgtgagtcatctcgggtgcttattgtctttgtcacaccttccacctccttttacaaaccttctacccactttggttctatggtctggtgatgatcttcagagaactagcccctttctctctcaggttcagaatgcccctcactcagttcagaaaggtttgcaatgaggtaggagaacatgcaagaaagggtttctcctcgtctctactataaatagaaaattagccgggcgtggtggcgcatgcctgtaatcccagctactcgggagactgtggcaggagaattgcttgaacccaggaggtggaggttgcagtgagccgagtttgcgccattgcactccagcctgggcaacaagagtgagactccatctcaaaaaaaaaaaaaaaattgggtttctgatgaagaggttgcagtatgctgttttagggaggctcagaggtctcacccatctttaggccccctagatatctcctctccttggccctgtgaacccctctacactctggtcaggtctcctagcctctgcacccccacccccactgttgcccttgcaccctctgccaggctttctccagcaaaccacaaggagcataattgggcaaagggaagaactaaaggtctggattcaaatctagttcttcccatttccctgttatggatcttggattagtcacttcctcctctgaatctcaaggtgggaataacgtgaactgccttgctgagtgcctgaggataaaattagataatggatgtaaagtgcctgaaagttaatggcatggaatcagcatgaaatacacagtagctttcttctccacaattcttctcctttcaaacctcccttcaataaagcttcttttaatcctcagaaactgccctccctccaaccgaaggtaccagatgtcccgtcagctcttctctctgtcctgcacatctccgagttccctttgtgactggctcttctgtgaggcctgatttgaatccaacaggaagagcatagaagatcacaatggaccatggccacatggaaggggtggaggcaacgccgaggtgtcccgcttgccttcctagagaactacggcgtaagctcctcaagggcaaggattttagcccgctttgtttgtggctctattcccagggtctagagccatgcttgacacttggtacatgctcaataagtatttcctggttgcattaactcattcagcatcttctcaccattttcctgtggtttttctctgtacccagtgggagaatggagagattgcattccaggacatacaacaacccctcctggaaatcagaaatcctctcttccttcaaaatgtccttggaacactggtcaggcatccgccgtggagtgggcatggagcagaatcacagccacaaggcttctccttgcagcccactgctagaaacaaacatgtcttggaaggcaaagttccacaaggctttaggctaatccatgcccagcctttggagattgaaaggataacttccagaaaggtgagctagagatgcacttccctccttctccggaggacagttctatagagccctcagtcaatcttaaaacacagggcaacagggaggaaaaggttggctagccccagagcaatgctgagtggcatttataaaggatttatcgtgtgccagactctgcactcagcacttacatgcatgaactcattaaaacctcgtgctggctagtactggtattagtcccattttacctataaggaaactgaggctcagagaggttaaatagcatgccaagatcacagggccaagaacaagaggaacagggtgatcccaggtctgtctgactccagagcacaagtgactacccactataatctacagcctcagaagacagggatggagagcagtccttggctcagatggttctggggccccggcagagatcaagcattttcctgtctgctcctgctctgttcttctcccacccccgctccagttcacagtgggcaactgagatcattgtttgggagtggttgtctcctgtggtcctcccgacctcttgctgggtattccctggggatgaggaggaagatgggacagggtcaggggagagctgctgctctctgtccccagctccacaggccagtgggatgctctgctgtccagctgggaccagttccgggcaactgggcataatgcaagagttctcaccccgggcccaggctggagataggctgcttgctccaccactcgccactgcccagtaatcccactcatctggaggaaggagattctttgggatcagagctggcgttgaccttttggtttttccatttggcaggacgggggaggggttcaagaaggcagatcccagagatatctccccccacagccagatacccagcttttggggttctgggattgactcctgaagtcgttacatgtgaaatgcttgcatgtatttttttttaatgcccaaaacatgatgcaatgtttcctgtacaccccggtcacgtactcttgtacatgcacacacggcttccacgttgacttctgtgactagccccttccgtgctccggcttgcttttgctctctctacttccccctccctctctctctctcattctccctgctagctgctgtaaggatcagtccccaaagaaaaatgcccaatttgtcatgtcatgtccagctgttaacctcccgtcggtaagccatggggaagacttactttctcctatttatttatttgccacttggacaatagaaggccccaggcctgctgagttctccataataaagccaccaacgatctcccccatcaccccctcccctccccccagccccatgtcaacaacactagccaacctgcaggtgtcactgggcattaaccccaggcttaactctggctctgctcaaccggagggaagggggagggggtagccggcgaaggtggggggtctgacggggaggtctctgcacaaagaggaaggcctggggatgggctggctcagaaccatccctccggaaagctcactgtgctgaggctgggggagggagggagggatcaaccaaataatgcagctccttcttcccagctctccgatggtctccaggcagagccttggccagccggtggcaggcgcctgggctcaccgcacctagcaacactgccgagagacagggccctccaggaatgaggcccagtgcggctggccctggagcgggcctgggaggggctggggcagggaggggaggcgcagaccctccggcccccagccccactcaaggtaaccactcctttctccagcactgccttcctcccctctccagccttctttggtcagcccaatttgctacaggagaactcgagggttcaggggaagctgctagcaacgtcccaaggctgggctccctgtctccctgtggattaaatgagaggtggtggggcaggggcctgggcagcccttccttctgttcagatgtcagagtgagttacggatcaccctgaagtgcagcccccatggcctttcatctggggctcccagccccttgttgtcaagaacaccatcctctcttcctggaaccctagctcccccctggggacacgctgtggagggaaaacacagattaggattagctgggattgtgcgcctgagcctggttccccagccatctctgtggtagtttcttactttctgctaaattccctatatcctcctccctcccccataggacatcctaaagtacaggggcatgggcagggcattttccaaggctagtcactcaaggctcagtgtgtaaccctctgctgactgtcctcagtgaggccacagccttggactcacggcacccagatacagataaaagacttggtcagctcctgcccactgaggtttcttgtgcatctttgttcactgtctgattgacagtaggaagtcacagctcaatggaaaaggaaaaatgatggtcactgtaaagctcccttgtgagggtccactgggtctgcactggtaccccctctgttcttggcccagtgctggcatcatgtgaagcagctggagaaaccagagagcctagaggaccagtgtacaggaacagaggtccaggatcacacaggccaggcagaaaaggaccccaaaggcttagttaggtcaagcccaggctctgccatagcatggatcctgattgtcacagcgagagatgcaaaggtcttgctccacccgggggcattctgaagttaaaatttttcttaagaggaatctctcaaaatttaattttataaaattacctatatccaggagacatatgggaagaaggaatctgacagttgcaatgtttcagagcaaggtgactgaatgggaaagcacctgaccaaacaggagaggctcagatgacggttcagtgtgcaaaggacttgtggctgtctagaactgctctgcagcgccctgggctgccttgagaagcagcaccttccaacaggaacatggtgatgaccgtccggaacagaaaagggaaagctcctacagtggatagaagatgggaccgtgaagtaagtctctgaggaaccttccagttagtgctcagaagttatgattctagagatagcatgatccagtttaggagacaatgtggtacggtgataaatactgacaatgttgtgagatggacctggatttgattcccagttctgtcagttactagctgtgtgactttgttttttctttttttgttgttgagacggagtctcactctgtcacccagactggggtgcagtggcacgatcttggcttactgcaacctctgcttcccgagttcaagtgattctcccatctcagcctcccgagtagctgggactacaggtgtgtgccaccacacctggctaattttcatatttttagtagagatgaagttttgccatgttggccaggatggtcttgaactcctggtctcaagtgatccacccacctcggtctcctgaagtgcagggattacaggcatgagccaccactcaaggcctactagctgtctgactttggaaaagttacttgacttttctgaggttcagtttcgtcttccatgaaataagcatgaggatacctacctctcagttgttgggaagattaagtgaaagaatctaagggaaaacacctagaataatgcctggcagattgcaaacaccgtaacaaatgttaattactgtctcttttccttgtctgaaacttacttggttcactccctgccccaaaaaacgaggaaatcaacttgctatatctagtggcctgcacaccagggagacctgactcgtgctctcagaaagtttggtctttcttggtcccttcttgtacacctccctcggttctggacagagacactggcgtggctggtttgtgtgggaggcatctacacatttcttgtctggcctgaatagcaggcattaaaatgcattttggttcacccaggacaataaagaaaaaaaaggaagctttaagtcactaataaaaatcaaatgtaggcagtttgcaggagtgatcagctcagagctttgctgttctcttgttaagggtctagagccataaataacttccccatagaaggcagaggcgagggggagtgagtgagagggaacgcaacaacacaaaatttttcatttttctccataaatcatttcagcgtgcgataatatttgttttttctaatgagtctcttgtgatccattccaggagctaacatcagggcctgtcagggggtgatgtgtggtacagttcaacgctttacaaaaactgcctgctacacagatttttttttctctcttccttatgctaagtattcatgaagcccattattctgtgctcatgctttacagattcttcctttctgatcttctcctttgggcagcagccgtcctgttctctcctctgtctgcctgtgctgtggggtcttgctgcagcctggggaagagatgtgggcagtggttgaggaaggctgctcagaggtatcctggggagaccatcaggcatagactttgagcttggctgcataaggggagcattcttcaaagttcagctgaagccagtgtggaagaatgcctttaaatgatggatttctcatggcccagtggtggaccctatcacagtgggcaagaacacctgccaaacaaaaggccctcaaagagagctggcaggctagacagaggtcaggttagtaagagacagtattcataccacgccgaagagtttggagtttatcctaataggcaaaagaggtcaatcaagaattttacaaagaatcagatttgcattttagaaagaccttgctgcatcattagtgtggagcatagattgggggagaggtacaggttagaggaagcaaagagtaggatgggaatcagaaaattctggaacagtgttggattaatacagatgaaaaatgataaggtattggattcagaaatgagagattttggggagagcttagtaaacactactcatcctttaagactgactttagtgttaccttttctgtgaaatcatttccacactctccaggttggctcactagttcctgttggctcctgtaatgtccttccatactctcctctctgcagacactcattacattgcattatgatgattagcctgagctccttgacggtgggctccaggctacgtgaatccttgtgtcttgctctctcatatggtgcatggcacgtagagtggctcaatggtatttattcacattttgaatgaaaacaaaagaataaaaggagggaagacagaactataagtagaaagctcgggcatttgggggcaagtgaaagaagaggagtcacccaaggagactgagatgggatgctcagagagtcaggaaagacctgggagagtgacatcagggctcacggcgaaccataggaatagaactttatttatttatttatttatttagagatggagtctcactctgtcacccaggctagagtgcagtggtgcgatcttggctcactgcaaccttcgcatcccgggttcaagtgattctcctgcctcagcctcctgaatagttgggattacaggtgcccacaaccatgcctggctaatttttgtatttttagtagagacggggtttcgccatgttggtcaggctggtctccaactcctgagctcaggtgatccgcccacctgggcctctcaaagtgctgggattataggcatgatccaccgcgcccagccttttttttttttttttttttccctagatggagtctcactctgtcgcccaggctggagtgtagtggcatgatctcagctcactgcagcctccacctcccgggtttaagtcattctcctgcctcagcctcccgagtagctgggatgacaggtgcctgccaccacgcccagctaatttttgtagttttggtacagatggggtttcaccatgttggccaggctggtcttgaactcctgacctcaggtgatccacctgtgtcggcctcccaaagagctgggattacaggcatgagccactgcgcttggccagaatagagctttttaagagggcaatgatttttggtgccaaatgcaaaagtgaaattaagacagacaaagacagaaacatgtccacagaatttggcaattccgaggttgttactgctgtttgagagagcagtttacttgcagtagcgagggcagaagccataccagccagctcacttctagatgagatgtgagaaagtgtagaccaatctttcaagaaatgcaactaagaagaaaatgacaaaaacaagagtagcttaaggggaaatacaggatcaaggggatcgtttcaagaaggggcagggattaaaaaaacatttatagggtaaatcagacggaaaagacatgacaagagagaaaatactggagaaaggtaagtagatacagagctggctgaataaccacacccaaagaatattgatgagagtttgaaaacaaggtctccagtgacatatgaccagatttgtcctttgtcctgtacagcatttttatcaacaacttgaaggcatgaacagcatgactaacacatttatagtcagataagtctagggacagccaacaagatgaagtacaggatcagtattcaaaaatcacttctgcaagtaggcatacaggtgagatttaacagacgaaagtaactattctgcatgtaggctaaaaatagaatttctggaagtataggtttgagaagctacgccttgagaaggttcatgggaagaagatccaggaattctggttgagtttacatttgccaaaagacttctgaagactccagccacattggcagaggcgcagtgcacagaacaaaggcgggctggtcacaccacaaacacagtgggaacattctgcacttttctgggcttcgtaccattcaggtgataggtgactagggcgaggtgggtcaggatggaaagatgtcttggaaccctgacttgtgatcattggttggggaagttggggaaagaatttgagaaatgcgacaggaattcttaagtatttgccagtttatcatatagtaaagagaatagactccctctgaagagattcaaaggacagaactttactcctagggtaacgaaaggcaaattttggctcaatatgaggcaagaagtctatggatccccctctatgcatgggtttagggtccctaaaatggaatataaaatgttatgtaaacgttaatatacatttttttttgtagaaggtgttcatggctttcaatacattctgaaaggagtctgtgacacacacacacacattaagaaccacagaaaaagggagaattttctttcaattatggtaattggaatggaactatggcttccagaaggagcaggattcccatcactggatatgttcaaacaggggcagaaagacctagtgaactctatcaagtttagaggtctgatacaagaaggggttggttgtagaccacgcaaagaaaggtgtttgtgtgtgtgtgtgtatgcagggggtagaagaggggcagagagaaagaagaaggcaagacagaggtagtgagataaacactgtcatgggccgtttccatcatgtactcacaagagcataataaagcccttgtaatatactagaacttgtgtggtcccggggcctaatttgcatactaattactgagtgcaaatgggaccgaggggtagggagggagggtgggggaggcatgcagggagcgaggggcctggactgtttgctctgccatttcatatcatgctaacaagctaatccggcgtgcagttagctcctgatatataactgctcattagtattataataaagtacatgaaacaaccataaaacgttatatactgcacaagtgttgttttcttgccaattatctgcaggcggatttatcaccacagttgtttcgaattccccttggtgaggtttgggcggaataaagaaaggtgttggtggcggcagcagcagaggggggccttttcgaggggcagaccatgtgttttcttaagtagcacttactgatgcgccatttcatgagagtgaagcaaagagatccgtccttccccagctccgcagccccagaggaaagcgacaagggtgagagctgagaaaggctgcaggcccatgttccagggccctggggacacagggcccacagcctgctggacagcccagaacctccaagtataaaggcctgtatcaatcccacggactgtttaatgaggtcttgtaaatctgcaccacttgctgctctccaggcttccaagcttgctgttcaggtagcccagttcaaagcaatgtttcacccccactgccttattcctaaagcacttactgaatgagctctagtgaaggcagccttgttctgagaagatgttctggagatgcgtcgttcttgcaaagagttcgtttctgcctctgggctctcaagggactctcacaacacagccacccactcagtgttctgggaggagtatggagggaagctctgactttcccagacagcctgtagggcccaagtcacacctcctaaggtcaccctactccatcatcaccagcgaatgcaggaaggccctggaattgggaagtagagaagacccctttctcagttttactctattagattagaaaagagcacccttgcttaatagcgagttgggatgaggtttcagggccctgttacacttcatcctttctcaccgctccccaggctgaaggaaaatttgcagagttctcatatattctaggaaggcctcttgaactgcctggacccacagcacgtagccagctcccagcagcctcactgttgggaatgggccacaggtttgaagaagccaattcttcaaaggtctgctcgctgaccagaagtcccagccaggccccatacaatctcccagacctctactaagtagacatcagcttcagtagtcacccaggagctgcgcagaaggatggcgggtcagtcccactttgcctgtgctgtgctggtgtatcgaaggactgatgtgggtattaggaaatacacattaacttcaaagactaacatgaacagccacatttcctttagagatccatagtggatgtgctaattcacaaactaaattcaaattgtgaacacatctggcctgggctctgggctcctctcaaagaaccctaatagtaaacaaggcaaggaacatcagtgggagttctcacaaatttctcagaagaagctgcctcctggccgggcacggtggctcatgcctgtaatcgcagcactttgggaggccaaggtgggcggatcacaaggtcaggagttcgagaccagcctggccaatatggtgaaaccccgtttctactaaaaatacaaaaatcagctgggcatggtgacatgtgcctataatcccagccacttgggagggtgagacaggagaatcgctgaacccagggaggcagaggttgcggtgagctgaaatcgtgccactgcactccagcctgggtgaccgagtgagactctgtctcaaaaaaaaaaaaaaaaaaaaaaagaagaagctgcctcctgaagcccctcctcacacagaaggaaatgtaatgaagttgttcccccagttcccagcccctacccccgatgaagccagaaagctttactcctcctacggagattagcagtaacttgctccctggtcacaacgagtctggacaactcaatagctccccctttcccgctctaaatagcatctccacttgaagagcttaaaaacatttagtaaatttctgttccaggtatgttctttgttgttttagttctctccaatctttaaatgtctgtccgtatcagataacaaatgactagagacgtaatgatttgactattttctaatgggtgtgctttgatgtatcacagacttgaggttaacgaactggaggatcacctttctcttccatatacaattctaggtttcataattcggctattatgatggcaaccatgatgatgatgatggcagtgatgataaaggaatgaccacctcattctgatacttgataatccccaaatctaaggaaagaacaatgggctgaaaggccattaacatctccaaaccagattaaatgccaatgctttgtcaaagtccagcagtgaagaagtgatatttggtatttagatgcaatcgtaatttgaattgactaaagaatcaagttcagggagaagggagggatagcattaggagatatacctaatgctaaatgacgagttaacgggtgcagcacaccaacatggcacatgtatacatatgtaacaaacctgcacactgtgcgcatgtaccctaaaacttaaagtataataataataaaattaaaaataataataataatagaaatgtaaaaaaaaaatcaagctcaggccaggtgcaatggctcacacctgtaatcccaacactttgggaggctgaggcgggaggattgcttgagcgcaggagttcgagaccagcctggccaacatagcgaaacccaacctccatgcacaaaaagtaaacaaaattagccaagcatggtggcacatacctgtaatcccagctactcagttggctaaggcacaagaatcacttggacccgggaggccaaggtatagtaagttgagattgtgccactgcactctagcctgggcaacagagcaagagtctgtctcaataaaaataatcaagttcagactcttcagctgatcttccatgaagtggcacccacctccttcttcgggctcatctcctaggccctacctctatgtccttgcaatgctgacttgggtcaaattccccctaaaaatggatgctttcttttacctctctgcttttgctcattctgatccctctacttagaatgcttatccacttttttccagtgccaactcctcctaacttgggtcaggtgctatctcctgcagaagccttttctgacagtccatcccttgtctgatctaggtgacccttcatgtgctggaagcaccctgtacttctatctcatgtcaatcaatagcttttgaacctcttcagggcaggtgtcttattctttgtggtccctgcaactcagtatgaagtactggccgaaagcaagtacttaatacatgtttctatctattccatagtttgggagaaccaacctggactaaaactttatttctttttcttttattttttctgagacggggtctcactctgttgcccaggctggagttcagtggtgccatcagggctcactgcagccctcctaggctcaagcaatcctcctgcctcagcctcccaagtagctaggactacaggcatgcaccactatgctcagctcatttttctgatattttttagagatgaggtctcactatgttgcccaggctgatctcaaactcctgggctcaagtgaccctcccactttggtctcccaaagtgctgggattacaggcgtgagccaccatgcccagcctggacttaaagctttaaactcacaccagtatgctgacctagagccttcagcagactttcgtttactctcccctttaggactcaaagctgggcagttctttccaagaccaaagagagggggcaaaccctcatgtctgtgacattggaagtccaccattttattgccatctatttcctccttccttttagtctggtctttaaaggtgcaagcagggactgaccaggtccagggactcagtggctcaatcctacagagcaacgcagctgcaccgacttcccctagggagctggagctcccctcttcctcccctgctgtgacaagaaggtcttcaggggcaggaccattcagcagaaagcctcagtatacccttctgctttgagctgttcccatttgcaggagacacaggtggatagcaaatagatgactggtgtttttcataagattgctgtggggcttaacggagataatgaaggcaatgctcctatcactgcatcagtcatacaacaagcactcaagtcctactgttctgctcctccttcccctttgaaaggcacactgttataattcaaacaaaacagaacaaagcaaggctttgaagtcataaaacaattcggcctcttataagctattcaactttgcaaaagttgcttccctttcttaacttcagctttcccacctgcaaaatgagctcataatgctcacccacagttttaataaggaataaaccacgtgataaaagatgccaaaatacacatatgtctgaagtgtccacctctggtatatagtggggactcaataaatagtagaagtaaggataacaataaatgtaagagtctgaatttctatctaaaaaaacagcataaggacaggatgaaagagacatgactcagcaatgagacaaggtaggggttttagttgataaggtcagtatgagtcagcagctaatgtgacttccagccgcattcataaagtggtgacaggctcaccctgctgtgtcctggtttggccaccttggacagggcaggtctgggcaccattctttgtgagctcaaaataataataaatgtatgtgaaggcccgttgtaaaccataaagagcgtacatatgtaaaacatcattatgaatcatcagcagtagagtattaattgagagagaggtcatctgcactgactttagagggataaagcagtacagtagaagggggagtgagactcagcaccttagaaaaaaggggggcagaaagaggaggcttagagaggggtgacacaggcagaggaagctgattcttgtatgtcccctatgagccaaaccaagaacagttggtgaaagttaaagctagtttaggctcattttaagaaagtattttctaacaatcagagtactgctttgaagaataatgagctccccctcataagaggtattcaagcagtgattggatgataattggtcctaatggagggaattcaaacatggaagaagagaccagatcatcttgaagggctcttctgaccccaaagtgtcatggctttgggggctgtctttctcctgttctctctcatcacaggggaagggaaaagtcagaaatcttcaatttaataactgatctgatattcctcaaacacccactacctgccaggcattgtgctagctgctgagaaaataagcaaaaataaggaaaagactttggcctctgtgctcttacagtctaatggggttaactggcaaagagctttggacacacatcagagagagcaactaaatgcttggaacggagtgagtccaccagggagatgatactggagctgagttttgaataaataatcttcctagatggaaaagggaaataacaggacaacaggtagaaaggacaagacctgcaaagccatggaatcatggaaaagcagacaaagtttaggggaagatgagctgcatgagaaatgggacagaagaaatagtttgggctggattgtgaagcacttagtgaaacttctggaggaccccggatttaccttgaggattacaggaagcaagggaggaatctacaaagagcagcccagtcacacctgtgttttaaaagggtttggatcataattctgaaagacacaatcctgaatgccataattctaaatgttgacatcccaaaagatcaaaatccctaaacgtaaatctctaatgtccaaaatctccaagatcacaatcacaggttagttttctttcattattttattttattttattatttatttaagacggagtctcaccctgtcacccaggctggagtgcaatggcgcaatctcggctcactgcaacctctgcctcctgggttcaaatgattctcctgcctcagcttcccaaatagctgggattacaggagtgcaccaccatgcctggctaattttgtatttttagtagagacagggttttaccacgttggtcaggctggtcttgaactcctgacctcatgatctgcccacctagactcccaaagtgctgggattacaggagtgagccactgtgcgtgaccagttctttcactattttaaattgtcagcattatttgctataatttgctgtgctacgtatttcatctttgcatcatttccaatactggaggtataaattgtgtagagacttttaagagagttgtaattctttttatgcttttttttttttttttgcagatttgactccatgaaagtgcattatcacaatgttgattttgtgtatcagcattgcgcatctacgtaaaaatgttgaaacttcctcagtaaatgacgagatgtcctttttgtacatctgcatttgtgaaagacaaaatttcttgagatctctgctctttgggtgactgcatatgtggtggtgacccacagtggtaacccattgtagtttttgctccatcttgtcaaaagacttaggttgttcatcatggtatttcagataaccacaattataaagctgatggcacacaattaccaactatagtgaaatgtgtttatacatttccctctttgacctatttctttatgaatatggttcgtctgatcataaatgctatactcatgcaacttttgttagtatacctaaacgtttatactcacaaaaaaagtatgttgttgcttattttttattatttaattttaatttttttttttttgagataagagtctcactctgtcacccaggctggagtgcagtggcacgatcttggcttactgcaacctccacctccctggttcaagcgattctcctgcctcagcctcccaaatagctgggagtagaggcgcccaccaccatgccctgctaattttttttgtatttttagtagagatggggttttgccatattgccaaggctgatctcgaactcctgagctcaggcaatccgcccaccttggcctcccaaaatgctgggattatagcactattaccagcctattgttgcttattttattgtgtaaagtggcctatgaagtgttctgtcgtgcttttatgtttttcaaataaatctcctttttaaaatataaataaatatctggccaggcatggtggctcacgcctgtaatcccagcactttgggaggcccaggcaggtggattacttgaggccaggagttcgagaccagcctggacaacatagtgagactccatctctactagaaaatacaaaaagtaactgggtgtggtggcacttgcctgtagttccagctactcgagtggctgaggcaggagaatcactggaacctgggaggtggaggctgcagtgagccaggatcgtgccactgcagcactccatcctgggtgacatagcgagactctgtctaaaaatatgtgtgtgtgtgtgtttgtgtgtgtgtgtgtgtgtaattccttttttttttcccatgcatagttttacttaacattattttaggatctctgctgaaatattcttcaaatatatgtttttaaatggctgaacaatattttatcatatgattatactataacttatttaaccattttattgttgtggaacattaggttgttctcagattttctctgctataaataatactgaaatgatgatccttatgcataaatctttgaccacatatctaattattttcttagaataaattccaagaagggaattactaaaataaaggatatgaatattttaaggattttgctacacattacaaaattgcttctagaaaggttatacaaatgtatgcttttaccaatagtatataagaatgtctgcctaactctacccttattagcattgaactttataattttaaaagttgccaattctggccaaacgtggtggctcatgcctgtaatcccagcactttgggaggctgaggtgggtggatcgcctgaggtcaggagttaaagaccagcctgacaagcatggtgaaaccccatctctactaaaaatacaaaattagccaggtgtggtggcacatgcctgtaatcccagctacttgggaggctgaggcaggagaatcacttaaacctgggaggtggaggttgcagtaagccaaaattgtgccattgcactccagcttgggcaatagagtgagattctgtctcaaaaaaaaaaaaaaaaaagttgccaatttgcagggccgggcgcagtggcttacgcctgtaatcccagcact

SEQ ID NO: 1372 - DNA, 515 bp, Homo sapiens
gggacatggtgggaggtaattgaataatggggtggtttcccccatgctgttcttgtgatagtgagtgagttctcacaagatctaatggttttataagcatctggcatttcctctgctggtactcattctgtctcctgctgccctgtgaagaggtgccttccaccatgattatgcggagtctcactgtgttgcaaattcctgacctcaagtgatcttcctgcctgggcctcaaagtgcggggattatacgcaggggccactgctttcagcctttaaattctgttaaaaacagcgttggtgagggtcagcgctgccactgcacaacctcagggttggaaccaccaccatggaaacttttgctgctgacacacatgtacccacccacagaaccagaagccaccacacccacccccaaatggacaattcagtacttccctagtttcttatagacaacatataggtttctcatgctatttgatttcctctgacaatctgtttttattggtgcatttagac

SEQ ID NO: 1373 - DNA, 1934 bp, Homo sapiens
acgcgggcggcctactgtcgggtgtggccgcgaggggcggcctatataagctcttgctcgcggcttcagcgccctttctccccgccgcattcccggtgtcgacttactagctgcaagcctctgcctgccttcctgcgcgccgttccccgctagtcgctgctgctggcgcgcactcgccgggtttttcctcccacggcctcgagatggtggtgaatgtggcacggaggagccgggccttccaacccggtgggcccgagctccgaaaggccccctcggcagtgagaggggcgggagcccgcgggggccgcgcccttctctcgcttcggactgcgcaacgctgcgctctgggctgacaggcggataaaacggtcccatcaagactgagaaaaagcacaccagctattggcacagcgtgggcagtggggcctacaggatgactgacttagtctacagagatcccggcgtacttaagcaggtagtaatgatggacaggtgaggctttaggcggccgccctgggatctgaattgccccttggcccttatcgaagctgcagctgcttccgcatagctgctgtggtcaaaaaggagcccagagtgacagttttccttgacggtcgccgttctgtttgttgtaactgatctgcaacattttgggaaaatacagttccattgtacctgccacctttcagctgtagccagagacctttatcaaaatgggcttgtttccacagaacagcagaacggttgggggtttgcatgtacagttaaccagcataagactcgtactgggaaaatccagctgggatgtgacacagcttaactgatagcttaaggcatcagtattgggaccaaaggctggtcagatttgtatcattctgaggaccaaatgatgggaacaataaaattgttcatgacagttgttctcattttgctgtccagatgaagactcttaagatgacagaaggtgatttttctggtgatcgaggacttccggggtaatgacagtgatgaaatgcaggggacctggtaggtttcttttggagactaactgggggctgcctggtgggacagaacagcatgtttccaagggctgtggctggtcatagccatgggatctccaactgcatgcaagagcaacctggaaagactttgacagcgcaggttggctagatgggtctcgaacttctgacctcgggtgatccgcccgactcggcctccccttccaaagtgctgggattacaggcatgagccaccgctcctggccagtttagttttcacgctaagctttttgttctgcaggttgcccccaagtttcctggcagtgtgtgatactgaggaggtgagcttgtttctggagctgtgctttaaggtaaagttgatcagcttaatcctcctgatccctttcccatcggatctgaacactggtcttggtggtcgtaaaaggaggaaaagtaatagtgaagctggcctaaatgttgtaatctggtatatggcatgtgggctagtttcagacaggtttcagagatggttggatctctgaaattgtaaaatgaagtataatcttaggctaagggaaggatgcgtgtgaagctctggaggttggtatagtaatagctgacctattactgcatttgggagggatctgtcatagcttccttgcctcttaattaagggtggtgtttttttcttttagattcatgttacatgtaaagctgtcctcatttgtgactatggacctatggagttgggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagtatatttgtgtttgtatttttttgtagagaccgaactggtctctt

SEQ ID NO: 1374 - DNA, 3487 bp, Homo sapiens
ctatggagttggatgaatggaaaagaattggcagagaatttaaaaaggcatataaagacggagccaaaattccagtttctgtttggtcagtgcaggcattgataaaggcagctcttggggcacttcaaacagatgacaaggcagattcagaagaggaagaggcagactagtgtaaaaaactaacttcagattctgaatgtgaggaacagcaactggaggaaattaaagaaaacaaagggaaactgaaaaagctcaccagactgtacaagaagtgtgtgtcagcatctgcttctgatgaggatttcaggaagcttaaaatcatggtggaagacggagtctcacttttttgtcctggctagaccacagtgctgcaatctcatctcactgcaacctctgcctcctgggttcaagcgattcttctgccttagcctcccgggtagctgggaccacaggcaggctccaccatgcctggctaaaatttttgtatttttagtagagacagggtttcaccatataggccaagctggtctcaaactcctgacctcatgatctgcacgcttaggcctcccaaagtgctgggattatagatgtgagacaccgtgcctggctatagttgcaattttttaaaatgctacatacattatgactagttcattaaaattattcatacttagatacttatacctaatatccaaagaaaatttactaccaaattgttacagtagatattagtgtgacatgtttattactttattcaatagggataattatgaattaacacaactttagtatcttttattgcactaaattggaatgctgctattacaggaaaaataaagacaggtgatgtggccacccaaaaccaataatagctattcagttaactatgttacaagttcttttatttttatttttttttttgagatggagtttcactctgtcacccaggctggagtgcagtggcatgatctcggctcactgcaacctccaccctccaggttcaaatgattctccttcctcagcctcctgagtagctgggactacaggcgcctgccaccgtgcctggctacttttttgtatttttagtagagatggggtttcaccatcttggccaggctggtcttgaactcctgacctcgtgatccacccacctctgcctcccaaagtgctgggattacaggcgtgagccaccacgcccagcctacaagttctaatatattccactctatgaaaacagtcagattctatttcttcatcaaaaagtgttgttggaagttgtcagatgtatttcaatatagaactccattcactggctaggagatgagagagcaccaaagatggaaaaaaaactttataaaattcttctgaaaatctgccttctttcttcctgaagctcatgtttctcatgctgagagtagctgtgcactttgggtgtttagagagaaattgcttttaggggaatattttttgactgacttgatcaatcatatctaatctgagctttttcttaagatctttataatatttttctatgaaaataatcttgctcagatcaagatctcatttttctctccaatgctttgggtgtgtgtttcagaagccctattagtgtcccatggtgtcagattaaggtgggctgtcacaatgagaatttttgcagctatcactatctggactcatgctgaaaattcagctttatcttttccttgtcatctctatacgtagaaattgacgctgaaacactgctcacattctcatgattgtgaaggtgtaattctacccaggaggcctgcaggctctcctcctgcagctcaggcctcactctctgatgtgacactagagtgctgctgtggcaaataggattcacataaaatgtgagctgtggtttgtgcctcagtggcagatggtagaggccaagagaggacactagcaaccaggagaaagcaagcaggagtgctgtagcccagtgccagggagtacagagccactgctctaaaatgtaagtagccaaaaagatagaacactattcaaccatttttgtagcagagtgaaagcctaccttcagcaggcacctggcttcaagctgctaaactacatcctattatgaagatgtgaaaagtttttgtcattgaatataagtaattagcatacacagatggcctcttcagtatccaggtgaatttaggatgaactatgtatgacatggtgctggaaattcttctacttgtggcctaattatagtgaccatctttccgtctcttaagcagattgatgaagatccgtgtcacattcaagttcaattgtgtaataaaacagtttctttctattctattattgtggagtttctctggggtggagaaaaattttcatttaattattgtttccaaacactgtctagaattaccagacatgatataaacacataaggtgacatccagaatttactctagaggagactttccctctcaggcttccagtcagctcagagttgtgcagcaaagtgcatgctgtcccctaaatatgcaggcagaattgtgtctctgcctagttggcattcatagtcctctgcagtcacttctagagaggctagatcacatttctacaaacttcacagggcagcaatcaatcattttacctctttcactgactcttgtatcttcagactggaactgatacagaaactatttggcccagaaacccaatcagagtaacgtgtgtgcattgagtagacatatagacatgagaatctccactttccccttcctcctcttgccaaagtgctcacaaatgtacaggtaacacctgctgctactccagccattcaggccctaaatgtgcagctccaaattttgaatttagatcttgagatttgggaaataaaaaacttttatctaaaaaatgcaagtccttttggttatcaaattcagagagatgaaaataaaagtgcagttatttctcccctctttgaactatgtattcatgtcttgaaactgttcactattgccacaagtagctataaattaaactaataatgccacattggacactatatcccataccctaaaccataacgatatatatctaatcaataatcaatgctatttctgtaaataaataaacatttctgacaaacaactttgtattatcttttaatggtaggttgtattgacatttttgaaaaataaaattttttgacccctgagcaaaaatatattgaagtgttttatatatacatatttttgaactttccagtttgacttttgcttttaattcctagtttaattcagtttttgttagaaaatacacagtgtatggccgggcgtggtggctcatgcctgtaatcccagtactttcagaggccgaggcaggcagatcacctgaggtcaggagtttgagatcagcctcaacatggagaaaccccatctctactaaaaatacaaaattagcctggtgtggtggtgcatgcctgtaatcccagctacttggg

SEQ ID NO: 1375 - DNA, 1241 bp, Homo sapiens
agaaccttacagtattcaagaaagtcactaccaacattgccaaatagatttaagctaagcacaaagggaaaaatatagaaaagcacaaatcacacagtcctggtaactgtcttctgaaaagctaatataattatcctaataggtatatttgataggcccttactgtgcagaagtctgtcctaggagttaagaaataataggattcaataaaaacatactcctctttcttccgcaaggaaatttcagtctgaccaatcaggagtttgtgccacacagccagcacagtgttcacctagaaaaactagtccaaccaaacagtgattcagggtactcctgtgactaatttatattctcactcagctggggaaaactcaccctgaggacttgaaattgtgtccagaactggtgggttcttggtctcactcacttcaagaatgaagccgcggaccctcgcagtgagtgttacagttcttaaaggcggcgtgtccggagtttgttgcttctgatgttcagatgtgttcggagttttttccttctggtgggttcgtggtctcgctggctcaggagtgaagctgcagaccttcgcggtgagtgttacagctcttaaggcggcgcgtcgggagttgttcgttcctcccagtaggctcgtggtctcgctggcttcaggagtgaagctgcggaccttcgcggtgagtgttacagctcataaaagcagtgtggacccaaagagtgagcagtggcaagatttattgcaaacagagaaagaacaaaggttccacagcttgaaaagggaccccatcaggttgccactgctggctcgggcagcctgcttttattctcttacctggccccacccacatcctgctgattcgtagagccgagtggtctgttttgacagggcgctgattggtgcgtttacaatccctgagctagacacaaagattctccaagtccccaccagactcaggagtccagctggcttcacccagtggatcctgcacgggggctgcaggtggagctgcctgccactcccgcgccctgtgcctgcacttctcagcccttgggtggtcgatgggactgggcaccgtggagcagggagcggcgctcatcgtggaggctcgggcctcacaggagcccatggaggcggtgggaggcttaggcatggcgggatgcaggtcccgagccctgcaccgcgggaaggcagctaaggcccgacattcatttggcctatatctggacag

SEQ ID NO: 1376 - DNA, 32757 bp, Homo sapiens
gggatctagaactagaaataccatttgacccagccatcccattgctgggtatatacctaaaggactataaatcatgctgctataaagacacacgcacacgtatgtttattgaggcactattcacaatagcaaagacttggaaccaacccaaatgtccaacaatgatagactggattaagaaaatgtggcacatatacaccatggaatactatgcagccataaaaatgatgagttcatgtcctttgtagggacatggatgaaattggaaatcatcattctcagtaaactatcgcaagaacaaaaaaccaaacactgcatattctcactcataggtggtaattgaacaatgagaacacatggacacaggaaggggaatatcacactctggggactgttgtggggtgggggcagggatagcactgggagatatacctaatgttagatgacgagttagtgggtgcagcgcaccagcatgtcacatgtatagatatgtaactaacctgcacattgcgcacatgtaccctaaaacttaaagtataataaaaaaaaagaatgaaaaaatatatagcaggcaaatattaaaaaaaaaagaatttgaaggtggagagaaactgaattccgctggaatttaggctgggcagaaaagaagtgaattgttggatgttgagggatagtgggacaggtctttggaagtagattgtagtagtggagggaaagagatgtaggactatgttctttgccttcacctcgcactcatagccttcgaatccaacttttggcattcactacactctgccttgttttagttgactgtatttcccacccccaccccccaactcttgtaagtggctgcacattcctgaggcacctaccccagtgttctgtatttggcagtgattcaattacagttgttggaggagtgaaggaaaccaaatgtgttgatttttaaaatcatggcaagtgtttttggttaaatttagaactactcttttgaagattgtgcactcaaaagtattaattaaattggcaactgtgcctgccagcaacattaatgtgatactctttggggaggagccatttgaaggtgttgctggaactatagtaagctcagagtatgaatttaactgcacttaaagaagctctatcttttggaacttccaactaagggtgaaaaagccttgcttcataagcaggcacagtttgttctggatcgactgtctggtagtttcaaggctgataacttttaattctttttgctcagatagtagccactcaagagggtgccagggaaccttctgcttctcctaaaagcttggtttcagaaagtgaatttgcttgatatcatatctacagggtgtactcttcttaatccaaagactctctagtaagttttccataattaaggtataaactcacaagatgccaagttcttattttatcggaggagaaaggacaaggaatatactactctctgatcatgacaatgggtgaagctaaagagggaggaagaatcccagttcctcctttcagaaaccttaactgtggttctataaatgtggaggcatacatacgcccatacacacccatgcattctcgctcacttactcatgcattcacacaaccgtttttccaatcttattcttttcagttgaatgttcacatcctaatcctggtatttaacttttagtgttttcaaggctcctttttatatattcacgaatctagtagacctcatcccagtgaacattcttaattatagtcaattgctctaaattggctttcttgaatttaaatgcatttgccatttcatttttcaagatgaatttgattgaatgtcttgtagtgattgatgcaagctcattcagaatatgtgaataataaatttattactctctagaaataagtactagatcacaaaatctctttggtttaatattttactgttaaagattaaatagttcttctaaataacttagcaactctctcaaacttaaattgtttagctctatgtttaaggaaactatggaaattgtttcagttcccttgggtgcagtcgtgcaatttagatttagctggcctgcagattgtactcatctatgttaatgtttctgtaatgagaatgatccaactgtgtcataaccttttaggtcttaacctccttcatttacataaccttttactttacatttacacacgctttgccattttaggattaatatgtcaggctttttctgtttttttcccatgacctttgttgctaataaaaacaatcagttggtttgccttatatatgggaaaaacatgttgttcacaatagattggtcaatatttgaaagaaatgttagatttgataaccagagaagggaatacatggatttttgcatgactaccataattgtaagcagaaaaactcaataaactatttttattcttaaaagtgttgattaaatttgataatatttgaaatgtacatcattaaataaatggtttataagtgtattcagttccttgcttcaaatagaacaagttataatttaaaataataagccgggcacggtggctcaagcctgtaatcccaccactttgggaggccgaggcaggtggatcacgaggtcaagagattgagaccatcctggctaacacggtgaaaccctgtctctactaaaaatacaaaaaaattagccaggcgtggcggcggacgcctgtagtcccagctactcgggaggctgaggcaggagaatgtcgtgaacccgggaggtggagcttgcagtgagccaagattgcgccactgcactccagcctgggagacagagcaagactccatctcaaaaaaataaaaaataaaaaataaaataatactagtacctattaccctaaaaatgtgttaaaaacatatacacattggtcttttacatttaaaattatgtcatttatgtgcatttttatatatccacatatatttacaagtattgattacaacaaaataaaatcttcaaagacttggactttcttaactagacatatagttaagaggtaaatatgtttcaaaaatttaatggtagaatttatttaaatagaaaatataatacatgtgaaatgatttcattttaaagtagcctatttacatacaggatattttttctattattaacgattttattcgacttgtgatactctgaaggagaatcacagggtgcacaatctgggtatcagggagcacccccgaggaaatgtcatttgagctgagtcccaaagggtgagtagaaactgcaaggtaaaaggcttgagtgcctcgggaggcctaatatttttagaataatctttgtaatataaacctgacccataaatccctcatactctcccaaaaccttacaatattttcccaaatctgtaccatgtcctgcaaaagctgcatcatctggcttctccctatcccagcaactttatttcccaccaccctccctcactctcacccccagccatggccgacttgttaagtttcaccacctcaccattgtctcacttcttaccttttaacatgttgctcatgttccttggatgactctccctacctcctttctccatcccgctcctcatcattggtgaactccacttatctgcagatattcagcttcttcagggaggtggtatctgcatccccagaggctgggtcttcatttacaagtgaagcatctggcacttcttccccagtcattccattctcatcatgtttgtgatttctggtgtcatggccatattcctggaaggtggaccttgtgtccccagcatctagattgctgttacattgtagggatcaagcaaatagctattgaataaatgaatgtatataaaactttaaatcagtaaattttaaagataatgctttttcttagtcactataagaattgcagctaccacttactgagcacaagtgttaatcaagcacagtccaagatgccaaatgtggtggatatgaacctcatattattaatgacaaaactgaggtttggaagtccagcaaattgctccaagtcagattgtggtttgctctattatgtttgataaaagcagtcactaaattgtctcattataatcaggggagagaaaacactattttttgatgaaaaagtgttgatgtagttcatctcaaattgtaatacttttatgtaaattttattttaaaaataattttttatatatcattacacttattctcatttaaattattcaattcataagtactgtcagtcatgtaccatatattaaggagcaaagtaagtgatacatatatacggttttacccgctagtgaggttacaatttgtgtagggagagaggcttgggaaaagcatctatggtttagctgaggtaaccacaaaatcctaagggttatagagttgtgcatacttaacaactatttaactgcttaaggccatgcgtggtggctcgtgcctgtaatcccagcactttgggaggccaaggcaggcggatcacgaggtcaggagattgagaccaccctggctaacacggtgaaaccccgtctctactaaaaatacaaacaatttagcccggcgtggtggcgtgcgcctgtagtcccagctactcgggaggctgaggcaggagaatggcgtgaacccgggagggagagcttacagtgagccgagatcatgccactgcactccagcctggtgacagaacgagactgcatctcaaaaaacaaacaaacacctgcttaatatggcccacacatttttcaaggcactaggcacacactagtgaataaaataaacaggatcctttgtctcatgaaaaatatattctataataaagacattaaatcctattggggaggtctcattaggcaggacttactagagagggtgatgctttcattggctcataaaggatgagtaaatactgtcatgtcctgatggggagtgtcttagtatatctgatcttaaccaaaaggctgagaaactataacagcatattaattaggattaggttcatcatggagtagtagaaaaccccaagttatattggtctgacaagctaggaaactgtctcttgctcccataaaagaaatctaggtatagttagtctagcatgggtactgtactcagaggtaggagccaagggtgttccctccatgttgtttctccaccatattccatacatggcttccagctcaggctctaagacggccacattatttccattcatcatatctgcattccagccagcagaaaggaaagggatagtagggaagaagagcatgccctctttatttccaaacatttaccaaaagttgtgtacactgattctgtttatttctggaagcaacctcaagagaggtggagaagtggggaaatgatgtgttttgctaaaaacaggattttattactgaagatgtggaaaatgaatattgggtatatatgacagtgtctgctccattaacaaaagcaaggcctggaggaatgacagcaaaggactcaaaaaaataactccacaagtttcattgtgtgatgtggttgaagttttatgtatatagaacattatagaaggaaataactaaacgtgggttcgtaaaagcatttaattgccatgctcagaaacattgtcatgcagggatatataataatttaaatatctttcttatgttgtacttacatatttcataatttacaaggctcttaaaatatattatctcttttaatattcaaaataatcctgtggaatagtaaatattatccttgtttggtacattaaataatcaaggtccagatatctgactcaaggccagtgtcctttccattgtatctgaaatagttaatatattcatagaaatttaaagaggatattagtatttttttattaatcttaatccaagaacaggaaagtaatgcaaagaaaactattacacaataaaagagagcttctacagattaaaatgtaaccattgagataaaagataataatctcccagaaagtagacccaaatgagaaagtaatggaaatgttagcaaggaaatgaggcatagggttcaaatatggaatgttcaacttttggttagtaagagtcttagaaagagaacaaaaaatagtgcgtgcttggggttaggatggggtggtggcgatggaagaggaagtattattaaagatacggatataaggaaattatttaaaactgaaaaggacatgagtcttcagattaaaaggatctggatccactaggtgtctgagactgcaaaaagatccccacaaaggcatattcttgtaacattttacagatcaccaaggagaaaagacactaaaaacttctataaaaatatttttcaaatttatgagacaaaatgttttatgctcagaccatcaaccatatatgatgattgtttgaagacatttttaatcatgcaaaattcaaaatatttattcttcatcaatttttctttgtgactaacaggatatattaaagtaaaacagaagagtgcacaaaggttatatggaattttggaaacagtgtgtctaactggtaaagaagtcaaagaaatcccataattatagtttgcatagtcctcgattgaaggaaataaataagtttatctatggggttgggggaaaggtgtgggggaaggaactctatggacaatatgattaagaatgaggaagaatatgagtatgataaagttacaaattcaaggaaccaagaaatataattagaaatgtcagtaaaaaatatgaagcaaaataagaagtgacacaattggaagtaattgttgaatgttaaaaaatcaacttggaattgatgttagaaccaatatttgtatcaattatataaatacacacacaattgtagaagttatttagtttccatgagacatctggcatctgatgttggagaagtctgcagatagacaatggcgaagggaagacgtgtaaaatagcggtataagcatgctggaactcaccagtgtgagctgaaatctgctaggacagactgtcagtgtgccagtctcaccacctcccactttgatgatgtgtgtgtgctgcagaataagctgtcaccttttgtcatggagctaagcacacacctggcgtagaagaaactgaaagaagaagaaacagaaagacctaggggaagatggagcagctgcaggctgggcttctgctcctacccaacaatgtgagctgctaaataagaaaatatgtgagagctaaaacctcctgttgcctcttccttgatcttctgagcatacaaacaatataaccactttttcatttctgccttcaaaatctgacacagaatgtctcttgtggcccaatctaatatgaatcatatagggagaggaattccagaacacataggtcagcctagctggtagcataacgcactaacacattacaaagccatcacaatctcttttgagtgaccctaggggttgtatttggtccacagaaaaaagtaatgcaatcttaatatagtacttggtccaactttaaagaatatttacacaataaggataatgtaaatgctgtttctgggtcattatatttagagtcaatctgtgaaaaagcacagaaacccgggtggtgattgcatgaaggtaaatgttaacaaccttggaaatataaaaggaaaaagtaggtggtagatggtgggatgtggaaaggactctggtgtggaagaaaagttgaaggaagagtaaggagccaaatagcttaagtttttcttctttttaatttttttcttgccaaaaaaattctaccatatcttaatttttaaagtgtagagttaagggatcctacctaaaattcacagaacaagaaatagaggttaaagatatcatttaaagtgacaaacataagcaataggagaatttaaggtaacgacctaattataaacattaagagaagaaagtaaaggtggaaaaaagaataaacatgataaatctgttaaatcaataatctaaggtatatagaagtatattattcagagttattaaaacagaatggttaagaggttgtttgggggaatagatgtgagttagagaacaaagtagagggatactgttgcttttcatcgtaagatttttgtaatatttgattaatgcattattagagttctcctgagagacataaagagaggatatagatagattttatgtatatagacgtaagagggaacttgttacgagaactggctcacatgattatggaggctgagaagtcccatgagataccattcacaagtttgagagctagaaaacctggtgcactgggccctgctccgatgtccaagggcagaaaaagatggatgtgacaactcaagaagagagagataatttgcccttcctttggctttttgttccatttgaactctcaactgattgcatgattccagcccacactggtgagtccactgattaaaaggctaatcttttttttctgaaaagcatatagatgcacccagaaatattgttttacaaactatctgggcatcccataactcaatcaagttgacacatcaagttatccatcacaactatttagaataagcatacattactttgtatgcaataatttttttagaggagagaaaatagaagaggtcagaggatagagggtcttccttggtcaaattcttcattaaagggacaaatgtgagaaccaagaaaagaaggtgaagtgcatttagacctttaagatgaatattatataatagctattaattttttaacaaatttaaataatagaaacattatctgcactgtaacttcagaaatgatgctggtcactgctctacaatggtggtagaaatagctgtcaaaccactcctttcttcactaggaaagaataaatgaatttgataaaaacctgtggtaaaatccattgattatgattttataaatatgaaaccctaatacattttattacattactgtgtgaatataataaactatattaatatttaaaatattatcattgtaataaaataatgaaatataataaataatataataaaagtatataatattatgtgaaactagaaaaatttagccataaaaccagaaactagaatgagaaaaaattaatgtctaaatattcgcatgcttgggattttgcaaaataaaccaaattttaaaaagaaaaatttttgtcattataatgtaataatgttttatcatattcacaatagatattaaatattcttctgaatagactattaatacttaaaacaaattatatggatattatttggtttaatatttagaattatagttttaccttcccatttgtaattccttataattatgttcaagagcattggtcatcattttgcagattctaactgttctaattattttgtccaattattagttactatatattttctggactaattatattactaaaatacagaagaactgggtaaattttattcacattgatactagtatattttaaaccttgcctatttcctatctttacatattttcctttgattaaacatctctgaattattctcaagtgcaccactattaatttcaacaagttagtttaaatcatttattctgctgaaatgctatattacataactaattttgcaaatctggtagtgatttaaactaatttgtcttccagaaactatggtagaataattatgctttgatcttgtaaattagccaaatggagtattgtttataatataatttaaatgaaaactgccattacattaaatagtgtttcttgtctcattgcttaattgacctcagtttgtgtgttgttcataggtaaacagtgcaactggatccactggagttaacagagaaacacctttttcctcacaatgttttcattgcctaggaaataataaaatcaaatcaacctatttttaacacaaatttcaaggtttaatttaagactttataaggtagagttttaagatgtatctttatggtgatgatgatgatgatttcagtgaaaagtaaacatgttaacactgcctcttattttgggatctgtctgagcagcctcatggctctcggattttatcagtatcagtgaccatcagactcatatatgttaactagccatgaaccttggttccaatcctgggcccttttattccctggaactcttccatccttaaaactatcaactctaatattccatcctctgaccaacttcatattcatttaaatcttttcacttctttatttctgcttaaacaaggccttcacttcatcaagaccttggcgttcttaacctttttattttccttaaaccaatttattcaataaaattacaatttattgtacacttagattgcccaagtgctttacatgagttgtctgatttaagccatttgatgtgaagtaggaattattatcccatttcacatctatggaaattgaagcatagagaggttaaataaattgttcaagggaagtggaggacataatttaaattcaggtctagtttcttcatagcgtatgctatatagctcttatgcttttattactttccatattcaatcttgcccatatctcatttcaaccactttctctttctctgtcttttctttttgccactgctctaaattcctttattatacagttttgacagccactgacatttaaaaagcatccaattccattacctaagccatccaccttctctgttcctcaacctgagttgccaagcactgctggaagaatggcatgttcatgagtattgatgccatatccattcattgtgtctagttcctgctgatctccaacactgcctagctatgtgtcctttatcagctcccttctcaattctaaactgaattttctcaaacttcctgctgcaccattacctactaaatcagctaacccaaaggattggattgtcaattcaactcacataaatgagagaccttcttgtattaatttcaagaataaaagcgatcaagaagtacagatgaagtatggagaggtctgagacatctgcatggctctcaaagttcattattcctgcgttagacatgcacagtgcgtggttcagagtaatggataaggtctacaaagaagtactcatgggttattactttacatagcagggaacatttaggttacaccatatctccattttatacctcaaattagtcacctaacttgcatgacattttccagagtgccatgccccataaattcatagaacctagatttgtttgtcataagcaaacctaaatgaggaacatcctcctaagagaattccataaataagagcgttccttctagtaaatatcatcagtctatttacaagttcagctatcaacatgtctaaaagaatcatcagaactcttttcttctccaaaaggttcctctgacctatctacaaacacacacaaaccatctgctttaaactccttcctccaactcatttttagccaagatccctactttcattttataaaaaaaattaaagcatctcagataagaaagtccaacttcctttttccagtaatacacattgttagacattcactctaccctctttcctttagcctgagtggaaaactatattttgttcaaagttgatctctgtttcaatgatctgtttctccttgctttttctctcttcagagactctggatattttattaaccaactgcaactttacctaattgcattcttaatcagtgaaaacttcttagtaatagtttatctattacttcttcaatgctggctgtgtgacaggcatttttctaatattaactcatttactatcataacaacggaatgaagtaaatgctgttagtattgccgacttatatatggggtctatgagtatcagagaggttaagtaactttcttttcccttctcttctcttctcttcttttctttcttttttgagaaggagttttgctcttgttgcccaggctggagtacaacggcgcgatctcagctcacagcaacctctgcctcctgggttcaagcgattctcccacctcagcctcccgcatagctgggattacaggcatgtgccacaatgcctggctaatttttttgtagagacggtgtttctccatgttggtcaggctggtctcgaactcccaacttcaggtgatctgcccgcctcagcctcccaaagttctgggattaacaagtgtgagccaccgcgcccggcctgaggttaagtaactttttcaaaatcatacagctagtaagtgatgactctaggatttgaacaaagctgtctatgctgtgctggaagtacatttcctaatgcctattttaaaattattattatgaatacattttagatttatagaaaaggtgcaaaaacagatcaaagaaggtgtttgtaattctaatccatgcttcctctaacgttaacatcttaccttatcacagtacaattataaagaacaggaaagtaactttggcactatattaactaaattacagacttttttttttttttttaaatggagacggagtttcactctgtcacccaggctggagtgcagtagtgcgatctccgctcactgcaacctccgcctcctggttcaagcaattctcccacctcagcctcctgagtagctgggactacaggtgcatgccaccatacccagctaattttttatgtttcagtagagacggggtttcaccatgtggcccaggctggtctcgaactcctgagctcaggaaatctgtccacatcggcctcccaaagtgctaggagtacaggcatgagccactgtgcctggccaaattaccgacttttaattttatttttattatttattttaaaatttttattattttaattaatgaatttttaaatgcactagtttttaatatcctttttctgatctaggacccatcctgaagttggacgtgttttttcttcagttgcctccagccttgaatatttgctcgatcttacgttatattttatgtccttaatgaatattaacttttcgtcactctaatgagaaaaaaagttttcccagttaaagagtgagaaaattatttggtatcaatgaaatgtttttccttatcaacatacatttcctaattattagacccatgattattatatagttctgagttgacatgctttctgcataaaacttttggtttcaatgactcattatatagctatatgatttgcatgcaatcacatgtattctatcatgactataattttccttctaatttatattttctgttatttaatctgcactttccttttcagtttttagtgataccaaattccagtttagcagtgtattttttatgagcacttaatcttctagtttccactgtttttattgtgaagttggtccttggtgtgagtgttactcttttgaaagccctctcttttttctctgttaggctctaagatcttgtctttggactgtgacagaattcttctactggtcctacttatggttttcttgtttgttagcctccttgaaagcatggcatgtcattgtcattttgaaaaccttaaatacttgctctgaaactctcctccttccttctaccatcccaataacacacgtgtcagatttaattcttctatactttgtgcttgtttttgcttttctctattttctattattttcttctcatactttagagtattgtcttatattcccattcactaactttttctttagctatgtctaatctcttcttaaatcacatctattcagttatttgcttcagttattttactatttatttattactttggtacaaagcataacaaaattttcaatcttcaccattttaaaatgcaattcagtaatgttcagtatattcacattcttgggaaagagatctgcagaactttttatcttacaaaactggaggtctatgcatattaaagaactctttttccctctccctgcatcctttggtaaccaccactctacttcctatttctgtgaatttgactactttagatactccatataagtggtatcatacagtatttgtctttttgtgactggcttaattaccttagcataatgttctcaagattgtagaatttaagggattttcttccttttcaagactgaataatattccgtcatatttgtatatcacattttgcttatctgttcatgttgatgaacatttgggttacttctacctcttgactattgttaacagtgctgctatgaacatgggtgcacaaatgcctatttcagaccctcctttctctagtgtctatttgaattaacatttctaatgtctatctatgacattaaaaagaaagcacaacacatgttttctccttatcaggatacttttagtacctaaagttcttatcaaacaaattaaataatcttaatttttaaaaaaattgtttcatgtgtccagtaaagaaaattcattgacagtaaaaatcatgacatatttttctacttcatgtgacaacaagcacaatttcaaacacatagtgaataacacaagggcaactaattttgtgggctgttaagggttgaattgcatctcccttcaaaaatcatatgttaaattcctaacttctagtagttcataatgtgacctcatttagaaatagggtcattatagatatagttagataagatgaggtcatattgaagcaggatggacctctaatccattttgactggcaatcctagaagaagggaacatttggagacagacataaggagaatttcatgtgaagcgctgaaggtagagattggagtgatgcttctacatgtcaaggaatgctgaggattgctacctaactatcggaagctaggggaaaggcatggaacagattcactctcacagcttttaaggaaccaaccgtactgacaacttggtcttggatttataatgtccagaactgtgagacaatatatttctgttgttaaagtcacccagtttgtggtacttagttatggtagacctagcaagctaatacagggctatagtccctttagaggcaacatgattgacccataaaattgtatataaaattgtgtttgtgagtgtatctgtcggtacacattcttttctcctttgcacaatttcacaatttccctctctaagaacctgtatttcatgactagtaggaggagtataataaagagagatggaagaagtgaaccttcaatgtgacatttactcctgttttaactttgatttctcatggtatttttagttcatgagtgtttagcattttatggcagaaagagcttgcacctgtgattttccagatctatctgatctttagtcagcatctggagtccaaggtaatctcttggatcttccctcatagtaagaattaaaaatgagattgaagactgggcccagtggttcacacctgtaatctcagcactttgggaggccaaggggggaggattgcttgaggccaggagtttgagatcagcctgggcaacatagtaaaaccctgtgtctacaaaaatttttttaaaaaaattagtcaggcatagtggcacacaccagtagtaccagctacttaggaggctgagttagaaggatcacttgagctcaggaattcaagactgcagtgagctatgattgtaccactgcacttttgcctggattacagagtgagagcctgtccaaagaaagaacctgtcatgaatatgtcaatgctgaatgcaaatcagggaaagatgaaggtaaagtcactctgagacaaagggagagcaggttaccacgtggaagctgctctgcttactagagttgggaattcagtatgttagagagctctgtatcagtttcctaggactgccatattaaatcatcactctcacagctctggagctccaaagtccaaaataaaactacattccctctgaaagttctatgaaaataccattttttgcctcttctagcctttggtggctccatgtgttccttggtttgtggcatcataactccaatttatgcctctgtcttcatatggccttctctgtgtcttctactcttttcctcatgtgtctctggtaaggttacttactattggattgagggcataccttaaatctggctgatttcaactcgatactctcaattacatccacaaagactatttttttccaatgaatgtcacattcacagattctaggggtcaggatgtagacatattgttttggaggccaccattcaacccaatataggcccgagcattgctaaatcctgagtataaaagagagataaagttagccccaacagattttattttcatacctctatttcttaaacgagaggccaaggataactccttaattctgaatgaatcacccaccaaaatttgagctgaaaatgtttagctgtagaagtggaaacttagaggtgcagactgaatctcatttctttccgtttttgttttgttttgttttgttttgtttttttgagatggaaccttagctgtgtctcccaggctagagtgcagtgatgcaatctcggctcactgcaacctccgcctcccaggttcaagtgattctcctacctcaacctcctgagtagctgggattaccggtgcacaccaccatgcctggctaatttttgtatttttagtagagatggggttctgtcatggtggcaaggctggtcttgaactcctgacctcaagtgatccacctgccttggcctctcaaagtgctgggattacaggcgtgagccaccacaccggcccctatttctttttaaagataataaattcaatacaggaatacatcaaagatattgtgggtttggttctagactaccacaataaagtgaatatcacaataaggtaggtcacataaattgtttgccttcccagtgcactccattatactgtagagtattaagtgtgcaataacattatgtctaaaaaaagtacataccttaatcttaaaacatcttattgctaaaaaatgctaacaatcatctaagctttcagtgagttgtaatcattttgctggagaaggatcttgccgaaatgttgatggctgctgactgatcaaggtggtggttgctgaaggttggggtggctgtgacagtttcttaaataagaaatcaatgaagtttgctgcatcaatggactcttccttttataaaagatttatctgtagtatacaatgttgtttggtagcattttacccacagtagaactttcagtattggagtcaatcctctcaaaccctgctgctactttctcaactacatttatggattattttcaacttttcgttgtcgtttcagcaatgttcagagcaccttcaccaggagtagattccatctcaggaaaccactttgtttgctcatccataagaagcgactcctcattagttcaactcttataaaattgcagcaattcacatcttcaggttccacttctaattcacttactatttctaccaaatctgcagttcctttcttcactgaagtcttgaacccctgaatgtcatcaacttcttccaaacatctgttactattgatattttgacctctgcccatgaatcacaaatattcttaatggcatccaaaatggtgaatcctttccagaaggttttcaatatactttgctcagatctgtcagaacaatcactatgtacaagagctatgagagctatagccttacagaatgtacttcttaaatagtaagacttaaaagtcaaaattactccttgatccatgagctacagaatggatgttgcattaccagtcataaaaacaatgttaatctccttatacatcttcatcagagttcttgtgtgactagctacattgtcaatgagcagtaatattttgaaaggatctttttttctgagcagtagatctcaacagtgggtataaaatatttagtaaagcatgctgtaaatagatgtgctatcatccaggctttgttttcccatatacagagcacaggcagagtagatttagcataattctttattattattattattattatttttgagatggagtcttgctctgtcaccaggctggagtgcagtggagcaatctccgctcactgcaacctccgcctcccaggttcaagcgattctcctgcctccgcctcctaagtaaatgggactgcaggtgcacaccaccatgcccaggatttaacataattcttaagggccctgggaggtttggaacagccaatgaatattggcttcaacttaaagttaccagtcacattagcctccaaaaagagagtcagcctgtcctttgaagccaggcattaacttctctctagctatgcaaatcttagttggcatcttcttccaatataaaactattttgtctgcattgaaaatctgttgtttaaggaactcaaaaaactcaacagtaaaaaaacaaaacaaataacccccttaaaaatttggcaaaggacatgaatagatacttcccaaaagaagacatacaaatgaccaacagatgtatgaaaacacgctcaacatcaataatcaccagggaaatgcaagatcaaaatcacgatcagatatcactttacctccattagaatggctatggttaagaagacaaatataagacaaaatataacatgctactgaggatgcagagaaatgggaactcaccaacccactgttggtgggaatataaactagtacagtcacgatggaaaatagtgtggagatttctcaaaaaccaaaaaatagaaccatcatatgattcagcaatcccactattgcgtatttatccaaaggaaaataaatcagtatatcacagggatacatgcagtcccatgtttattacagcaccatccacaatagcaaagatatggaatcaactttagtgttaataaataaatgaataaagaaaatgtggtatatatacacaatagaatactactcagctataagaaatgaacaaaatcatgtaatttgcagcaacatggatggaactggagttcatcgtgttaacggaaataagccagacactgaaagacaaatattgcctgttctcactcacatgtgagagctaaaaaagtttatctaatagaggtagacaatagaatgatgggtaccagaggctgggaagggtgtgtgtgtggaaggaggcatgaagaaagattggtcaatgggtacaaacgtacggttagacagaataaataagttctaatgtttaatagtagagtagcgtgattatagttaacaacaatgtatcatacatttcaaaatggcttgtagacaggacttgaaatgttcccaacacttagaaatgataaatatttgagatgatggatattctaaataccctgacttgatcattacacattctgtttgtgtaacaaaatattacatgtgttccataaatatgtactaatattatgaagcaatttacctacggctatttaccacattttctttatccagtccaccactggtgagcatctagtttgatttcatgtctttgctattgtgaatagtactgcgatgaacatgtgagtgcatatgtctttctggcagaacaatttgatttttttggatatatacccagtaatgggattactgggtcaaatggtagttgtattttaagtcctttgaaaaatctccaaaccgctttcacagtgactgaactaattgtatatagcttctttttttaaaaaaatcttatgaaccaacctctactagcttcaaacttttttcctgcagcttcctccctctctcagccttaaaagaattaaagggagttagggccttgctctggattagggattggcttatgggcatgttgtggctggttagatcttctatccagaccactaaactttctcccgatcagcaatatggctgtttcactttcttatcattcatgtgttcactgaagtagcacaattaatttccttcaagaacttttcctttgcgttcacaacttggccaactatttggcacaagaggcctagcttttagcctatcttggctttgacatgccttcctcactaagcatgatcatttctagcttttgatttaaagtgagagacatgagactcttcctttctcttgaacacttagaggccattgtggggttattgactggcctaatttcaatattgctgtgtctcaaggaataggaggcctgaggagagggagagaaatgaagaagcgacaggttggagcaatcaggacacacacaacgttattaattaagttcaccatcttatatgggcaaggtttgtggcaccccaaaacaattaaaatagtaacagcataaatcactgatcacatatcaccataagttataataataaagaaaaagactgaaatattgctaagattaacatactgtgacacagacacagaaagtgagcacatgctgttggaaaaacgacactgataaacttactcaatgcggggttgccacaaaccttctatttgtaaaaaaaacacactatctgcaaagcataataaggcaaaatacaataaactgaaacacaataaaatgagatttgtctgtatttcaaacatatttgggagagagaggaatggtataattactgtcctcatatttttttagagtgtcatgtaggaaaggattagaggtattctgtgaagcagatacagggcagatccagaagtttcaagaagctaaggtccagattgaacctagttaaacccgaacaattttaaaagcaaagatatttagaaatggagtgaattatattgcaaattgtgagtgctctgtacagaagtttccagctttaggtaggaggttgagctagaatattttcaagttcccattcaactctacgttctatgattctgcaattttattttatttatacaaagataaaactacttatagatgtttttcaagtctaggggcaccaattaatattgttttgatttaaacatatttatcataagattattgtagacatagctgaaatccttacagattgagcatgcagaataaggctaaaaataagcaggaggtgggcttcagagtgttggagaggaaagtacaataattttagaacttcggctggcaacgatcacaagaggctactaatgttcacagatcgttttatatttgactttaataaccaggatcatttggtatgggttcaggtaatgaggtattttatttttcatgacaaatgcatccttaaatctatttactttcattttgtcatgttattataaaagtattattctatctctccggaaaactatttgataacactgagtaggcaatcatcagactgatgttgtgtcccacataacttggaaattatgccttaggggatggggaaaagagctcaggaaaagagaaagcatattattataactagcaatagtttcatgtattttttccctgcttgccagtactttttacagatgaggtcttaaaactggatgacagtcaaataatttggaataataaataatgccaggtgaagatcaggtccaatttcttttaaaaaatgttgaattcaacaattcaaataaccaaaatatgttaaacttggagactgatcagaattgctggctaaggcagatactttgaagtaactgatgaagttccctataaccagaactttttggcatggcttagaaagatagtataacataaactctaaaatgattttcttcactggggcatcttgacaagcaattaggaagaatcaaggtctaacaattgtgaaaaatgttgcagtttttaaaggactacagtcccctgaatgtgaatttcttacttaggtaataataattactctcatttattgggtgataaacaatatgtcaggcgttatttcaaatgctttgtttatggtgttttatttaatcttcatctcaacctatgaggggattattttcccatttaccagatgagaaaactgagggtctcggctaagattttcaaacttaggtgtctggagcagcgtcatagagctgttggtggaaaagaaaaaaaagaagtttgaaagttacttctatgggttgatttcctttacaatgaattccaatggacttcagctgtacttgatttttgtttttttttaggtattataaggcaaatttgactggtatgtgatatgtcatagtgtatatgctccatacttttagtctttttcatgtttctatacttttttgtctatgagtcagatatttatttcaatgacaaatattttctctaaaataagatatactcaaataattctttccaaagatatcactatcatgctaacagaatatctgattcatttattgtttctttcaaattttatccagcagtttagtatcatgttgtcatttataagatatgtgtaaatatattatgtttaagattttatagaaattctagttgactgaaatgttttgaaaatcgccttttatctaagaaattcaaatgcatcacagtcattcacattagggctctggaagataataaagcgggcctaaaatagaaggcttttatgtattttgctcttgtctttatattttatatctcatagaggacaagagggaacaacaaagccatagaatttttttaaacttttgttttttttcttttcgttttggttcaacatttcttatctgctttctgtcataggaagaacacattgagtgtagtattggtaggatccttcagcaccctgcttctgttatggaagctcaatgggaaaattcctctctccccagcccttggcagacagagctcatgatggtagagttttgaatgaagatgtggtatgctctggtaatgagcatccaactgttgtgtggaatgttagtgtcttggcgagaatgttcataatacctaacttccagaatccctttgggcctcacacattttccagaactacctcccaccaatgtgcagactttttattctaccggtaatttcctttcttgcttgtgacagccagttgtttctgccgcttgccccaagggccctatgatcatcaacctgcacctgtgagaagcctgctaatgcagcattttggaaatttgaatgacttgctttgggtaggtcatatatctagctcattcttgatggaatgaagaataaaatccttcctcatcctttactaagccttaagccccatgattgaacaaaataaatatataaatatctatgacaaatatattttaaaaatatcaaaacattgagacagttttgaaatcaccgaggaaataaacctctattactaaagttgagaaggaaacgtgatccttgtcaccaaacatgtatatttttatgctatgcttttgtcttctaaaggagttattttatgcgaggatgaggatacagaccttctgacaggcaactttcagtcctcagtgtcctccttgtaagagttacttgtgttagctttcatggagctttctgttttaaacaacagcaaaacaaatctattcaaactgttgcaatttctgaaaaattgtttttctccccctcctttttacgatgtcttctgggaaactgaaatgcaatttggaaacaaatgacagctcaggactcactcttccagctctaaaaggaattctgagcacaaattttaaagttcaggttcaagcatttaggttttaattcaaagggagttgtacatttgccataacgtcctttttttcttttatgaaaacagacattcagttatacaaagggagatgctaacatcttacaccacccgcacgtattagaatttctgttctgtgtcagctttgtgttcacaagaactcctgcatgtttttcccccagtcatggagaaaatatagcatattacctactgctgttatttacatataacttggctgatgaaaatttaatagtttttaaaccagtaaaatacagatgaggactagagaaccaatgactgctgctattcagaaaggggttgaactttcctccttctgcactaatgtctatccaaatacaactccattaatgctaattattgtcagtgattattttctatgtggacatttatttatttattttctttaatgataaaaactaaatctttgtatacatggaaaattattttgactacaggatctgatagatatttgagttactcagacaaatgatcatttcagtaagtagtttatttctttctcttgcctgattgtcctgaccagaacttccaatactatgttgaataggagtggtgagagagggcatccttgttctgtgccaattttgaaaggcaatgcctccagcttttgcccattcagtatgatattggctatgggtttgtcacaaatagctcttattattttgagatatgttccatcaatacctagtttattgagagttttaacatgaagggatgttgaattttattgaaggacttttctgcatctattgagagaagaattggataaattcctggacacatataccctcccaagactaaaccaggaagaagtcgaatccctgaatagaccaataacaagctctgaaattgaggcagcaattaatagcctaccaacccaaaatagcccaagaccagagagattcacagctgaattctacaaagaggagctggtaccattccttctgaacctactgcaaacaattgaaaaggaaggactcccccttaactcattttatgaagccagcatcatcctgataccaaaacctggaagaggcacaccaaaaaaaacagaactttagatcgatatttctgatgaacatcaatgcaaaaatcctcagtaaaatactggcacactgaatccagcagcacatcaaaaagcttatccaccatgatgaagttagcttcatccctgggatgcaaggttggtttaacatatgaaaatcaataaatgtaacccattacataaacataatctaattcttaaaagaagtaatttttaggccaatttaggggaaacgtttggtcaaacatcttagaatatactgaaaaagtcatctttctgaattatattttcatcaaaagaatgagagaaaatgaagttatcccataataatttttaaaaattattttattatctgtattagctaaaggtcattctaaaatgagcagtctttagtaactgtaaaatagtaataaattataagaatatattatttactcaatgattatcctaaaataatctttgctcttcatttttggaatgaaggtcaaatgctactctctgaatcctttcataatccctgtggtgagaattattccctccattgtctttcaacagcatttttataccgttattaccacatttaacaccttgaatcttcattattttttatcctgtcttccacacaggactgttgagaggtaatgttttattcacagctgtgttcccatagagccagtcacagataaggcaatcaataaatgttgttggatgaaatgaatacatttacttgagcaaatattttattaatttcccatttccccattctacttttttttgttgttgttatttcttaaagcttatctttccctatcttctcatggcctttcccacctttgtaaatgtttaccttactgcctttgcttgcttattgtcaccttaagaaatttccacccctttctgcagctcctccgtctctattccttgtttttaaatgccccacaccagcccttgtctgagactggaaatcccttcgtgaggacatccctcattttctggaatctaaaatcttcattgtcaaagcataaccttgcaataatgattactgactgcaatttattatattaagagtgttggcaacattctaactaatccaaaatgaaggaattaagaatcaaggttttaaataaaagcatgttttagaaaactactgtcttacttagtaataagatgaggccatggtaatacacccaaagagattctaccatttaacatagagatttaggagattctaccacttaaatgagtccaggggcaaattgttttgggccctgctcatacacttgcttcaaagtcccagacttcttaaacgtagcaactgaatcctagggcctgtgtggggaatgccctcagtctattgttaggtcctcagtccccctcttggatcaacagtgtggcagaaatttggctgttctgggaaccccatagttttaggagagtaagaaaattaattcatgcacaaattatatcataacttaaaaataaccaggctaacttaactagaaaatggtaggtatttacgggtctgtatttttaagtttgtactttatcttcctccctgttttctttctccatcctttcctcccaccccactttgttctttcttcacctttcttcctccttagccagagtgtggagttctcttggcttgtggtgcagcatcactattagtcccctcaagacccctctctcgttatgttagcatattcctttttatactattgcccttcaattgatctcccatatatggacaatgtcataaaagttatttcaccataaatcccattgtgttttttaccctttccatattatggttttaagaattacttcgaatgatgaataatattctgtagtacgtatcctccacctgttcacattattctgttcagtccctccactgagggacatctaggtggttccaactcccctgcaatatgcatattcttgcatgtcgctaattgatcatttatttagtgagggaataccagtagaggggttcttggacacagagtatacttttccctaatatcactaagaactgccatattgttcttagctacaccattctacaaaacattagctgaaccatggtggtttctgcttcccaaatcctcaccaacactccaagtttttccaacacatattttttagggtttaaaatgggatttctttgttttgatttactttattctcattatgaatggtattgagtatttcttcatataattatttaacatttgggcttccccttttctcaaatgtctgtttttaaactttgagtttcttctccttttcttattttcttgaagtagttcctcctacccccaaccatgtatcattatcttgtcaagttttagatattgcaaatattttctatattgtcatcatttgattactttgtctaggatcttcttttttcaacaaatgaatacattttgatgtatttaaatctctctctctctctctcactatatatatatatatatatatatacacacacacacacacacttttatttaaagattataatcttgtctcatttaagaattttaatgtgtctgaatgctggtaggcttggtgctaacctcccttgacaattttgctcagtttttaaaaagtcagcataactattcatggatctgtgattagtgattttggctttataataagaagttgtatccttttaaaaaaatctggccagattttaattgtgattgcattgcttttatacatgatttttggagaacagaactcaataatattaagtcgttctttatatatgtacagaatatcttttcatatattcagattatttatgtctatcaacagttttgcaatattttgcaattttttcaagaggttctgtaaattctttgttaattcatacatattaaacagtgtttgctattattgaaaaatgctatattttctatctgctgcttagaaaaatgtgttatagaattgtaggtttgttttgcattgctctgacaatgtattgctggatactgcattttgaatagaacctgatcgtcttttttattgaaaatttgaatttatttaaaattatatttattgatatattaggacttaaaaattcaaccttacttaaaattttctccgtaaaaatttttgttttctgtttttttctgctttgtattagataaatcaagttttcttttgctgattaaggtgtgataaatattttttctcttttttatattattgtcactagcattttaatgcacacgtaaagttaattttttcttgacaattttatgaacttaccaatatctatatatatactgaaatgagacaaatattttctaccttttcacctctctacctttggttctgttactatgttggaagaatttaagttctaaaattcagttttgtgttgaaatggatttccattttttatcactcgctcttcagcttttcttcaatttcttacctttttcacttgcttttattttattttactttttcatttttattttttgagatggagtttcactcttgtcacccaggctggagtgcaatggtacaatcttggctcactgcaaccttggctaactgcaacctctgcctcccgggttcaagcgattctcctgcctcaacctcctgagtagctgggattacaggcacacgccaccatgcccagctaatttttttatttttagtagagacagggtttctccatgttggtcaggctggtctcgaactgctgacctcaggtgatctgcccacctcggcctcccaaagtgctgggattacaggcataagttaccgtgcctggcctttgcttgcttttaaaaaaaatttaattgtggttcttgctcttctgtacaactataagttaccttctaacccattttttaaatgtttctaatagtactctactttttattgtaatatttccttaaataatattttcagaggatctttattacacagaacctctcaggctttgaatgcataagaatgtcttaatttcattcttacatttaaatgacagtctgagaagatataatattctaaaatcagagttctctttcttccatattttgaaaatatttctccattgtcttttatttctagagtttttgttgaggagtcagatgtcaacctaattatcatttcttttttgggtagtctgttctttctcttcagaagcttttagaaattttcctttgtctttgataactttaaatttcactataataagccagggtataagatacttaactatcatttttttgtcatgctaagaatccattcaatcttttttatctcttttttttctttcttttgaaactcttgtcttctggatattaggactttctgtctctggtggaatttttcaactctttctttcatgagctcactatttcaatgcttgctaatacaaacgctgctatttatgactttcattttgttttcacctacaagttttcatatcatgcagctttcaaataaaaattatgtgtgcacatagttaagtagagttcaatagtaccacaaattgtgttatgaaaaacagtagtccctgatccttccttttttcttattggaaaccagcactccctatttttcactgataatttgatatttatttctgtatctctaaataaaatgtggcagttcttatgtttattacttttagtcattttctattggtttgatattgtggaggataaaaatttagctctctttacccttgctcccaatattactccccactcaattttctattcgcatcacatcaatgtgggtaaataataattttgattataaaaatgtgtttacattattatgtctgtaaaaactgggccaaataatacactacaattacctttgctgcatgacaattctacttagtactagattaataatagtatttcttttatttgcttaattttctatatgctgtcattaatttagttctaagctcttgctaggcatgtaggtatcactcagtatattctcatattaggtaatttattaatattatcatcttaagtctttcctggacagcccattctttagacttgctgcattcctctcttcaatttgtgaggaatttgggtagacatttcccctagagttttagcttataactgggtaggtaagacagggtctcctgtgtagacagctatttcctttgacagattgtatgttttaggtgtacagagtgagtaatagagcccatttgactttaggtcttagctaagttccaatgactatattttgtgtgtattctctattcactgtaattacataaggggaaaagagaatttaggcactaaactcctcaacaatccttattgatctgctttgcaaagagttgttataaacttcaatatggatccgaaatggcctgtggattagtgtttgggaaccactaagtgagctcacctacttgttcgaccttccctaatcccatagattggcaactcctaaatctgtatctttaacccagccatctttcttaaacttaagactcacatccagcaagctacctaccaagaggatgttctctaagtatctcaagactgacatcatccctacaacaggtatccatttttaaatatattttctatagcaataggccctcctagttgcatgtgagaggcagcttagattagtgtttagaaaaacaatttttgagcaagattatctgggttagagttccagtgctaccacttaatagctctgtaaccttgaaaaattgacttggcctctcattggcaagataggtataaataaaagtagggctgttacatgggattaggtggattaaaaagtgcttagaacagagcctgacatatagtaaattttgtacgtctctttaatgcaaatacacgaataatcaaataaacaaacttatgctagaacctcaaaagcaattgctgtgtattcttcaatccccacccatccattttattaccaagctattgataactactaatgactaccaagtttgtcctctagttatttcttaaataagtcactggaccataaactctgtaaatgtctgttggcttacaatcttatttctagtttgtaccacaataccacactcacctagtggatgttcaatatattttttgttgaatggtttaatgaattacacatactacattgtattataattttctataaatatatccccccaccagatttaattttttgactaggaagactttctactctttttagcacagtgcttagaaaacagtaggcacaaataagtatccaatatatggatgaatgagtgaatgaatgaaagcatttggataaaagaagaattcaaacctagtaagttagattccttagaggcagtattgctctgactgagaaacacactgctgaagttaataaagcagaacagcttaatgttatgttgactttacttggcatcagttttttaaaaattaccagcagttaacacagatagactattgaaagcaactaagatatctaagatatactgaagtaaagccaattatcctggcaactaaaggtaagttgtgtttgctaagcatttaacttctggatatgaggatgcatttttagtaacaaatcaaatagcggcacttctggaccctttcatattgtctgaagtactctactccagaaatggaatattataatattcttgaccaagggtatccacactattataatatttatgccaaatatctacactattaaaatatttatgccaaatatctacactattatatttatgccaagttacattaacttataaaacaaaagtaataataaaaaaaattctaagctttctaggtgatggaaatattttattactgaaagtactagataaccattatactatcaataacatatatgcttaaaatatatccaaatatttttataacatgagtgactggtaattgagttatgtataaaatgaaaagtaaatattttaattttaaatctgaattaaccccatgctatatattgagcaaaacaacaacagcagaacacattgttccaataaaatgacaaagaattggctgatctactttacagagaacagcaaaataaacagagcaaagaaacacgcatgatggcagtcatacagagacagtgcagataccatctatgctgatttggctccattttacacaatgcacaaagtcattctttgttaataatcacagcaaactattttatttgtattttcctttatcctacacaagaaaaattatacttaacatggcctagggtaagtattccaaaaaaggattccttaatttttaaaagattttatgaaaatatatcagatgacaaacgaaatgttaaatatgtgcaacaaccttttgctctgtttattcaatggctactatattttcactgcagatttctatgctatttgccataacaaataacaagcccatgaaattattactcctgtgtaggaaatcatgatccagaaaaacagtcatgtgttaaacaatgtttaaaaattgctatttaacttaataaatatttattaaacactcgctgtgctgaaaaatctgatagaaaagaataggcgaaattcagctacacatctacccatactcatgcccacacaaacacatacacacatagtgagtgtcttatttcttggtgccattttagaggttcggcatcagtggaagggtgttccaagaaagagaggacaacttctggtttataagaaaagaagtatatcagcaagaaaggactagataaacattgaagaatggacaagaccttgacaagtagagaatgtggggaggacatgaggtggagaaagtttcactggggacagcacagaggcaggaactgtgaaagcatcagtagctcagtggggctggacaataaaggttgatgttttggaatacagtgggaggtaagccaggctcacagcactgacagtcttgatgaccagcttaaggagtttgcatttgtatggtaagcaaggaggagctgttagacttgaagatatacttgaatttaaatatttattttatgcttggatattttattacattttaatgtaaaattttaatttataatattataactaatttgtcattttgaaaaattgggtccctcatataacattttatactctatag

SEQ ID NO: 1377 - DNA, 1199 bp, Homo sapiens
cagcaaaccaaggggttgtgctgtctccttgtctcccagggataaacccacatgacagtttacaaaaacaggtaatcataagaagcaaatggcccagatgaaacacagcaaaagaatgagaagtggtaacactgggagtgaaatttgaaccaagcgtaaatggagtgatcgtagaaatagctgactgtggaatgtggacactctctgtatctgcagcctgggaagcttaaagaaggtgaacttactgacaccagttagaaagtgactgtgatgaaacgatgaagatgctccagaggaagtgacaccagcaataggaaaaaaaaaacaaacctctcactgaaggaactctcggagatatttcatgacacagaaggcacaaaggatacaatattggcaactaatcgaaacttagaaatgatatgacagctcaccaaggcatagaaaaagatgcttgctctatcataagttatagaatgagaagaagtcatagatagcagctaggacggcagtcctctggaggctgtgctgcatggagacatccaagatgacttctctcacatgtctagcaacttgatgcttctccacatggcctgtctcctcatccttaggggtatctcatcctccagggtttctacacatgaccactttctacagcgtggtagctggatgcatacattatggtccgctttcatgagtgcaaaaaaggaaggtgccaggacttttaaaggcttaaatccaaaatgctacagcatcactgtcactgcattttattgattaaagtccacctgcaatatgggaggagactacacagaggaataagtaccaacaagcgtggttcactgggatcatttttgtataactatcacatcactttgttttggtttccaaagctgttgtgttttgggacgttttttgaaattacttcaaaaagatttagaggagaaaaaaatgaactcagttttaattcaccatcttaaagtgggaatccagtatttgttttgaaaatggctgtagaaattattttttggtatttgtgttattctctttttactatgtgcattgtgtaatacaacatatacaataatctcattttctaatcctgtcaacatcacttaattgaaaaaatatggttttctttgaaaataaaatctctcagaataagaatatattcaattctttaattcaataaacatttaaaa

SEQ ID NO: 1378 - DNA, 1199 bp, Homo sapiens; identical to SEQ ID NO: 1377

SEQ ID NO: 1379 - DNA, 5673 bp, Homo sapiens
gacagcaaaccaaggggttgtgctgtctccttgtctcccagggataaacccacatgacagtttacaaaaacagcctgggaagcttaaagaaggtgaacttactgacaccagttagaaagtgactgtgatgaaacgatgaagatgctccagaggaagtgacaccagcaataggaaaaaaaaaacaaacctctcactgaaggaactctcggagatatttcatgacacagaaggcacaaaggatacaatattggcaactaatcgaaacttagaaatgatatgacagctcaccaaggcatagaaaaagatgcttgctctatcataagttatagaatgagaagaagtatatcagaaaactcaaatataactccacaactttttcaagagtttctttttgttttccaatggtaacgggagagaaaataagctgtcattatcggaatgatcaaacacagagagaaaagaggcagaggtgagaagatggagaagatgaatacatttgctttcagcaaaccaatggaagtccatttgcatgatctgaaaaggaaaatgagaagctaatttttctatacaaggcagaatttaagaaatacaattcctaaggactccagtggatacagctctggttcctggacttcgtgttttggcttggtctttctgctttttcaattttgtcactgattccagagaggctttcaaaggaagtcgtggaatcttctgtggcaataacaaccattcacattcactcccggagatgtagactttcttgtggccttacagattgatcacagccatcaaaggaggaatgaacacgtttcctgaggcactctatttacatactcagggtttttcatcaatcatgtaaaagagagttacattttcaggtcaaagtgactcatcaagccagaggggtgagtcatggaagacatatgacgctttccagtttaacctgctgtgcgactatgaacacctgtaacagtcatcttgccataaatctctccctgacctttctgtgacaagagaaactgctaccaaatcctgaatcctacctgtatagtaagaaatgatttcagtgtttattgcagaaatcttctatttggagaatttaaatttaaatcaaattcagaggcaaattcatatcttactttagaagtaaagcaaatcattggaaaaagcactgggggagagagattgagatagagaaagagagagattctctttcaatcagcaattctgtgtctattagtttttcttgaaataagcaagtcttgaaagatgtatgtactgggtgtttattgcagtagattgaatattacgaaaatattgaaaattatccaaaaatctaaggctatgaaacttaattatggaatattcatacaatgaaatattatgaagtcttgaagaatgataggaaattgtgatatattgttttaaaagttgtatcttcaataaatagtgaaaagaggaagatatcagaaaaacctacagattaaaagagacttatgaaactttttttttaatgggggagacaagttctcactctgttgcccaggctggagtgcatagtgtgatcatggcttactgcagcctcaacttcctgatctcaagtgatcctcctgcctcagcctcccaagcagctgggactataggtgcacactaccatgtccagccaggaaacatattaaccagttgcaatgtactgcattgccctcataagtctaagcatgcacacatacagaatattaaggaaatgtaaacactgaccaattattgaattatactatggaatttttataattatttttaagtgtgataatggttttttttttagttctatattttagagaaaaaatactatgctgattggagaatgtaaagatatagatgaaacaagattgaggaagtttgaaagtttactatacacttctctctacttatgtacatgttgaaaatgatccatttgttaaaaggtttttttaagttataaaacagtgtgtatactgtgaccctatttgttaattattttaatatcttttttcttattcttctataaaagacatgacaatattttgaggtaaaaatactttttacttattcatgtatttattttttgagatagggtctcactctgtcacccaggcctgaatgcagtggcatgatcttggctcactgcagcttctgcctcccaggttcaagcgattcttctgcctcagcccctgagtaactgggattacaggcatgagccaccatgcctggctaatttttgtatttttagtagagacagagtttcaccatgttgcccagactggtcttgaactcctgacctcaagtgatccgcccgcttcggcctcccaaagttctgggattacagacgtgagccaccacacctggcccaaacatactttttataataaataagtaatttgacaacttgaactgatttactctagccattaatctctcaaaatttgctgttttcccattatatctaatatactactgagtttacagttcataaactattaaaaatgacagcgtgagatggactcacatgttgtctcaaattaagatcttctattatcataaggcccatccatcagttgtgaggtgacttttatcctgtggccagggagcctgataattcatgcctggggcaagcaaggagatcaggacaactcacgcgaaaccccggactttccagttttcatacaaagctggactttcataaacaaaacaaggaaagaaactgagcatcttaacaggcgaatttaggggaaaaaacaaacaaacaaacaaacgtcttttttatataaatgatttgagtaatttagaaaaattttaagggccattttgcctaaattaataagaaaatgtgattgctccaggtaccaattttgctcttttaagatggccgggtttacctcagctctcagaaaaaaaaacaaatcatcccaccgtaacattttcacactcctaaaataagctttaaattttatttatttatttatttatttatttatttttgagacaaggtctctgtttcactcaaattgagtgtagtggcatgatcgtggctcactgcagcctctaactcctgggctcaaatgatcctcccaactcagcctcccaactagctaggactgcaggcacgcaacaccacatctagctattttttttattttttgtagagatggggtcccactgtgttgcccaggttggtctcaaactcctagatgcaagtgatcctcctgcctcagcctcccaaagggctggattacaggcctgagccaccacacccagccaagttttgagtgggccttcctgaaagtgaaagtgaaagtgactgtgtgcatatacaatggaattggaataaattaaatgtaatgaacttctcacatcagcctctgttgatgggtgggctgtgctatgtacttgctcttgcttaaagacccaaccacacatcctgtgtgcaggaaagacagcagtttggaaattgcaggactgtgattctgctcatgccctccaaggctccaaactgtttgactagaaaattctgctttgcttctggtgttggtctccgcttgctaggtctctcaactgcaggccctgagccctatctcaggtaactaagttctgccccactcaacttctgagtccaagttcatcatctgtccagagtgagtctttgccacaccagagtagggtggagtgggccttgctaccctgccctgtagccagatgggtgctaggtctggaggcttctcccctgaccccttgtcattcacaatagcacctcgggacttctgttttggttttctgaatgttcccctggcccatacccagggggaagcccacagtctcagccccctagaagtggccccttttcatcctgtagtaaccacaggctgaggtctgattcccttcataagggaccacctgaaactacactgccccctcctggatgccattcctcttgctatgacatccatgcaagcaactggccgcccccctccacatgagacacccaaaaattttcttgggatgggattgaactctaatttgctatacctgtaaaacataattaggaccgtagggtatgcctcagtggtaatacagaagcaggagccgactgataaattttcaggatttttgcaagttggactgttaaacacccccagtattaaaatttgagtcatataaacttttaattaatctatactaaaaataaaggtcatactcaaaactcatcacttcttatcttactacattttactactgtctatgctctgagttatttacattgactgtagtgttatttgtatgactgtagtgttatttgtatggtggaaattactccacttatcaaatcatggttgaattgcaaccatcggttggctatggagacaagagttcagtaaaaatcaatgaaagcattctgtgagagtcaattggccatatgggacttaaaataagggtattgcatattttattattatttataaatggcatgctactcatccttttttgtatcaataaaatttataagttgatgtattttattttccaaagagcctattgttaagcatttcccagcacaccactgtatcccatctaccggactgtgagcccagttctatggtctcatccacaacttcggttctgctcacctcctgcactgactttgagactgttggagaacaggaggctcatacccaacccactcttaatttatctcatccatgtggcaggacatccattagcataacacacctggcttcggctccccgccacactcctctaggcaaactgacttacccggttggtgaatttggaagaaaaactgtgtcatatatagcttagcttttttccttttcttaggagctacccgcaggaggggcatctttctccagaggcaaagcctgccttgttctggtgttgcctgaggctgatgggcaagttggtcaaatcccaaagtttagttgataagaactgcacttgcttgaagatagaagctatgctttcccaagtagcattgatcaataaggagctacctgcaggtagcaggtgtgatccagagaacatgcctttcactgtgaaaaccagcaccttcaaggccaggcgcagtggcttgcgcctataatcccagcatattgggaggccgaggtgggtggatcacctgaggtcaggagttcaagaccaacctgaccaacatggtctactaaaaatacaaaaattagcccggcatggtggcgggcgcctataatcccaggtactcgggaggctgagacatgagaatagcttgaaccagggaggcggaggttgcagtgagacgagatcacaccattgcactccagcctgggcaacagagcaagactccatctcaaaaacaaacaaacaaacaaacaaaaacaccacacaaaaccagcaccttccacagtgtctagcatacgttagtcaccaaaacaggtttgctaaatgaacaaatgaatgaatggcattttatgtgtcagtaaatatgcttcaaaatcatgatgtatgatgagtaagcaactctatcaaataaatataacgtaatttgctgtgagcacataatttgctgtgttctagtattgaacagttggactatttccatattttaatttttactattatgtttgaggatgatatataaatctt

SEQ ID NO: 1380 - DNA, 2704 bp, Homo sapiens
ggagagtcctcagagagtcctctctctcggcatggacacaaaagaaaagccatgtgaggacacagagagaaggtggctgtctacgagctaggaagaaaggcctcaccggaaaccaaccctcacagcagctccatcttggacttccagcctccggaactgtgagaaaataaatgtttgcaattcaggtcggggagctccacccagcagcagcgtttgacagagctgttcacttcctcttcctggagctgtggcttccagagcccatgctcagcagttcccctccttcttcgactgctcctctcttaggctcagagccactcagacattgggaagcaagtttgtcaagatgacagagaaccgaggtaatggattcgagtgatgaaacaggaagttcattcatgagtttttggccacacctccaaagtgacgacttagccagaaatgggataactgggtttccctacttctcttttatcatcctcaatgagagtgaccaaatattagagctagatggaaccttagtgaaaatctggctactcgtcccgtcccaccagcctgccacccatttcaagtttgaagagacaaagacacatggaccttatgtaattactggggattaccccaggagtctgtggcaaaagtcagcttcttccctccctgcttccccgccctgtctctggtactttctaccaacactgggctgtttctgtgatcacacttaagcgtacctaacctgcgaatgctgtatagaaggtgctaatgaacatgatttagctttaacactcagttttctaaagggacacgtgggggcagcaaatgtttaggcaaaaacaattccagttctagcctctactgtctacatatgtgtatacatttgggaaacgtttgggaaagggatatttgagagcttctttttcttttttgtggtttagttatttgatgatattgagattgtttctgagccatgtgcttcaacatcggattggggatttcagaaaaagttttagtcactgtgattccatttagcttccaaatgtgtctctgctaagagacttaaaagcactcataaatagcacgtgtgtcttctttgcagtgtttgctaattttgagtcacatctttttagaaaatcatgagatttggtgtcacagagactggaataaatatagtcaaacttattggtgaagatttcctttagctgttttcataatccatttccattgttatgattattgatgaataaaacattttctttaggtagatacttcttttttccccccaccttgatttaatgtttccactcttattgtcaagtttcttattactccctaataactctcaataaaataatgattcctgggagattattcctgctttcctactatcacctgttgatttgaaaagacagaacaataccgtagaagcttcactaatacattgaaagataaaatgataatactaaatactaaaatatgaaaagtgatactaaaagtggagtcctggcactagtatttttttttttgagtctttaaattttatttatttatttttgaattttttaaaattatatgttatgttctgggatacatgtgcagaacgtgcaggtttgttacataggtatacaggtctggcactagtattttgttgccacaaaatatcaagcatgtatccaaactgctcaagacacattaaagacacaggtaatctgtaggcatattcaggcttgtagtttgcattttttggttttcttgtggctttcagtgcaagttgaggtaattcatgggaaacagtcaccaaagaagtgccagtattagaaatccaagagccatttctctagcttcttccagaatcaagactttagaggtaatttctatcaacactggacatttcctgtctgcaattaacaatgaacacatagcattatgtttaattgcaacctgtttaaagcagattggatgctaaggtttaagaacactcttcagtcaaaaaggtcttttaatcaggtttttaatcttgagcacaatctaggacacagcatcatagactaactcattcgagaataggtgttgtcatctaatcctaaccacccccaccaccaacaagctgaatagctctgggctcagtatatacatttgtactgggctcagtacacacacctaagctgggttcagtatatgccactttatagtgagaggcattttgtaatgagagctctgggttcactatatacatttgtactgggctcagtacacacatctaagctgggttcagtatatgccactttatagtgagggccattttgtaatgagagctctaaggctctaaaattctgtgtttctgctagtttcttcctcaagataaaactgtggaactcatagtgaattccctctctttgggcagtttgagccaggccgctatttaatcacaacatcacaagtcagatttttcctacctagtgttggcagtggaacacaccagaactgctaaggccaaggaaatcccattttttgaagaggctttcctttgttagcttctctttctagtagtaaaggtaaaagaaaaatagatgttaaagatataaatatcttagggggtttttattggtataaatatttgtacacaaaaagaatatgtaatgtaaactggatatgtattttttacattttacttaacctgaattttacacaatctttgcttgaatgctcc

SEQ ID NO: 1381 - DNA, 11196 bp, Homo sapiens
taaaagtttggaaaatttgtagcccagctatgtggtagaaaagaaaaacccattttctgtggaggaattcaagccagctgcagaaatttgcatatgtaaagaggagccaaatgttgatagccaacataatagggaaaatgcctcaaaggcatttcagaggtctttgcagcagcccctcccatcccaggcctggaggcccacaaggaaagaatagttttgtgggccaggaccaaggtccggccactctgtgcagcctggggacatggtgccctgaatcctggctgccccagctccagccatggctaaaaggggccaaggtatagctcaggcagagggtgccagccataagccttggcagcttccatgtggtgttaagcctgcaagtacacagagtgtgagagttgaagcttggaagcctctgcctagatttcagaggatgtgtggaaatccttgaatgtccaggaagattgctgcaggggtggagtctgtcaggcctctgagcccaagccaagccatcgcatcccctgtgacttgcatgtatacgcccagatggcctgaagtaactgaagaatcacaaaagaagtgaatatgccttgccccaccttaactgatgacattccaccacaaaagaagtgtaaatggccggtccttgccttaactgatgacactaccttgtgaaagtccttttcctggctcatcctggctcaaaaagcacccccactgagcaccttgcgatccccactcctacccgccagagaacaaaccccctttgactgtaattttcctttacctacccaaatcctataaaacggccccacccttatctccgtttgctgactcttttcggactcagcctgcctgcacccaggtgaaataaacagccatgttgctcacacaaagcctgtttggtggtctcttcacacggacgcgcatgaagtttggtgccatgactcggatcgggggacctcccttgggagatcaatcccctgtcctcctgctctttgctccgtgagaaacatccacctacgacctcaggtcctcagaccgaccggcccaagaaacatctcaccaatttcgaatccggtaagtggcctctttttactctcttctccaatctccctcactatccctcaacctctttctcctttcaatcttggcgccacacttcaatctctcccttctcttaatttcaattcctttcattttctggtagagacaaaagagacatgttttatccatgaacccaaaactccagcgccggtcacgggctgggaaggcagccttccccttggtgtttaatcattgcagggacacctctctgattatacactcacgtttcaagggtgtcagaccacgcagggacgcctgccttggtccttcacccttagcggcaagtcccgctttcctggggcaggggcaagtatccctcaaccccttctccttcacccttagtggcaagtcccgctttcctggagcaggggcaagtacccctcaatcccttctccttcacccttagtggcaagtcccgctttcctagggggcaagaagcccccagttgcttatttccacaccccaacctcttatctctgtgccccaatcccttatttccgcaccctgacctcttatctctgtgcccccatcccttatttccgtgccccaaccccttctctgcttttctggagggcaagaaccccccaacccttctccgtgtctcttttctctgggcttgcctccttcactatgggtaagcttccaccctccattcctccttctcctcccttagcctgtgttctcaaaaacttaaaacctcttcaactcacacctgacctaaaacctaaatgacttattttcttctgcaatgccgtttgaccccaatacaaactcgacagtagttccaaatagccagaaaatggcactttgaatttttccatcctgcaaaatctaaataattcttgtcgtaaaataggcaaacggtctgaggtgcctgacgtccaggcattcttttacacatcagtcccttcctagtctctgtgaccagtgcaactcgtcccaaatcttccttctttccctcccgcctgtcccctcagtaccaaccccaagcgtcgctgagtctttctaatcttccttttctacagacccatctgacctctcccttcctccccaggctgctcctggccaggccgagctaggtcccaattcttcctcagcctctgctcctccaccctataatctttttatcacctcccctcctcacacctggtcgggcttacagtttcgttcggtgactagccctcccccacctgcccagcaatttactcttaaaaaggtggctggagctaaaggcatagtcaaggttaatgctcctttttctttaccccaaatcagatagcgtttaggctctttttcatcaaatataaaaatccagcccagttcatggcttgtttggcagcaaccctgagacgctttacagccctagaccctaaaaggtcaaaaggccgtcttatgctcaatatacattttattacccaatctgctcccgatattaaataaaactccaaaaattaaattctggccctcaaaccccacaacaggatttaattaacctcaccttcaaggtgtaccataatagaaaaaagttgcaattccttgcctccactgtgagacaaaccccagccacgtctccagcacacaagaacttccaaacgcctgaaccgcagcggccaggcgttcctccagaacctcctcccacaggagcttgctacacgtgccagaaatctggccactgggccaaggaatgcccgcagcctgggattcctcctaagccgcgtcccatctgtgtgggaccccactgaaaatcggactgttcaactcacctggcagccactcccagagcccctggaactctggcccaagcctctctgactgactccttcccagatcttctcggcttagcggctgaagactgacactgccggatcacctcggaagccccctagacagtcactgacgccgagcttcaggtaactctcacagtggaaggtaagcccgtccccttcttaatcaatacggaggctactcactccacattaccctcttttcaagggcctgtttcccttgcctccataactgttgtgggtattgacggccaggcaaacctcttaaaactccccaactctggtgccaacttagacaatactcttttaagcactcctttttagtcatccccacctgcccagttcccttattaggccgagacactttaactaaattatctgcttccctgactattcctggactacagctatatctcattgccgcccttcttcccaattcaaagcctcctttgcgtcctcctcttctatccccccaccttaacccacaagtataagatacctctactccctccttggcgaccgatcatgcaccccttaccatctcattaaaacctaatcacccttaccccactcaacgccaatatcccatcccgcagcacgctttaaaaagattaaagcctgttatcactcgcctgctacagcatggccttttaaagcctataaactctccttacaattcccccattttacctgtcctaaaaccagacaagccttacaagttagttcaggatctgcaccttatcaaccaaattgttttgcctatccaccccgtggtgccaaacccgtatactctcctgtcctcaatacctgcctctacaacccattattctgttctagatctcaaacatgctttctttactattcctttgcacccttaatcccagcctctctttgctttcacttggactgaccctgacacccatcaagctcagcaaattacctaggctgtactgccgcaaagcttctcagacagcccccattacttcaatcaagcccaaatttcttcctcatctgttacctatctcggcataattctcataaaaacacacgtgctctccctgccaatcgcgtccgactgatctctcaaacccaagcaccttctataaaacaacaactcctttccttcctaggcgtggttagcgcggtcagaattcttacacaagagccaggaccacaccctgtagcctttctgtccaaacaacttgaccttactgttttagcctagccctcatgtctgcgtgcagcggctgccgctgctttaatacttatagaggccctcaaaataagtagaggcctttcatacagggtctgagaaggccaccgcagtcatttcttcccttctgtcagacataattcctcagtctagccttcccacctcaatacagtctgataacagacgagcctttattagtcaaatcagccaagcagtttttcaggctcttagtattcagtgaaacctttatatcccttatagtcctccatcttcaagaaaacacacctcaccaagctcagccaccaacttaaaaaggactggacaatacttttaccactttcccttctcagaattcaggcctgtcctcagaatgctacagggtacagcccatttaaggtcctgtatagatgctcctttttattaggccccagtctcattccagacaccagaccaacttagactgtgcctcaaaaaaaaaaaatcccaaaaaaaaaaacttgtcatccctactattttctgtctagtcatactgctattcaccgttctcaactactcatacatgccctgctcttgtttacactgccagtttacactgtttttccaagccatcacagctgatatctcctggtgctatccccaaactgccactcttaactcttgaagtacataaataatctttgctggcaggactatgctgaatctccttaggcactctctaatcagacatcctgagttgtcccaattcttaggccttttatacctgtttttctccttctgttatttcatttagtttttcaattcatacaaaaccgtatccaggccatcaccaatcattctatatgacaaatgtttcttctaacatccccacaatatcacgccttaccacaagacctcccttcagcttaatctctcccactctaggttcccacgccgcccctaatcccgctcgaagcagccctgagaaacatcgcccattctctctccataccaccccccaaaaaattttcaccgccccaacacttcaacactattttgttttatttttcttattaatataagaaggcaggaatgtcaggcctctgagcccaagccaagccatcgcatcccctgtgatttgcacgtatatgcccagatggcctgaagtaactgaagaatcacaaaagaagtgaatatgccttgccccaccttaactgatgacattccaccacaaaagaagtgtaaatggccggtccttgccttaactgatgacattaccttgtgaaagtccttttcctggctcatcctggctcagaaagcacccccactgaacaccttgcgacccccactcctgcccgccagagaacaaaccccctttgactgtaattttcctttacctacccaaatcctataaaacggccccacccttatctcccttcgctgactctcttttcggactcagcccgcctgcacccaggtgaaataaacagccatgttgctcacacaaagcctgtttggtggtctcttcacacggacacgcatgaaagagtcctcatggagaaactctactagggcaaagtggaggggaaatgcaggcttggagtcccccacacagaatccccactggggcaccgcctagtggagctgtgagaagagggtcactgtcttccggaccccagaattgtagatccactgacagcttgcactgtgcttctggaaaagccaccggcactcaatgccagccagccggtgaaagcagtcgaggggactgtatcccgcagaaccacaagggtggagcttcccaaggccttgagagcccagcccttgcatcagtgtagcctggacgtgagacatggagtcaaaagagattattttggagctttaagattcaatggctgccctgctgggttttgaacttgcacgtggcctgtagcctctttgttttgcctgatttctctcttttggaatgggagtgtttagccaatgcctgtgcccctattgtatcttggaagtaactaacttgtttttttattttatagactcatgggcagaagggacttgccttgtctcagatgagactttggactgtggacttttgagttaacactgaaatgagttaaaatttaggggactgttgagaagagattattgtattttgtagtgtgagaaggacatgatatttgggaggggttggggtggaattatatggtttaaatttgggtcctcattaccaatgccatgaagccatcctacaaatcctgggctgcttacacaccaattaatatggtttcaatttgtgtccctgaccaaatctcatgttgaactgtaatccccaatgttggggtaggggtctggtggaaggttattggatcatgggggcagacattccccttgctgttctcatgatggtgaatgagttctcatgagatgtggttgtttaaaagtatgtaacacctctcctcctctctctgtttctcctgctctagccatgtaaaacgtgcctcctccctctttgccttctgccatgattgtaagtttcctgaggcctcccaaccatgcttcctgtacagcctgtggaactgtggaagaatggtccagggaactacgaacccagggttatccaggcttacagggctgaaagcccagaatgactcagtgctacatgttttaagggaaccaataaagatcattattgttactcagcaatgacattcctgccacacagcgcaggctctctacatttctatttacaatcttcatgttaatccccaagtaatatttagattgttgtgtaaaaccctaaattctgctccaaaagaagattgtgccaaatccatctatctgagtccttcccactgaactcctcatcttcttgcccagaggtagtccttcaatcatttcctccagaaatcttactaaacaaagaacagctgactgcatttgaatgctcaagacctaaattgaatggggaaggaaagagttacacaaaaaaacacaccagccaattggcttcaactcacttgaactatgagagcttctaaaaggtacctttcatgaataaggttggaaaaggactacactcagttaaattctttgaacaatcatgacaaaagccaaccctatatccagcagaagttgagtataaaagggtagagactgcactgaaaaattgaaaagtaaattattacatgcaaagcatgtacctttgcatgaaaacagaattttatgactgtaccatctctgtctattagccaataaagttttaaatgatatttttgatgatgtctccagaccctaagtgttggagtttccacaacagagcactcagatgagaaagagacaaaaaaacaagcagatggctctctgggcacgaccatctctgtggtaatcataagggtgggaacctccctaacaggtatccagggttcaaggatcaatgccccaggggtgattgtgaatgtgataattagttcacaacgtttgtactcatgcatggtaaatctgtaaaccagaataatcatcatttaagtatatgtaatcatataaatatatatacatagatatctatatcaatctagctatctatatcatatgtaattgtgtagccagggcaaatcctccttagcactgacatccctggctggcagcctaattaataatcagcactttattaggctattgccatttcatattatcagtatctgtttcactcttcaaacttccaagtgaaatatccattaaaatatatttaaaagaccaatactagaaacatttgttattaatttttaatttgatgtataatacactgaatttatctgtctatattatatatatccatcttttaaattattttgcttgaatctttaatcctttgcttgctttaattgtcagagactgaatgtggtatctagcgatctcttaattccagcatcctgaccttagccctccccactccactgccaccagcccaaacaaatctattaataatctggcactagtttccaacattctcaacaggcttcatgacaaaaaataattctgatcaaataatccagtgatagcagttgctaaagatgcttacaataactaacagaagatttttgagaaacgaattatcactccagatatctctgaagagtgtcttgaaacacacttgaaaattgatcatatcatatcccacaaagaaaatcacaataaattcctcagtaagctctggtggcattgggaccaggtttcccatgggggtggccaactagttaagcacccttctttagatttcctcgtttacttcactagcaccactctcctactctttggatcccatcccaaataaaccatctgcccataagcccttatttcagctttgttttccttgaaaacaaaatctaggatatgttctttcttttgcacttattgtctgcatcctgctcaatttggattcttatgtccagcagtttctcctcagtgcatgttttgtcctacaagggggctgcactttgttagttttgacagtccatggggtccaatccactctaacactcacccgtaaattggaggttgcaaagtgctcctgaagttctgttctcagaccagccagctgcactttcctatgaaaacctgttagcagtttcgaggcttttcatccttgatctgtcagaaacccctctgctttcccttctttttcatctataggtaggttctgataataagcagatttggttactatgcatagttcacttgtatttgagtgttcatgtgaataccttctcacatacttgtatgtaggggttcacatgaataccttctcatggtgcttttgctgcagatttctctattcatttgggtttgctctcctagtggcattctattccattccattccacaaccacacgagtaaaggatatattctgtaaataatctgcaaactcagtgattgagaaaaatagtggtcatcactttataacacatactaaaataagctgcaaatgaactgagataaatcttaaaatgtaaacataacaagaagaaatagtaggcaaatatgtatcttatttgtgaagaggaaattgtttttctaagcttaaaatcctaaaatgaaaagaaaaaaatgatactcatttatattaaaatttcaaaaacttgatataaaatagttaaacagtaagtttaatgcaagttaaatactaagcaacaaaaatactggtgttaatgtggcaaaggattaatttttaatatatgaatgctatgaaatatatcagtatgaatgatactaaaatctagatagaaaaatgagcataaggcatgaacacagaatttgtaataaaagcagcagaaatgactagtaaatgtgtgactaatttgcaagctctctagcaagcaaaaaaagtgcaaattaaaacaacagtataatatcatttttctccaaattactaatttttaaaaatcaggtaagtcctgattaatttacttatttcatagttttataatttcataagtaagtatttcatatttcatcatttaagtaaattaattaattaaaatgttgtttggtaaaatagagaatcagagcaaaaggaggtagtatatgaaggtatgtcaaacttgctaagcgttggtaacttcaatgcatcatacttctccattacaaggatgaatccagtccacagattagatttgtctatttgctacggcatcccctacccaggaaacatattagaaaatagttactctgtaattcaccttttcccaaactctttgaggactatagtctttctctttgctcttgttaggtcacccttctttatttattttcaaatcttggttaatggcctcaccatctaatttgtcaacctagctggatcctaagatatctttaacttcttcctgtaccttattcctctccctgacaagtagaaccttgggatgccaattcagatgtaatatccaggaaacttaaatggaccccaaatatggggcattatttgtggtggcattcgcaagggagtggtccaagaaacagtgaatcagagagctgggtaaatttccaaaaagtatcacatgagggggctagatgagtgacgttcataccatctgtgaaatgttgtaaaatacagatgcccaagcttctccacagacatgttcatcaaaaaatgcttccctcaaattcatcagtgacttccttaccactaaatccaatgggcatttttttaacctcatcttgactgaactctcagcagaatttgacactcggaggaaaagctctgctgggcttctttggcactatgctctgctgttcccttcttcctctctggccaaggcttccagtctccttttccggcttttacgctgtttagtcttcaaatgttgatgttccttgaagcttgctttttgtcttttcttgctccacaaactttctctgacaatatcatatcttcacttactgtatacatgccaaagacttctacaaatatatcttcagatttaatatgctcttctgagcatattaagtcaggttaataaatgctcgttgaattcacaaatgacaaacatttcaaaaatgcatagttactttctcttctacctcattttagattagtacattcttggtgacatggaaatcacccttatatcataatctatatctccaattctttatttctataatcagtaaatcgcacaccgagtttgaaaatcggtataaactttaatagaaagagtttctcttcaatgatctgtcttctttttgacttgcaaattagtcatctcacatattatttatcccattgtatttagtataataatttgcacatagagttcagtgaaaatgtattatatgtttgattttgtttattccttaatttccctagaggaggccaaagtaaaatttgaggtatttctatttggtataatctgatgtaattttgtatggattgatcccacataacaacatcttccaatttgtacctttttgctttggactgttcaactttgggctatattctctctggaaactaaaaataccacaagtgattgttgcagaaaaatagtatatggctttgacaagcataataactgaaatcaagcaattagagactgtcataactgcacagaaac

SEQ ID NO: 1382 - DNA, 823 bp, Homo sapiens
ggtatttctccctcccatgcacccagcactccccgcaccaccatcagggaccctgtgccattgctggaaggtctgacccttgggaagaatccagcacgaggtaggagtgaagaaaggagaatgtagaagacagttttattccctttgtgatcaagaggttaggtcgcttgtggcattctggatatggagaaagcaaccccaaagaaatactcgcagttcagtgctgatgtggccgaggccattgccttctttgactccatcattgcagagctggatacagagagacgaccccgggctgctgaggccagcctgccaaatgaagatgtggactttgacgtggccaccagctccagggagcacagcttgcattctaactggatcctgcgggcaccgcgcagacactccgaggatatcgctgcccacactgtgcatactgtagacggccagtttcgaaggagcaccgagcacaggaccgtgggcactcagaggagactcgagaggcaccccatttatttgcccaaggctgtggaaggggccttcaacacctggaaatttaagcccaaagcctgcaaaaaagacctggggagctccagacagatccttttcaacttctcaggagaagatatggagtgggatgcagagctctttgcgttggagccccagttgtctcctggggaggactactatgagacagagaaccccaaaggacagtggctgcttcgagaaagactttgggagcggacggtgccctgactccatctggattccttgacgtgtctcagactgggtccctgagaagctgtccgctttcagcgcagcatga

SEQ ID NO: 1383 - DNA, 1126 bp, Homo sapiens
tgaaaagagggtaatgtggagtgagtagcctccgtattgattaagaaggggacgggcttaccttccactgtgagagttacctgaagctcggcgtcagtgactgtctagggggcttccgaggtgatccggcagtgtcagtcttcagccgctaagccgagaagatctgggaaggagtcagtcagagaggcttgggccagagttccaggggctctgggagtggctgccaggtgagttgaacagtccgattttcagtggggtcccacacagatgggacgcggcttaggaggaatcccaggctgcgggcattccttggcccagtggccagatttctggcacgtgtagcaagctcctgtgggaggaggttctggaggaacgcctggccgctgcggttcaggcgtttggaagttcttgtgtgctggagacgtggctggggtttgtctcacagtggaggcaaggaattgcaacttttttctattatggtacaccttgaagaaagcaaccccaaagaaatactcgcagttcagtgctgatgtggccgaggccattgccttctttgactccatcattgcagagctggatacagagagacgaccccgggctgctgaggccagcctgccaaatgaagatgtggactttgacgtggccaccagctccagggagcacagcttgcattctaactggatcctgcgggcaccgcgcagacactccgaggatatcgctgcccacactgtgcatactgtagacggccagtttcgaaggagcaccgagcacaggaccgtgggcactcagaggagactcgagaggcaccccatttatttgcccaaggctgtggaaggggccttcaacacctggaaatttaagcccaaagcctgcaaaaaagacctggggagctccagacagatccttttcaacttctcaggagaagatatggagtgggatgcagagctctttgcgttggagccccagttgtctcctggggaggactactatgagacagagaaccccaaaggacagtggctgcttcgagaaagactttgggagcggacggtgccctgactccatctggattccttgacgtgtctcagactgggtccctgagaagctgtccgctttcagcgcagcatga

SEQ ID NO: 1384 - DNA, 1744 bp, Homo sapiens
acgccaccttgccttacaaagataccttcttggtatctttcatcaagttcataatcaggatattctggaaaaaaaggtagggtttcaatttagcatttggggtagggggactaagaaataagtctatggcaattattgcagaaagcaaatgatcatatgtctcaccaagcatttcagtgactttgactgttcctggtacctcagcaggctcaccaggtccaccagcattacaagctaggacgcggaacctgtattctgcaccctgagaatcagaggtggggagagtggtggaagggcctgtggacttacggatgctgctgcgacactctatgacctcagactgcaagtaagagccaatcccgaagcggtttgttgcagccacacggaacacatactcatttccttcgatgatagccaatgactctacttcctccatcactgattggctcattccattgtacttccatgctgtccctggaggacagtgtgacaactggagtgccaggaggaccaggaactttgaatggatattgggctacagtaggctctgaattgaggtggctgccatgagatagtcatgtgttcaggagtaacatccagaatattaataggacctgttggtggcccaggaacatcaagaacagtaagatgtacggctactgttttgctaccggctgcattggaaactgtgatttgatattccccagtgtctctccttaagcagttcttaatgagaatagacgccttgatggctcctctggcagttcttgatgaccatggatgagctaatggctgtggtctcaatggtggcttcttgaggagcatgcagagaaattgctttagcctctgataaataaaacagactgcgaggaaaattacagcgaggaaattacagacatcatctcctttgaacagggaaaaggtaacagctgattgagaaacttaccaaactgatatttggctgttattggagaggcctgaactggttcaccaacaccatacatgttttctgcagcaactctgaagatgtactctttattggggattaatttggtggccttgaagtttgtatccttgacggtggatgagagcttgtgccacacttcactatcagttgctcgtctctccacaacatagtttgtgatcttagatccaccatcatcgcgtggttctccacaggcaacccatttatcagaaccacgtggacatctttcaactatcctggacaacaaccatgttatttcttagccattggacttccaccttatctttattgagttctgctaaaaagacaacatcagcaccaggggcttcaagaatatcttgtggaggcctgatgatctcaacaggaatttctggaaagaaaatgtgaaataaatacaaatatgtttacattttgattaacaattttaaaaaattggtaacattagaattgttttttcacttaatatgtaccttccacaaaaagtctagcacgagacttcctgtcttctaccccgcaagcatattcacactcatcatccagcctgcaatcttttataatgagtctgtgtatacttccatctttttcaaatttgtatctaaaggagacattggattatcagttagcttgcaatgatggccactaaattgtcaaaagtgtatatatagctacagaaatagagaataaaaagatcttgcttactttttgccttctttgatttctctcccatttctgtaccattttacattggctttctctctg

SEQ ID NO: 1385 - DNA, 1624 bp, Homo sapiens
cggcgttgctaggaaacgggagtggggcctgcggggacgcggctggagcctgcgcatttcttccttcctgctttcaaagttgcaatgagcgcagagcggtgcgcccgagggggttgaagcgttgaaagtgtgttacccagattttatctgagttaaacacgggccggccgctgtggctcacgtctgtactcccagagccttgggaggtcgaggcgggaagatcgcttgagcccgggagctcgagaccagacgcggcaacatggcgagacgcacatctctgcctttaaaaatgagaggctggcggttacctttcttggggagacgcgtccgactgcttcattgtgggggcctcaggagcggaggatcgggtcccgcccgaggtgacgcgtaaacccagactctcagcaacgcgggtaggaaggacccttgaagttccgcggcgaccacgtcggctgaaaccagcagcccaggacaagtggaccagccagcaagacccagaccatccaaaccggctgatcctacgacaggacccagatgccagtgaaagtgaccacagccctgctctagtcaccccggaagctgaccagtctacgcacggccgaagcttcgtcaaggaagtaaatgtagttagaaatcttaagcccagtaattttccttgtcatcttaattgttttactattaacctgtcgctttgctcaaccccctcctctgggcaaacatctcttgtccatcctaggtacaaacatgctactcttccctttgttcttgctgctctcgctagatctatgtcagaaggagggatatgcggagagtttaatttaactaattgttgcctaaaaatcgatgacaatgaggaggacgtcatgaattaattgcgagaatgcgagacttagctcatgttccaacacaaacctggaaaccggaatggtctccaggttccccccgcccccccgtggttggttttcatccctcgggggatttaaaaccttactaggagtagttctggccatactgggagtccgcctcgtactcttgtctcttcccctccttgtcaagaatatcgacaaagccagagacgctcgtgtggacaggccgagtaccaccgagctcatcccataactacgtgtccacccctgccaggaaaagagctacttccccctgtagaagtaaataaaaaatagtgatgctttctattaaaccttatttataaaaagcatcaaggagggaataaagcggaaattgaagaaacggaaaatacctttttcgtataaagctgactcgccccaaagccagcaacaggcaaagcccccaggcaaggccttgaaaacaccatttaaaaagccagaaccccaaggaatgccgcccagacgcctcccagcactgcactccccccgtgcaaagataagaaccagactcctccttccgtttcccgctccccgtaaaatactctgccagttttgtaagctcctgttctttctcaatgcggccgcaagctcacaagctcggctgaggttacgaaacctgtcactgtacgattaactgcctctgtcctgcgtctgtaaattcactttcccgcactgcaagtttcacgccgctgcacgcttcaaagtcaagccctttgttc

SEQ ID NO: 1386 - DNA, 4385 bp, Homo sapiens
caggcaccccgatatccactgttgagtgcttacagcttgggcaggggccacctgctgaaatgctggtcctcgtccccactgcagggcccaggacaagctccgctgaggaagcggcagcctgagagtggccctgcggggacctggccagggctcagggttgttccggccctcgtggctgcggacggcaccccggtgtgggggctccaggcaggtgcctccacttagaactgccagaggctgagacaagctggggtggcccagggacagctgtttttgtttttgtttttgttttgttttgttttgtttgagatggagtttcactcttgttgcccaggttagaatgcaatggcgcgatcttggctcaccgcaacctccaccttccaggttcgagtgattctcctgcctcagcctcccgagtaactgggactacaggcatgcgccaccatgcctggctaatttttgtatttttagtagagacagggtttctccatgttggtcaggcgggtctcaaactcctgacctcaggtgatccacccgcctcggcctcccaaagtgctggaattatgggtgtaagccaccccgcctggcctccgacaggtggttttctgagcgtctcctgctggctggaaaatgccccgtaggctcgagggggctcagccctgtcacccctccagtggggaaggtgggggtccccaacggggggtagagggaggggctggaggcgcctcagaggctgcaccagggtggcagggtgagcccggtgctgggccaggcccgggctcagggggaacaggtctgtcacgataccaggggattgtggagagtagcgtggggaccggcccagcccagtaacggtcagcagagcccctgcccctctcccagggcctggaggctgtacctggccttgccttcggcggaaatcctgaggtctgagtcgctcttatgaagcaggcacttgtcggagacactctctatctgaacacagagccgggagcggcgggcagccccagggcgccatctaggaccagccttggcctcgacccacacagggagagggaggaggggagaggacaaggtgcagggagaagggtcccacgccacctccaaggcccaagtacaccaaggctggctgtgccttcgcccacctgctgggggaggccatccaccttctcccgcacccctcgcaggtgttcggtcacctccttccgccacctggccaggtcctccagggacttcctctctgcaccttcccattcggtctttgcctggggtacagatgcccagtgagggacaaagccaagagaggggggacagacagatggaaagacggacacggggagctctggggagcaggcggctgggatggcctggccgggcacgctctggagacacacatgccaaggcagggcctgggcagccgagggcccgtgggggctgttccgaccacacaggtgcccgagggaggcagggcaggccccggtgggacccagccccgaaacgcagggtgtcgcccacgtttgcagccgcgctcgcgtgtcggtggatgagcgggaaccggggggcggcgcctacgcaatgcacgttacgccgcggtggaaggggtgaagctctgcgcacgaggccccgaggagcgggaaacgggatgcccgtgggtgtcaccgccacagcggccgcaccgtgcgtggctctgtttcctggaaacgtccagaacaggcagcccccgagacagggaggggcccagcggtcgccaggggaagtggggatgggaatgagtgcggatggggctgaggttcttcctgaaggatgaatgctctgaaactgtgaatagacacacggaactgtgcacgttcacgggtgaaccgtgtggggagtgaatccatctcaacagagctgttacacagtgaacaagagcacgaggggtggaggccgcttgtctgccccgccgtgagctgcccgcatggccgggccgtgggccgaggctccagctcgggcctcacgggctgcagatgctgggccgaggctgctcagcggctgtcctgccccacacaggagtctctggggctcggggtctcccaggccctggggacagtcgctgggtgggacgggaggcttgggaccggcctgtcaggcctctaccctgggggcagtggtgggctgagagctggaggggtggggactccccatagccccgcctgcccccgcccgctgcctggcgcacctcggacagcctgaggcccagcatctgctcctgcagatcgagccggctgctcagagccgggagatggccactcagctcctttaactgcccggccagctgcgccacggatgcctccagagcccggctcttctctcggagctgcaggggacaggtgggcacggggaggcctggctgagcgcccatcccgtgtgcgtgggagaccccgttggggacatgttgcgctaccccctcaccagcaccagctctccatgcatctcctgccgggccagctcgccagccagctgtgcggcctccaggttctcctgcacataggcggccagctccccagcccggctttcctccaagcgccccttggcgtccctaggggttggggacacatagacaccctcagtggagcctgcccacctctcagccctgggccagggaggggagcttggctgctggctccagaacctcccaggagaccctgggatcggaagatggggtgcggtcacagtgccaccaacacgggttcactccccatggccaccaagatgggcgttcactccccacggccaccaagacaggggttccctccccatggccacagctgagtgccccagggagggcaggctgggtgagggacaggaggccccacaggagggaggagggttcgcaccatccagctgcagccctcggggtcgagcactctgctcgggggaggcaaggtcattccctgctgagtcggccactgcggccccctcctgagtgggacatcaggggtccccccgcctgacagcacctgaggccccaggacacccaccaggctttctcctcggccagtaggacacggttcagcgacgcctggttctgctgcacaaacttggtcagctgggccacggcagcatccaggccctggcactgctccaggaggtggctctcctgccagggggtggaggccgccctgagacctgcaccccggccccggccccacctgcccgccgcccgcccggccccacctcatgctgcccctgcagggcccgcaggcgctcctccatcagcccccgaagcttctcccaccggctctccagctcgccccgcaggctgccctccagcttcagccgtgagctctccgaggccttcattctctgtggggagaccccactgtcagctgcaggtctgcgtctgggaaggggggcagggcaggccagccgcgggcaggctcccaccttctccagggccaggaagctcttctgcaggaagccgcacagcttggcctccctcttcaggaagcgcaggctcacctcttcgccgagcttggtcacctgggcctggggcggaggcacattgtcccgtgtgcagcctctgctggacacgcagccggtccccctcctgcccatggtctccatcagagttggagtcccctgctgtccccaagccctgagcccggctgagctgggcctgccacaccctcagccggaagaaagccacggcgggcaggaccactctgtacccagacgaccaaccaggcatgggtttgtgaagcatgagaaggccacgctcaggtggggtccagacacacttggcacccaccaccgaggctgcccagggaaggccccccagccgccaccaggcccggcagggaagcaggagtgtcgtgcaggtgtccccatgcacggggagccaggtgggctgggcagagccttggggccttgtctccacaccaacagctgctttcctgccgccctgaaggggaggggaggggggaggcgcagccggccccatccctgcatctcatacacgcaaagggtaggcaggcggcacaggcccttcatcagccacggagaggcgcctcccgggaaacttcccctccacccaagcccctgctggcctcctgccccccaggaggtcaccttagagtagatatttttctgtaaaaagccagatggtacatgttcccacctcatgggatctctgttgtaaccctctcagcatggcggttacagcccccacagtagacattgacaacatgtaaaaaatgttcctgtgtgccaataaaactttatttacaaaaacaagcagtgactggcgcaatgactcactcccactttgggaggccgaggctggtggatcacctgaggtcagaggttcaagaccagcctggccaacatggtgaaaccctgtctct

SEQ ID NO: 1387 - DNA, 1464 bp, Homo sapiens
gtacatatatatatatatatatgaacgtattaataaattaggtgggaggaagtgacctcctccgcccaaataaaaatacttaaagggcacttgaatctggatctcagaaaatgaataatttcttagtataaacgtcctgtgcaccatttggttgggacaagtaagttcctcttcagaaactcaacttccaggtctaaagttgtcaatcaaccttacccccttcttctttcctcgcaggtggcgcgtttaccctattttaaaaaagttttaagttttagccaaccgggatcagcttagattgtgggcgtccaaccccagccaacagggaaaggacagaggaacagaagctcccttcctttgtcccgtgtgctctggagattgcatcccacgcaggcagcccccttccgtacaagtaaagtggtctcgctgagaaattttctaagtgctggtttctctttgcgggaccgactcgccgcccccaaatatcccatttggatcccattctgtttcaggagaggctggcggttacctttcttggggagacgcgtccgactgcttcattgtgggggcctcaggagcggaggatcgggtcccgcccgaggtgacgcgtaaacccagactctcagcaacgcgggtaggaaggacccttgaagttccgcggcgaccacggaactgtgccttcgatctccacagtcggctgaaaccagcagcccaggacaagtggaccagccagcaagacccagaccatccaaaccggctgatcctacgacaggacccagatgccagtgaaagtgaccacagccctgctctagtcaccccggaagctgaccagtctacgcacggccgaagcttcgtcaaggaagcctccacccctcgaattcccagttcaccgacaccagcctggggatcacctccttgtcagaagttggaaagaggaaaaactcagccaacctgggaaggactttatcgggtgctcctgaccaccaagatgacggtcggaaagggccccatccctggagggatcttggaccttcactccaggatcaacgccttccaaattaacattcaaaaaggtttaatctgtctcttccttctccctgtagccgcccaaggacgtcttattatcaatataaggtgatcaccctttccccagctagtttcgtttgatgcctgtctggttcatataccccgtaaagatatccacagccaaagacagcctcttctgaagaaaatccttggcccagcccttgtagtaaccggtaccctggggtgccattccctgttgaaattcgctcaggatggtggcagaaatattaaagggaaacattaggtaaagttagagaaaatagtcacaaaccggccgggcgtggtggctcacgcctgtcatcctagcacttcgggaggccgaggcaggaggatcacgaggtcaggagatcgagacaatcccggctaacatggtgaaac

SEQ ID NO: 1388 - DNA, 5015 bp, Homo sapiens
ctcttgctacctcgctcacccttggcacctcggccagtctccctactgctgggctctgggaggtgatgtgcagaagctcaagatggagcacaggcttccccagttctgctcacactgaacctgcacgctgtgggtgatggcctccttcacctcctccccacaggtcagcagcaagttcacgaggtccacgtagggtctaaagattgaaagcaaagagagagagagagagagagagagagagagagaggctgggaatggagcaagtcccgaatggaccacagagggcaggggcaatgctgggaaggaggcatggccagtgcttgtcttgggttcggtggaagatctctctcaaatgacttcaagccttttctcatagtctatggagtactggcctcaaccaacacttattgggtggccactgtgtcccaggctcacaggtgcatagggtaagagcttaggaccctaaaaggaagaccctctggggatggtgagaaatccaggtggctgcgtgaataatggcaggagagctctgggtgcctttaggctacactaactaggtgagtttcagctagagtggagatggctctggggtccagtggaatcataattaggcaaatggtgcagggccttacatagacttccaaacagaggattctttttggtagggaagaggaaaccatgaaggtttaggaccacgtgccctctatgagaagcccccaagaaaccattttccccatgtttgtgtttgccccgggtttaggcttctgatgaagaagggtgtttttggaagttattggatgcatttcctctgcatctggaggagtatggaagagctgaagtgggagggaggaagaccatgtccctgggacgtcattgcccgtgcatgcagtgattccctttctcagtagcagaggctggggagtaggtgtggccatctgagcatctttattctttcagtctgggcttccttagatttggagttgaaggctggcggtcaggggcccctgtgtctggactgagagacagctcactgtgcaatgaactcgcctagttctggagggcagagccagttcctcaggccattccggttgtcttgggttgttctgtaggaaaaccactggaataatttactccagggggtggacaaggtgtgcagaaggcaggagcatctgctttttatatttatgggcccatctggtaaagagtgtccccagcaatgggctctcatgggccactcactgagcttttattttaacctctcactggcctttaaaaccccccaaggggggtatagaatgtttcacatggctaaccagcattcctaggcagtcctcgctggcaaagtttctgatctatctgaccacaagcattgcagctttgggccatcaccttgagcagggaagtcaccatggaatgtgaggtcattcataacaaggagcaatctgatttgtcctccctaagtctgggccaccagagaggctgcgttacagcccatggagccttttctttgcaagttggcagttgttgctatgtggaaagagcagactgtgttttgagatgtgtgaagtagtttactgcctttttattaattattcctcaagttggaattgagtgaactgtcctcacctcatggatgcaaaaactgagaaaagcagggagaaggtggctcttggaagcttctgggcttcagggcccagggcttggctgagagcagagcagagaggaggaatgctctggctgagagagatccagctgctgtttagggcctgcttgatgactttggagtcagcaagtctgtgcatggccgctgggcaaagggctttaaaccccctaaggcaggcccctgacagcgcaagacaacctaaccctgtcccttggactgccctgaggtgggcaggtgggcatgcaggaggcaatatgagggaaatgctccacgcgtgcttgtttccttctattttttgaaaactagaaactgcctccggagctcaagttcaccgagtgtgtctgctaaagcagcaacaggattttagcacctgactgtgcctgccgcggcaccagggctaggtgagcacactgcaggggtgagggtctgtctttctgagatactaactggatgctgtcttcaagctcctttccccagagtaaggggagggctgtcttgggaatatgcagactgtctttcgccttcccggccagggcgttctgtctgccagatgagcccccagaagcccagggcggatctggatcccagaaggctggatgagcccatgctgtcctctgcccttggccctctctctctccaggaggaagctgtgaactgcggggaggggtgtgtgtgccgaaccaagttaatccaagccgtgttccgagctggcctggtgccttctgaggctgcaagctcagcccgtgtctaatgacaaagtccagctcgttcaactgggtgtcagcaagcctaaaggattttaaaaaatacttggagggggatgtgcctggagcctgccagcacccagtgacatggcgagtgggggtaaaaccaggcaggcggcagctagggggagacagatgctgtgcagaaagtggggcgggcaggaaggggtgaggggagcggagaggaagagcttgaaaagagcagcattaactgggggtgagtgttctggtgtggatgggggttgggttgaagaatgggggtggtgcagattctggggtgactgtgatttcctcatctctaaagtgaaaagcaaattcagttctctctttttttttttttttgaccaatgccacacatttggaaatgggcttcttgatatttggggactgataggatactttaatcagttaagatggttgggaaaaaaaaacctaaaaaacaggcagttcagctagaagtacaagtcgatgcaccgccacatcatggcttcagaaggaaaggtaatgggggtttttgggaagctggagttaggggagacccctgcctagagatgctgacttagggggaagcaagaggaacagcatgtgaccaggcttcttatatgggctgcctgcatttccagagcaggctggggtggggggtcataggctcattctgaatggtgtgaggagaccatggccccgagggccacattcccaagaaggagacactagaacgccagagagctttaccttcttcttaaattaaggggagggggtgggacttccaaccttcagttttcccaaagaatacttttctccaagaaagatagaattcctgtgctccaggcatgcattatagccttataaactaggaatgggccccattccccaccgattcctgaggccagcaaactctctctaatgggggacagggctagaggcgagtgaagctcacggtgtttcctagccatggggcatttttctcttccagaggcacctgaaggaagggaattttagagtgttctccttgtgtaatggggatatatttgataaaaggacaagaagcccaccacatgtggggagctgtgagccctttcaggtctaggagggagataataggctgggagcaggtttgaagtctattcctgatgactggcttcagtcatgtataccagcaattccgaagcttaaaagcaggaatcaaacctcagtccgagttctctaatctcttagcttcactttcctcctcttgggcatagtaatttctatcttgtagcatctttgggaaagataaatgagataacccatgtaaaggccctggccaagggcctagaccattagaaaaaaaattaaaaaaacataaaaaaagacagctatcattgttgttgatgatgctgtggctgctattgttcccttaaaaatatttgaagaataaaaaatattttgtaaggcgttagcctaattcgaggaaaatgcaatattgttttgcttttggcaagagcttcctgcagagtttcgccatgaattgtatgattctaacactgtagcaagggtgttgcaagatgcctatgaccttataaccaagtggaaagagacaggaggtgcttgctgttctctgtcatctaagtggtgttggtgtggtagggacataactggaagaaggttgtggcacaaactgaggatcaagagttcataaaattataccgatttggctcaatgagtcaccgtggagagaccaacagtgccatcaaactggtaatgacttgtactgaactggttggctagtggctttctttctgccctgtgtctcttaggaaagagccattgtcaatatttaaaaaaaaaatcttcaggggctcctggccctgcctcatgttaggaacaattgtgtaccaacatgctttaccatgctgcaaaatttaggatcctgtggctgaaatattttgtaagaaatgatgcatcctgaatttatcattgaatttcaagtcttgaaataagtaagttcacatttccttgttttggcatagaagtgtttagctgattaaagtttttggcacttgttttgcatttcctctgagagggcactaatgtatgagagaaggtaaaccgaaccttctaagggaaaggaaagttaaggaggcaggaaaagcatctatagctctgttttcgggatttaagagtataggttctggaggcagactgctcagcagactggagccaggtcccaagtctggctttgcctgtcactagctgtgtgagctctgccttagtgagtctcagttttctcatctgtcaaatggaggtgacgagggctgtggtgaggatcaagtgaaaaattcacaaggagcccttagcccagtgcctggcgcttagtaaatattcaacaaatgttattagcaatttgctgtctgtaaggacacctctacagctactcagaatattctgagagctagtgggttcttggctaaggggaagatgaagagtattactgaatcgacacatttcattcttagtaaaacgatttcccatttctgttgcttgtgattttgagactgatgagggaattctctcttttcctaaaagccagcaggaaaggggccttttag

SEQ ID NO: 1389 - DNA, 1099 bp, Homo sapiens
ggcgcggattccagctgctttccaagttggaggcgcctagtgagggtcagggaggcccggcccgcgccctccccgcccagccgcctccccgtcgaccacccagggctggggcgagccaggctgcctttcgaacttgggggcttctcctcttgtctcccactggtgctctggccgtgaatccatccaggcgccaggagatgacaatccggtaccaaggccggcagtacaggctgaggatggcatttctccaaaaggtttccaagctgcgtcctgggcctggagactgagacagagatccacggactgcagtgcaggcagcccaccccagatccgagtcatataaggttgaaatatcagtaaaaaacatgcagacccaaagatggggaccaaaatccaaagccagagggtcctggaaatcagagggtcttacaacataacaggcagtacaggccatggctcaggctaggcgtggaacagactgcagttctcttctacaaatcaatctagactggacagacagaactccaagggaggaaagaaaaatgaatctgatgttacttcttgaaaccacattttctgaagtcaccatttttatgtccagtcacatcttctatgcctatctcagctgctgacacgtgactcagctgctcccattttccttggaaaagtaggagctggaaaggacctcagtcagaggtcatccacatcaaccatctcatttcactgatgaggaaactgagacttggaccaggggaagtcagctgccatgttgtgaggacactcaagcaatcctatggagaggcccatgtgatgaggaactgaagcctcctgccaacagccatgtgagggcaccatcttggaagcagatccgccaacttcacccaagccttcagatgaatatagccctgaccgacatcttcactacaatctcatgagagaacctgcgccagcactacctagctatgatgctgcaaaattcctgacccatagaaactgtgagataataaatgcctgttgtgttaagccacaagttttgtggaaatttgttactcagcaataactaacatgagagttagctgaaggtcacattcttgttgag

SEQ ID NO: 1390 - DNA, 1099 bp, Homo sapiens; identical to SEQ ID NO: 1389

SEQ ID NO: 1391 - DNA, 7282 bp, Homo sapiens
gtaacaggaatttcacatttgtgtacaattttattgagaagaggaaggaaaaaaggcataaagtgatctgaaggcgaaacttcttccatcgcatttgagagaactcaggaaaagagccggctaacggtattacggaagtactagttggcacagaggctcggtgcaattaccgttctgcaccgtaaaacgggtttaggaagttcctaggagatactagcggtgccagaaccgagaaagtgacgacacagacaacttatggactccgcgtacgggaaacgttccgttgggcgctaagaacggtgcagcaactgaaaaaccgctcagtgggcgctactggcaaaagcgttgctgcaaaaccgccagctccgcattagaagcagagccgccagacagaacccgggacctgaaaccaccgaagcggagaccgagcttggctccccagctcctgagagaatgcaagtcaaggagtacgaagctgtgatactcaaaattagtagaagaaaaatgaataacatttaaataagataaaattttaaaataataaattctaaaattcaaataaaaaggcaaagcaaacacactggaaactaccggtagcattgttctcagagcaaaagacacaaaaagagcatttaaaaataagcaaaaattagagagaaccaaccctacaaagcagaaattacaagtattgccaaaagaagcaattctgtgattaggatatccctgttagatctaaaccggtacatgttacacctaagtctacatttcttaggacaaaaacaaaaacaaacaacaacaacaacaagaaaccaacaaaacccagtcatggttaaacctgtttacgactaaaaaatcgtagtagctgatatatcccgacttggtccacaagaggaaaaagtcgcgttcggcggaaattgctatcgtcaaaccgagcttcgtaaaccagaaatcgcttttgccggcatttcctgacttccatgggagtttaaaaaacaccaacatagctaaggcgggacttgatgttgcgcagctagccttggtgtaagagctcccaggcactgctaaactggtcatcgctaaacctaaatgaatcgcattcgctggtacacagatttctacaggagttgaacatctcctgcgcagctaaagcaagccgtactagtaggaagccggaacttgccacgacttagaaacttgaggctttgggaggccaaggcgggtggatcatctgaggtcgggagtttgagaccagtctggctaatgtggcaaaaccccgtctctactaaaaatacaaaaattagccgggtgtggtggcgggcgcctataatcccagctatttgggaggctgaggcaggagaatcacttgaacccgggaggtggaggttgcagtgagccgagatcgccgagatggcgccactgcattctagcctggacgaaagaaactctgtctcaaaaaaaaaaaaaaaaaaaaaaaaaaaaagaaaaagaaaaaagaaacttgaggcagggctaactctgcgtttgttatgattaggctacaggaaacccggagttgctgggaaatgagtcacagggtcactcagcctttctgtggcgaaacatcgacttcctacgacctagaaatcgccgccagggctaggctggtgtttgtcctaagtgggtacttgcttgggttgagaaatcacattttggctattccccgacttgaaccaggggatagaaatcgtagtcaccggctgggcgcagcggctcatgctgtaatcctggcagtttgggaggccgaggcgggcagattattgaggttaggagttcgagaccagcctggtcaatatgatgaaacaccgcctctagtaaaaatacaaaaattatccgggcgtggtggcgagcgcctgtaatcccagctactcaggaggctgaggcagtagaatcccttgaacctggggtgcggaggttgcagtgagccaagatcgcgccactgcactccaggctgggcgacacggcgagactctgtctcaaaacaaaacaaaaggaaaagaagagaaaagaaaaagaaacgcaggcaccctgaaatcgaaacttgttaggaccaacaagccaacgacagacgaatctgcggggtcctgcgacagacacgccagccccgccgccacagcacagggttctggaggtcgagctgttctgcgggttctgcggcggcgctgggaagagacggcgcccgggcagctcccctgtcaccggcttggaggagcggcgggctcccctagcccagcgccgccgccgccgcccgggaacgccaggctcaccccagctggggaagctccgaatccctcagatcggcgacctgagtgctgtcgccccgagaaaatggaggcatcgagcaacgagctgtgctgagaccgagagacctcagttctgcgaaatgtcggtgcctggagcttgcgaatgactgcggccggcgggttgtcaaggacaacattccttatggcgcaaccaacagcgctgtcaccaagaaactggactctgagaaaaaagagggtttcggccaccgagaaactccgtgccacatgtgccgtgacagcaaaaccgcccgctccgcgccgctggtgaaagagctaacgaacgccaggtgctgcgacagtgacaccgggactagaaggcctcggatggagaatgggacgcccagagcaagcaggaaaacgttttgtttggctcaactagcgctgtcgcaaccggaaaactgtcaggccagtgctgctgcggatgtgagaaaccggtgatccgaaggcggagtggcgctgggcgctggactcgctggtgtgaaaatctggctgctctaggacccggcaagcgcgggcaccaggcgaacgccagcgactttgccagacaaatgcatgtcttttttggtcgccattcaaagatgcagccggcagtcagccccggctctgagaaacaagtggaggtgtcagccataaaccctccgttcagggaaaagagagtcgctgcgacggatcgactggccgttgggtggaactttctttggtggcctagtgactagaaaataaaaacgaaaacgaaataaaaaactgctactgacattactcccacgctccctcctcaagtcagtggcttcaggcttaagaaaacctgtatttttcttggctgatccgtgatccctaattactgagggccccgcgacccaccaagtgcgattcgcagagggaaaggagctggaataaggatccagaatgggacggatttggctcctccaggaagaaagcaaaacaaatgcaggtcgcgaacactttacattgcaggaagctgctcttccagtggccgcggctgggtccttccacaccacctctctgtcctaggccttcgtcccggttcagccctcacggattctaggctagcggtcaacaaccgcatccctccggaacctggaaactctaggtccgagatctcggtgaagaatgaaaggcacagcgccgctcaacccaggcttcaggcctgccccgctggtcccgtcccttccctgtgggatggaactctgtgggaatcgctccttattctgatggttcactcattcagatgtccttgatatttggggatatttctaaaacagctggggagaaaaatggactgcgaggctccggtgttggacgtgaaattggcagtgagacatccgcctctaagcccagggaaaagcttaaattgtggttctctgtctctagcaccgtgatctttgaaatgcgttattgattttcttctttcttctgggaaatgcaatgcaggtgaacttgtaagtgttgaatcctccctctcctcactgttcaatcagactgaggcctacttcctttctgataagaaatatggaactgccattgctcagtaggaaaatgtcctttctacaagcattcatatttcaataaaaatctgcactttgtgagttgagccccctcaaagagacctacagaccctgccatgagcatctccatccacactcatcatttcccattttcaccacttctgctcctgtgcaaaccagtactatccttttctgggggatcctaggcagaagcgatggcaggacaaaggcagagaaggcactgccaggtcctgcatgccagtaaaactactcatgtcagctgttctgcaggatcccatgagaaggtgagtcaccagaaaatgcagtttccacatcctgatgatttcatctccctaccccaactgatcaatttctccaattttccagcctctcaccctccacaatccccttaaaaactgtagcccagaactctctggaatgatgaatttgaaggtttgctcctgtctcctcactcagaagcctgtaatcattaaactctttctctgatgcaaactctgctgtctcagtgtaattggtatgtaagtgtgcagcaggcatatgaatctgttggtcctgtaacagttgggatgcagtggcacaattgtagctcactgtaatctctacctcctacacctaagggaaccttaccacctcagcactcggaatagctaggactttaggtctgtgtgctaccacccatggctaatttataaaataatttctttgtagagacaggatctttctatatagcctgggctggtctcaaactcctggcctcaaggtatcctccccactctgcatcacaaagagctgtcattacatgtgtgagataccataccctgcccatggtagaatattaacacatgggtgtgaaatgttggcttcagtctggcatgttattactttattaacagtaaagaataatatctgatcatgaaattgtttttttttgtaaatagaatattttctatttacattgatgcttttgtaaatagaatatttgactctgatgaagacatattataatttcactatggatatgacctgaaatggaaaaaattgacttacagaaaaaatacaccaaagaagtcaccattttatatttgttcttattacaattatctttcaagccataaaaaacaaaaattagtgattttattaccaactgagaagattattttctgccaagcaatctctaaacattaacttttactaggaatgtattcatgaaagggactttgtaaaataggagcaaatttgacctcttatttaatcattcagagatgaaataaaatataatacattatttgaaaagatatccaggaagcaggaagtacagtcagggatcccaggaatgggtgtggtgatgtctgttgcaccagggcttagagggcaggatctttcctctagaaactctgtgtgtcaggcatgcctagacaaaatacacttatatttgatgttttagcatatcaaagaggtattgcttggtttaaagatgaggctcagtgagtttacaccacagtccaagatcacaaaggtagttcatgctggagctggattgaagtcccaggttatcaggcattcatatcaagtagggaaatgagtaaagaaataattaggttgggttttgaaaaagaagaatcctatgccttacataaaattgtaccttaaaaatttttttggctgggcgtggtggctcttgcctgtaatcccagcactttgggaggccgaggcaggcggattacaaggtcaggagatcgagaccatcctggctaacacggtgaaaccccgtctctactaaaaatacaaaaaattatccggtgcggtggtgggcgcctgtagtcccagctactccggaggctgaggcaggagaatggcgtgaacccgggaggcggagtttgcagcgagcggagatcgcgccattgcactccagcctgggcgacagaccgagactccatctcaaaaaacataaaaataaaaaaaagggcaaatatgttgagctaatatgatgctttttacagtattttttttcaagacccttatatgttatgtgattatatgcatttttttaagttattctccttcctctgttattcctacttccactgcaattcctctcatcagtaactaccagttttaacattacattatccaaaaaagaggtggatggagtctcggctgcatatgctaatgttgcaccttggacgagtgatgtaatgccttttgccattttgcatttccaaatatattctcaaatgtattcctaacagtggtgtttgctacacaatgaaataatagaaataaaatataatacattatttgaaaagatatccaggaattattttaacatttttcctttaaattaatttctgaatggaaatgacagtcatgaaaccattcctataaactttataaagttaatcagggaaaatgggagaaggagaataaaaaatatatcaagactgcagtacattcagcattaatgattaggtcaccttgctctctggccttcttgctcatagttctttggtgcttattgccccaaactatgagaataattatgcagaataattataccctgtcagaattatgcagacccaatcacaagattatagtttcccttaactgctctgtagagaacacctttaacattgtaaaatgtcaaggttttcatttgatatattctcttatgtcctgaagactgataaaactattgatgccagctagtctgaaagaccccatgaggagctggctcaccgaagaatgcagtttctatattttgatgatttcatcccctttaccccaaacaatcaatgaccccaatttttcagtttcttgctctccacaatctccttaaaaactccagagctgggcggggcacggtggctcactcctgtaatcccaggactttgggaggctgaggtgggcagatcaccaggtcaggagtacgagaccactgaaaccccatctctactaaaaatacaaaaattagtcgggtgtggtggtgcacacatgtaatcctagctattcaggaggctgaagcaggagaaggctaaggcaggagaatcgcctgaacccgggaggcagaggttgcagtgggctgagatcacaccactgcactccagcctgggtgatggagcaagattctgttaaaaacaaaacaaaacaaaacaaaaacaaacacctccagaccagaatttctcagggaggtggatttgagggtccctcctgtttcctcacctggctgccctgctatcattacattctttttctgctgtaagccctgctgtttcagtgttttggtatatatttatgttactgcacagcagatatccaaacctgttggtcctgtaacgatcaggcacatcttttgtattggtttgtcttgtgtttttttttttttttttttttttccag

SEQ ID NO: 1392 - DNA, 7282 bp, Homo sapiens; identical to SEQ ID NO: 1391

SEQ ID NO: 1393 - DNA, 21099 bp, Homo sapiens
cgtgttagccaggatggtctcgatctcctgacctcctgatccgcccgcctcggcctcccaaagtgctgggattacaggcgtgagccaccgcgcccggccggtactccgaagccctcagatcggcgacctgggcgctgtaggcaccgagaaaatacaggcaccgagccagaagcagtgccgcaaccaagagacctcggcttggcgaaatggcggcgtctggagcctgcgagtgacgccagctggtggggctgtcaaggagaacattcgttacggcgcaaccaacggtactgtcaccaagaaaccgtcgtctctgagaaaaaaagagacgttcggccgccgagaaactccgtacaagtgctgtgacagaaaaaccgccggctccgcgcagcggcaaaagagccaacgggaacgccgggtgctgcgaccatgaccccggcactggaggacgtgggatggagaatgggacacacggagcgagaagggaaacgtttcgtgcagaccaactagcgccgccgccaccggaaaactgactcgccagtgctgccaatgaagtgcgtgtgagaaaccgatgactggtgggaggagcagcgctgggcgctggacccgcgagtgtgagaatctggcggcgctaggacccttcaggcgcgggcacgaggcgaaacccagcgctgttgccaaagacaaatgcgcgttcttttgggcgccatcagcggtgcagccagtgatcactcccaggctctgagaaactagagatgtcagccacaaaccctccgttcagggaaagtttgcggcgccgtgacggatcgactggcactgggtgcaacattgtcttgtggcctagagactagaatataaaaacaaaaaccaaatacaaaactgctgctggcattactcctactctcccccctcaagtcagtggcttcaggcttaagaaaacctgtatttttcttggctgtgccataatccgtaattaccgaggcccccagcgacccacccagtgtgattcgcagagggaaaggagctggaataaggaccgtgaatggggcggatgtggctcgtcctgggagagagctaaagcttatgctggtcgcaaacagcattacattgcaggaaactgctcttccaatggccgtggctgggtccttccacaccatccctctgccctagacctttgtccccgttcagagccatcagagattctaggagagctgtcgacaaccgcatctcttcggaacttggaaactctaggttcaagatctccgtggagaatgaaaggcacagtcgcctgacccgggcatcaggcttgccccgcacatcaagtccctcccctactggatggaactctgtggcaatcgctccttattctgatggttcactctgtcagatatcctcgatatttggggatagtagttcaaaaacagccggggaggaaaatgggctgaaagattccagcgttggatgtagaattgacagcgagacatacacctcctctctaagcccagagaaaagctcaagttgtggttctctgtctctagcagcatgatcttcaaaatgcatcattgatttctatcttctgggaaatgcaatgcaggtgaacttgtaagtgctcaaatcctccatctcctcacttttcagactgaggcctttttttttttaaatctgagaagaaatatgggactgccactgctcagtaggaaaatgtcctttcccacaagcatttatattttaataaaaatctgcactttgtgagttgagccccctcaaagagacctacaaaccctgccacaaatatctccaaccacactcatcatttccgattttcatcactgctgctcctgtgcaaaccaaactatcctttccctggggcatcctaggtagaggccatgccaggacaaaggcagagatatgcctgcctggtaaggaaatccattttggccttgtaattctcaccctctcccaagatgtttgcctcaatatctccttcccaccttaccccgtcttcagctagccaaaacattccctggtatttgaggcccttccaatttcctcctggttttgtgggtgggagaataaagaaaaaactgcactgttcccacccacatagttacagccactttatcaaacggaagagcagtctggagccattgcaaaacaaaatacctgccacaactcctctcttctcatttcgactccagcttttcatcttagcaaaaaagttgcaatcagcaccccctagacggaaggaatatcctgtcttaatgggagtccataggaggctgcaggctgctcccctacagagactaacatcaaggtagttgcagaattcagattctaattacagtgtggttggaggcggggtggattccagggaggtcaggaagaggtaaagtacagaattgagctccttgggaggaggtcataggaactttgcagtatgaaaatggctagagattgggtagaattgagcaggctggcaatggcagttttgtgtgggtggtaggacctaggattcaaacttgagggcaaattgtggagcacatacgacaaatgatgtagagcctttcctatttcccttcctgctgtgtcatccgaaacaataaataataaagaattaacaaagactgatatttttgttcaatttcatgaagaaaaatctcatcaaactaagataactataatgacaaatcttgttagaatattattaaccaaatgaaagtgacacaaaacagaaaaacggtgggaggtgggagggccaagaaagaaaaagtccccaacactcaggtggtgtgtacaggtgaatcttctggtcagttggtatgttgcagaaagctgggcaactaataaattaggaggcaggaattcatatgaatactttcctgatacagagaaactcttggttttaacaatctacttctttgtcaggtattggttcttgattttaggctcagaaaagatggtaacagttataactgtagtagagcaggtaaaaacaaagatcatgcaggagtctagacagaaagtaaaaggcaaaaatgtcccagggtaagtaatctagagtaagaaagtgaagaattctgcttggtgccaacggagggctccaccatgcctctggttcacctacaaaaaatgaaccatttgctgttggtctctgggattgaagattcaccctcccaatttcctgcctgtcctaagcttacctgtaacttagagggttttgtgtctgtttttttgtttgttttgtctgtttgttttgtaaaacactctctacaaatgtttgatagattataaaccgcaggatccactagaccctgcaaggtgcaggggagccctgtgactaccactccaatgcacctccacacatgttcttcctcctagttcctccacagaatttcttcttcctggttccatttgctgtagtaatttggggctgtattcactgacaagttccaaaagtttacccaattttggtgaccgataaactcttgactaacaattatgtgtgtgtgtttgtctttcctgtaggaggaaatcagtggtgcttcaggatattgtgaatttggtcttctgaaagcagaattctgatttaacagtataatggaattcgtgaacgtcatgatgctaatttgaaccaacaagcacccttgtgagaggaatctgcttttcctcaagtctgaagaacaccaggagaatctttctgtatggagttaccaggaatcctctgctaaggaaagtgaaagggaagatgcaatttctcctgggaaggggggatgctgatgtagagggtgacaagtaatatgccatgaaggattcagtcacctggttagatttagagttagagttatggttaaggaagaaggaaggaaaaaaggcagaagaggaagaaaggaagcaagaaaagataaaatttattctaagataaaatttgtgaattttgctaaactatatatatttatttatttatttattttatttatttatttatttttgctgtcattagccaagataaggaatcttcaagttgagtaagactggatttagaattgtctgggggctttcaaaagagccattcagtaaataagaaagaatacaggcctgcagcaccagagtctgagctgggggcataggtttgtgtgaatttgggcatggtggctcaggtctgtaatcccagcactttgggaggctgaagttgaggactgcttgagctcaggagtctgagaccaccctgggcaacatggggagaccccatctctacaaaaaaataaaaaatattaacccaaggtggtggcatgcaccttgctgccagctactgtggaggctgaggtgagaggattgtttaagtccaggatgttgagactgcagtgagccctgtttgtggcactgcactcctgcctggtccacagagggagactctgtctgaaggtggggaaagaaaagatttgtatgaatttggtgctgctttgtatttcaaaataggaaagtggatatacgaatatatggcataaaaggtccagatactggaccccagtgaactcaattgttttcaaggtctgactttaaccttgctaggctgaagaatctggaatggctcagatgtttctagttcagctgtaacttttgcctcctttagagtaaagctgtgggggacttgagtatactcagagtggatctgagaggtatctgcttccagaatgaattagaattcctggatttgaatcataatcagatggctgttaaggggttattgaagacatatggctcttaagttcacaatattgaattcaggtgaatattataaatatttgtaagttggattatattattgaagcacttggtaaaaattgccatgcagggataaatgtaggaaggggattgcagagtctgatatctaaaaaataagtggagcagcatttggaaaccccgttcacattttcaatctcttttctctcattagaacctaactgctatcctctaatccctacttttgaaaaaatgtatttaaggctgggcgtggtggctcacgcctgtaatcccagcactttggaaggccgaagtgggtggatcacgaggtcaggagatcgagaccatcctggctaacatggtgaaaccccatctctactaaaaatacaaaaaattagccgggcgttgtggtgggcacctgtagtcctagctactcgggaggctgaggcaggagaatggcgtgaacccaggaggcagagcttgtagtgagctgagatcgcgccactgcactccagcctgggcgacagagcgagactccgtctcagaaaaaaaaaaaaagaaaaaatgtatttaaaaactcagcaaacattaatggagatattccaagagccaggctcctggttccaagaccccactcagaggactaagctcaaatctaataagatgtgtaggcttggggccagtggggcgaggggatatccacaggagggccaatcgaacaaggcctcagactcatgagcctcaaatgtagatgttagatttttcctccaattgagattatacatacagccacagagcttcatggatgcaaatgaaaatggtcatgtctcaacttttaaactgtgctcaattagaggaactcattgcctatggcatagtgtcatgtaataaaatggtttttttgttgtctaatcttgtagttagtacagtgatagtacattgggtttttgtgttaaaagaagtcatttgttatcccagcactttgggaggccgaggcaggcagatcacctgaggtcaggagttcaagaccagcctgaccaacatgatgagaccccatctctactgaattagccaggcatggtggcgcatgcctgtaatcccagttactcgggaggctcaggcaggagaatcgcttgaatcgggaggcagcgattgccgtgagccaaaattgcgccactgcagtccagcttgggcaacaagagcaaaactctgtctcaaaaaaaaaaaaaaaaaaaaaaggctgggcgcggtggctcacgcctgtaatcccagcactttgggaggccgaggcgagcagatcacaaggtcaggagatcgagaccatcctggccaacacggtgaaaccccatctctattaaaaatgcaaaaaaattagccgggcatgttggcgggcgcctgtagtcccagctacttgggaggctgaggcaggagaaaggtgtgaacctgggaggcggaggttgcagtgagctgagatcccgccactgcaccccagcctgggcaacagagcaagactccatctcccccacccaaaaaaacatctttaaaatttagcttttaaaacacatttagttattattttactgtgtttattcttcgtggttaggcacatttatgcctttttgtttcctcccttgagttgtgggcctggactcctaaaacctccatttctaaatttgccttaccaacagggtcacaatggtaggcaggcttagtgggacatgaggcaataaaaagatgaacagtcattctggttatggcttggcagtgggatggcagcacattagcttggctctcacggtgtgggctgctttggtttcttttcctaactgaactctgacaggtagagtcctcatgtccaggaataattccagaaaacaataaaaaaaaaaaattggttttcagaccaggacacaaacataaccatagtagatgagggctcactcatttactaaacttgaatgtggttattacttcattgctattgtaaaccaaaaataaaatttgaagccccctgccaccaacatctgaatggacccctcttctccgccaagggcattccaaagttagactgaaaaagtagtttcaagccatgctgggaagggggagtcagacatgcctcattatattctcctctcttttaaaattattgatagaacagactctttaagtctggttagaaacatttacaatctatctctctgaagtcttccacctggaggcttcatctgcgacacctttgtctctggaacaccttatggcaacccaggcattcctttctagagataatagttattgcaacaaattgccaatcataaaatttttgaacctctccaacttgaaagatcatgcttccagttgtactgcctttctggactgaaccaatgtacaacaccttaaatgtattgatctcatgacttcctaaaatatatataaaccaagttgtgcactgaccacctgaagcacatgttctcaggatctcctgatggctgtttcatgggctaatggtcactcacatttggttcacaataaatctcatcaactattttacagaatttgaccctgtgtctgctggacctcccagaagagcagcagcacatgtgctgatttctttgggtttcaaaattgacaacagtcaatggaaaactggattccaaattctaccagagaatactgtgccaggtgctttcagtgggacccttgctgtctctgggatttcaagtgctattacaatggtctcccccagggcacattaaaggactggtgagatccctaactggcatggctccagaagtgatgtggaagttaggaaactcaggcagtcattgatttcccagccccactgacgcttttcctctatctcctggctgagaaaagaagaccaggaagagccgtgagggacttccagggtggcatgtggctgtctccagcacacgtacataacctggattatatctgtaacaagctatgctgatggatcagcaggttaacccaagctgaaaaaagcagtcaagcacttcctttggtgtgtgaggcagaaaccaggacatctgctggtccaccaggggacaaaaatcaatcctatttcaccaatgtgtctcctccgtgtggggagtatagggcattgaaggtggatgagaatcaccatccaccttctgctgcacaggaaagacaagggaagactccagggaagacagaggaggaaaacgtcgagcagccccaggtggatgtgtctgtgtgtgtgtgtgtgtgtgtgtgtgtgtgtgtgtgtgtaccttgacagtgggtagaggaagggagaggagggttgaggtcttcccactagaggagtgaaatgagcagaactgagaaaagaggtcagagaaaagaaagaggaacctacaagccaccacagaattttctttccccagagaatggtctcttgcccgactaggggctgggtatccttgtgaagtcaccggaggttttcaaggggtgggcttcctggcttcagtagactcaaggtccctaaggtccagttaggataggcgcctgggagggctcccgagttggaataagagtcggaagaactgacagggctgggggcgcactaagcacactctactcctgagaggtgagggtggggatgttggagggaaaaagggctgctttttcctgcctgcaggcttcagattcacaggggatgtgaggagagggcggaggaggaggaagcagcggctgtttatgctgggaagatggctcagttgagaagtgaggcagatgtggcctcagagggtctggcggatggctgccgggatcaccgggggctggactttgagatgtccaggacgaagtgttgccctttcagtgctgccctccctgtgtctgctggaactgttggagccgcagtgcagcctaattttgacttcaggtaaaataattcaatatactgaggcccagggggaacaaagcaaggtctactccatatctctgaacagctggtgtctttcagtgcctaaactcaatcagaatcctgggagcaaaagtagctctccagtgcagtccatgcaggttacttcttgcaacatagaggtgactgaagcatggtaagcagatctagaaaggcaaacatctctagcagatctagagaggctagccaatgttagctagcagtgtctttatgttgataaacctattcagaatgttaactttgtttgttggtttgtttgtccatttttgtctcccaggctggagtgcagtggtgcgatctcggctcactgcaacctccagtaattctcccgcctcagtctttccagcagctgggattacaggctccccatcgccacacccagaattttttgtagagacggggtttcgccatgttgcccgggctgctctcaaactcccgatttcttagtctgaccaagtcagggtttagctatttcttagcgtagcaagttgagatttattccagtttcgatttctagttgtaacaatgctggctttaaccgtgcctacgtagtcgttgcaagttcctgttttgtaataggaacccccattatagccgttcgtacggtttttaagtcttgtagaaatctgggtactggagaatgtaattaaaaaaaaaatttagcagtgcctgaaatcttttagtcataccaagtgtgatttcacaatagagattctcgccctggctgtgcttgtgatttttcactcatgcagaagttgaggtgtctaggctacaggaactttttggtgtcgcaaataccggtttagccatggctgtttcttcttaatccgaggaattttcgaataggcgcaagaggcacaggtttagtgctaatacaaatatagccgtaggatcgcatcgttcaacactgcaatttctttgtagggttatttgtatgttttgtatactcaaaaaaattttttttgatgtgtctttttctgggagcgaggttactggtgtattttattttcatttctgtttgctttaaaaatttattttattttttatgtaaatgttatgtattttattttttcttacccactgccttccccaggagagtaaatgtggcataatttcttctactgattttgagtatcatgtctcagcttcctactaactagctttctcccgtgagtcggggagcagagctggtgcctggtctctagggttctcttccgcggctctgtgcctatgtcgagccagcagtttcgcatcagcactttcgccaatagcggagactcagtgttttctcggctgctgcaccgctggaagcgctgaacacaacagaacgtttcggcggggcgctgtggctcacgcctgtaatcctagcacttagggaggctgaggcgggtggatcactcgaggtcagaagttcgagaccagcctggccagcgggtgaaaccccgtctgtactaaaaatacaataattagctggccgtggtggcgcgtgcctgcaatcccagttactcgggaggctgaggcagtatgcttgaacccaggtggcggaggttgcaatgagacgagattgcgccactgaactccagcctgggtgacagagcgaggctccttctcaaaaacaaaacaacccagaacgtttcttgttcacaagactcagaagtgctttgtggtaacgcttcccctctcctagcgccgccactttccccgggctggctgtctcacggtctcagcccagtgattggccgaggaggcgctctttcagcactttcgctggaagggcttgggctcggtttttctgccacaggcgtttcattgggtaggtgctttctcggtggaagcactgtacaaccttccaagcctcgatatttctcagagacgacgatttcttagtggcaataccttaactgcaccaaaaactaaagtttgccgctgggtactccgctagtcgttcagtgtccgcatttgctattgatgcaggatttttgcttctaagctcagctatatccgggtccttgtctcacgatcaggaggaagtgggcacgcggatatcgaagagtgagtggagtagaatttattaagcgtaaacgaaagctctcataaaaaacaagggtcctgaaagcaggttgccggttgctccttaacggctgaatacaaaggcttttatatgaaagctaaggaggctgggttccctgtttgtataaggcgagaatcccgggtggctccatcccattcccccagtgcgcatgcgcgctcttaatccgcagcaggcatgcttaggcaagtcccttgtgcaagttcccttatctgcacaaaacaccagtcggaggttctctggggacccttcccttacagtctccctaaagctggctaactcctttcactatgtcccagtatccctggttcctcggactggcactttctgagtcatagcaccgctcattcgtccgagcagaattgatctcggtggcagcacctctggtgggtcaagcctgcagcttctcctgagcagtttcgttagtttttgggtcctagaaccgctagtggtaccatagcggctcttcatgggttgcaggacgtttgccaactccaccccacgctgcctgcctaggttcggctacggggcaaaaagaacagactcctgcaaaggaagaaccccgagggttggatatttaggaaagacgtcctttgcagtgccacgtccgcggatgctgcacttggctttctcctccctcctggggaagaattgatgtttacttctccccactctccgggccgcattatccagggatttcggggactagattacctgagattttagcgcttctactggatcatccttttggaaataattatcacttacaataatgtctatccgggccgggtgcggtggctcacacctgtaatcccagcactttggaaggccgaggagggtggatcacgaggtcaggagatcgagaccaccctggccaacatggtgaaacctcgtctctactaacagtacaaaaattagccgggcgtggtggcgcgcgcctgtagtccgagctacttgggaggttaaggcaggagaatagcttgaaccgggaggactgcagtgagccgagatcctgccactgcactccagcctggcaacagagcaagactccgtctcaataataataataataataatgtctatccatgttctttaaaaaagtttgccttcactattctttatcaacgtttggttgtctttctcaataaaataatagagaaacatcaaatgccttttgtttcttttgttttgtttggttgttgttgttttaggatcaagaccaagtcagaggtctgttgctgggtaaggagtgcagcaaatccaggcgacccaggtttccctgccagtcctggcaacagcaaccagacaccccacccctgagcctcatccttactcaacgtcatcagcaggaactcaggtaacaggaatttcacatttgtgtacaattttattgagaagaggaaggaaaaaaggcataaagtgatctgaaggcgaaacttcttccatcgcatttgagagaactcaggtattattgtaactttatttatttatttatttatttacaagaggatcatccaatggaaggtctcagaggaagtttcagggcccaggattccaaaggcgggccgtggacacagtctcagggcgtctgtccccaagcgcatgccatctgcagccagcagtcttggaactttggttggtggcaccaggggacagcagtaggctgacactctcaaaggtcttctcggatggaagtctccggctccagtcgtctgtccactaagcgagaggcgagttgcgagggaggctgcgggggcgggcgggcgtatgttgagaccctatgcagcctcctgctctcccgagggctcctgcggctcctcctgaattgcctgcgccggatccagagcaggcgactctgcgccccgcctccaggtactctgaggcttgggaaagagatcttttcgccggcagtttcagcaaggaagcacgcagggagcggaaagtatgtggcagtggaaatctaggtcggcccaggagagctcgcagtggtaagcacaggaagggagcatccaggacaccgaatgtactgagctccgggctggaggcatctggtcccgccgcctcctttgcggaatcccgggcctgccaaactcggaggggacacggcaactccatcgcgtcctttcaccagcggatacagggtatctaggactcataagtcaacatcttttgcgtttttgtaatcttctggtctcatgggccgtccaaatcagattgcagggaggtgggtgtgaaccttattcttaggagcaagttacatcaggacatggaattaatgagattaacataaagtcctatcatttgagatgaagttatctagttaaacaatttgctttaggaattgaaaagaaaaaatatcacctttcttgtacagagaaagccgtcttggggcaccctggttagaaagttcattattgtccccaaatgcattgctagtactagagcagacaggatccctttctgcctcagagtagtgcttgtcagatgcctaaagatcgctatgttactgaggagcaggccagggtagttgcccatttttaaaattagaggatcattttttggggagatattttattattgtattattctgtgttacgttgactcatgttacattttaattttagattcaggaggtacatgtgtaggtttgttatgagaatatattgcgtgattctgaggcttgatctcatcacccagagagtgaactaaatccccaggaggaagtttttcagcctctacccccttatgtccctccctccctcctttcggagtcctcagtggtctattgttctcatctttatgtccctgtataccaggctgaactcccacttctaagtgaggacatgtaatatttgtttctgcatgaatttgtttaggataatggcatccttatagaatagcttgaagctggataatgtgatgctttgggcttcattatttatttatttatttattgtttgggatgctttgcctattcattgtctttttttttttttttttttttgagacagggtttttgctgcagctcaggtgggaatgcagtgtcatgctcttggcaacctggacctcccaggctcaagggatcctctccgtcagcctccagagtagctggtgatcctcccccctcagcctacagagtagctgggaatacaagaaaagagccggctaacggtattacggaagtactagttggcacagaggctcggtgcaattaccgttctgcaccgtaaaacgggtttaggaagttcctaggagatactagcggtgccagaaccgagaaagtgacgacacagacaacttatggactccgcgtacgggaaacgttccgttgggcgctaagaacggtgcagcaactgaaaaaccgctcagtgggcgctactggcaaaagcgttgctgcaaaaccgccagctccgcattagaagcagagccgccagacagaacccgggacctgaaaccaccgaagcggagaccgagcttggctccccagctcctgagagaatgcaagtcaaggagtacgaagctgtgatactcaaaattagtagaagaaaaatgaataacatttaaataagataaaattttaaaataataaattctaaaattcaaataaaaaggcaaagcaaacacactggaaactaccggtagcattgttctcagagcaaaagacacaaaaagagcatttaaaaataagcaaaaattagagagaaccaaccctacaaagcagaaattacaagtattgccaaaagaagcaattctgtgattaggatatccctgttagatctaaaccggtacatgttacacctaagtctacatttcttaggacaaaaacaaaaacaaacaacaacaacaacaagaaaccaacaaaacccagtcatggttaaacctgtttacgactaaaaaatcgtagtagctgatatatcccgacttggtccacaagaggaaaaagtcgcgttcggcggaaattgctatcgtcaaaccgagcttcgtaaaccagaaatcgcttttgccggcatttcctgacttccatgggagtttaaaaaacaccaacatagctaaggcgggacttgatgttgcgcagctagccttggtgtaagagctcccaggcactgctaaactggtcatcgctaaacctaaatgaatcgcattcgctggtacacagatttctacaggagttgaacatctcctgcgcagctaaagcaagccgtactagtaggaagccggaacttgccacgacttagaaacttgaggctttgggaggccaaggcgggtggatcatctgaggtcgggagtttgagaccagtctggctaatgtggcaaaaccccgtctctactaaaaatacaaaaattagccgggtgtggtggcgggcgcctataatcccagctatttgggaggctgaggcaggagaatcacttgaacccgggaggtggaggttgcagtgagccgagatcgccgagatggcgccactgcattctagcctggacgaaagaaactctgtctcaaaaaaaaaaaaaaaaaaaaaaaaaaaaagaaaaagaaaaaagaaacttgaggcagggctaactctgcgtttgttatgattaggctacaggaaacccggagttgctgggaaatgagtcacagggtcactcagcctttctgtggcgaaacatcgacttcctacgacctagaaatcgccgccagggctaggctggtgtttgtcctaagtgggtacttgcttgggttgagaaatcacattttggctattccccgacttgaaccaggggatagaaatcgtagtcaccggctgggcgcagcggctcatgctgtaatcctggcagtttgggaggccgaggcgggcagattattgaggttaggagttcgagaccagcctggtcaatatgatgaaacaccgcctctagtaaaaatacaaaaattatccgggcgtggtggcgagcgcctgtaatcccagctactcaggaggctgaggcagtagaatcccttgaacctggggtgcggaggttgcagtgagccaagatcgcgccactgcactccaggctgggcgacacggcgagactctgtctcaaaacaaaacaaaaggaaaagaagagaaaagaaaaagaaacgcaggcaccctgaaatcgaaacttgttaggaccaacaagccaacgacagacgaatctgcggggtcctgcgacagacacgccagccccgccgccacagcacagggttctggaggtcgagctgttctgcgggttctgcggcggcgctgggaagagacggcgcccgggcagctcccctgtcaccggcttggaggagcggcgggctcccctagcccagcgccgccgccgccgcccgggaacgccaggctcaccccagctggggaagctccgaatccctcagatcggcgacctgagtgctgtcgccccgagaaaatggaggcatcgagcaacgagctgtgctgagaccgagagacctcagttctgcgaaatgtcggtgcctggagcttgcgaatgactgcggccggcgggttgtcaaggacaacattccttatggcgcaaccaacagcgctgtcaccaagaaactggactctgagaaaaaagagggtttcggccaccgagaaactccgtgccacatgtgccgtgacagcaaaaccgcccgctccgcgccgctggtgaaagagctaacgaacgccaggtgctgcgacagtgacaccgggactagaaggcctcggatggagaatgggacgcccagagcaagcaggaaaacgttttgtttggctcaactagcgctgtcgcaaccggaaaactgtcaggccagtgctgctgcggatgtgagaaaccggtgatccgaaggcggagtggcgctgggcgctggactcgctggtgtgaaaatctggctgctctaggacccggcaagcgcgggcaccaggcgaacgccagcgactttgccagacaaatgcatgtcttttttggtcgccattcaaagatgcagccggcagtcagccccggctctgagaaacaagtggaggtgtcagccataaaccctccgttcagggaaaagagagtcgctgcgacggatcgactggccgttgggtggaactttctttggtggcctagtgactagaaaataaaaacgaaaacgaaataaaaaactgctactgacattactcccacgctccctcctcaagtcagtggcttcaggcttaagaaaacctgtatttttcttggctgatccgtgatccctaattactgagggccccgcgacccaccaagtgcgattcgcagagggaaaggagctggaataaggatccagaatgggacggatttggctcctccaggaagaaagcaaaacaaatgcaggtcgcgaacactttacattgcaggaagctgctcttccagtggccgcggctgggtccttccacaccacctctctgtcctaggccttcgtcccggttcagccctcacggattctaggctagcggtcaacaaccgcatccctccggaacctggaaactctaggtccgagatctcggtgaagaatgaaaggcacagcgccgctcaacccaggcttcaggcctgccccgctggtcccgtcccttccctgtgggatggaactctgtgggaatcgctccttattctgatggttcactcattcagatgtccttgatatttggggatatttctaaaacagctggggagaaaaatggactgcgaggctccggtgttggacgtgaaattggcagtgagacatccgcctctaagcccagggaaaagcttaaattgtggttctctgtctctagcaccgtgatctttgaaatgcgttattgattttcttctttcttctgggaaatgcaatgcaggtgaacttgtaagtgttgaatcctccctctcctcactgttcaatcagactgaggcctacttcctttctgataagaaatatggaactgccattgctcagtaggaaaatgtcctttctacaagcattcatatttcaataaaaatctgcactttgtgagttgagccccctcaaagagacctacagaccctgccatgagcatctccatccacactcatcatttcccattttcaccacttctgctcctgtgcaaaccagtactatccttttctgggggatcctaggcagaagcgatggcaggacaaaggcagagaaggcactgccaggtcctgcatgccagtaaaactactcatgtcagctgttctgcaggatcccatgagaaggtgagtcaccagaaaatgcagtttccacatcctgatgatttcatctccctaccccaactgatcaatttctccaattttccagcctctcaccctccacaatccccttaaaaactgtagcccagaactctctggaatgatgaatttgaaggtttgctcctgtctcctcactcagaagcctgtaatcattaaactctttctctgatgcaaactctgctgtctcagtgtaattggtatgtaagtgtgcagcaggcatatgaatctgttggtcctgtaacagttgggatgcagtggcacaattgtagctcactgtaatctctacctcctacacctaagggaaccttaccacctcagcactcggaatagctaggactttaggtctgtgtgctaccacccatggctaatttataaaataatttctttgtagagacaggatctttctatatagcctgggctggtctcaaactcctggcctcaaggtatcctccccactctgcatcacaaagagctgtcattacatgtgtgagataccataccctgcccatggtagaatattaacacatgggtgtgaaatgttggcttcagtctggcatgttattactttattaacagtaaagaataatatctgatcatgaaattgtttttttttgtaaatagaatattttctatttacattgatgcttttgtaaatagaatatttgactctgatgaagacatattataatttcactatggatatgacctgaaatggaaaaaattgacttacagaaaaaatacaccaaagaagtcaccattttatatttgttcttattacaattatctttcaagccataaaaaacaaaaattagtgattttattaccaactgagaagattattttctgccaagcaatctctaaacattaacttttactaggaatgtattcatgaaagggactttgtaaaataggagcaaatttgacctcttatttaatcattcagagatgaaataaaatataatacattatttgaaaagatatccaggaagcaggaagtacagtcagggatcccaggaatgggtgtggtgatgtctgttgcaccagggcttagagggcaggatctttcctctagaaactctgtgtgtcaggcatgcctagacaaaatacacttatatttgatgttttagcatatcaaagaggtattgcttggtttaaagatgaggctcagtgagtttacaccacagtccaagatcacaaaggtagttcatgctggagctggattgaagtcccaggttatcaggcattcatatcaagtagggaaatgagtaaagaaataattaggttgggttttgaaaaagaagaatcctatgccttacataaaattgtaccttaaaaatttttttggctgggcgtggtggctcttgcctgtaatcccagcactttgggaggccgaggcaggcggattacaaggtcaggagatcgagaccatcctggctaacacggtgaaaccccgtctctactaaaaatacaaaaaattatccggtgcggtggtgggcgcctgtagtcccagctactccggaggctgaggcaggagaatggcgtgaacccgggaggcggagtttgcagcgagcggagatcgcgccattgcactccagcctgggcgacagaccgagactccatctcaaaaaacataaaaataaaaaaaagggcaaatatgttgagctaatatgatgctttttacagtattttttttcaagacccttatatgttatgtgattatatgcatttttttaagttattctccttcctctgttattcctacttccactgcaattcctctcatcagtaactaccagttttaacattacattatccaaaaaagaggtggatggagtctcggctgcatatgctaatgttgcaccttggacgagtgatgtaatgccttttgccattttgcatttccaaatatattctcaaatgtattcctaacagtggtgtttgctacacaatgaaataatagaaataaaatataatacattatttgaaaagatatccaggaattattttaacatttttcctttaaattaatttctgaatggaaatgacagtcatgaaaccattcctataaactttataaagttaatcagggaaaatgggagaaggagaataaaaaatatatcaagactgcagtacattcagcattaatgattaggtcaccttgctctctggccttcttgctcatagttctttggtgcttattgccccaaactatgagaataattatgcagaataattataccctgtcagaattatgcagacccaatcacaagattatagtttcccttaactgctctgtagagaacacctttaacattgtaaaatgtcaaggttttcatttgatatattctcttatgtcctgaagactgataaaactattgatgccagctagtctgaaagaccccatgaggagctggctcaccgaagaatgcagtttctatattttgatgatttcatcccctttaccccaaacaatcaatgaccccaatttttcagtttcttgctctccacaatctccttaaaaactccagagctgggcggggcacggtggctcactcctgtaatcccaggactttgggaggctgaggtgggcagatcaccaggtcaggagtacgagaccactgaaaccccatctctactaaaaatacaaaaattagtcgggtgtggtggtgcacacatgtaatcctagctattcaggaggctgaagcaggagaaggctaaggcaggagaatcgcctgaacccgggaggcagaggttgcagtgggctgagatcacaccactgcactccagcctgggtgatggagcaagattctgttaaaaacaaaacaaaacaaaacaaaaacaaacacctccagaccagaatttctcagggaggtggatttgagggtccctcctgtttcctcacctggctgccctgctatcattacattctttttctgctgtaagccctgctgtttcagtgttttggtatatatttatgttactgcacagcagatatccaaacctgttggtcctgtaacgatcaggcacatcttttgtattggtttgtcttgtgtttttttttttttttttttttttccag

SEQ ID NO: 1394 - DNA, 21099 bp, Homo sapiens; identical to SEQ ID NO: 1393

SEQ ID NO: 1395 - DNA, 21099 bp, Homo sapiens; identical to SEQ ID NO: 1393

SEQ ID NO: 1396 - DNA, 3802 bp, Homo sapiens
gtcttgctctgtcacctaggctggagtgcagtggtgcaatcataactcactgcagcttcgacctcctggcctcaagtgatcctctcacctcagcctcccaagtagctgagaccacaggtgccattctctctctctctctctctctctctctctgtttctctctttctctctccctctctccctctttctctctcagaaacggggtctcactatgttgcccaggctcatcttgaaatcctggcctcaagtgatcctcccaccttggcctcccaaagtgctcagattacaagcatgagccattgcacctggcctgaaatattatttaccttgattattgagttttttggtgcccctttaagttttgcacctgaggctggtgcctcacccaactcacattagcccctgccctgattatttctaacatgcaatccacaccatatcattagttcctcagcaaatactctactattatcactacttcacagttgcaaaaactgaggcacaactgtgcccaatgtcccaaaggaaggagaagaaaaatctgaacttgaaccccagtttcttcgttttttggttcagagcctgcccagtatagcactacaataagctgaattttataaattgggttttgagttaaggaatcaaaagcttcaggcttaagtcccacctctgccccagagtcttctgagccctccattttcacagacgtcagttgccctaggtggaactggactttaatattctccacatcccttattttttcccaaaacagtttaccagctttttctttcctgaaccaggagcaatagcaaaaattgggaatgggaagaaacaggtaccagccaggacacctgaacgaacttggagctcaggaacccaggaggggattggagagagtggggagactccatggtccacaatgaatgctccttccccatccgaaaaaatcccctagcccagtttttgggcagatgccagacttttattctgaagcgtgggccacaacctatgaggtaatctttggagcttcattctgaggcggaatcccattggccagttggggaagcccctcccaggattcctggcgctccgccttccctgaagcctataaaagcgcaggtccccgcctcggcagccacgggacacctgcatctgccaacaagactggaagcagaaagggacagagacggcgaagtttgacggtctggaaagcagagaccagcagggctgactgcttgggagcgcctctcgggaggtccgagaagagaaccgcgatctgtttcagcaccggggctcaggacagttcccagcgggctccgtttcgtctccagaaccctggacagctcctccagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacacttaagggccggccagccaactcacagccccaagagagagagccaggctcatttaattagcaattacaaggcactgattcctcattagctctggcaaccctcgtctccctcctcagccccagacaaatgaaatctttctctctctcccaggagtactgcctcagtgggtccattaacaagcagagaaaatgagattagaagacacctaaatgccagaggcactttatgaatgggctgagcagagggaggttcaatgtctgggttaggtctaattgtgggaggtttcctggtctatttagaattgccccctgggaatgcaaggtctttcagaaaggaaaaggcacacagatattgccttctggggtcctcaatggaggaggacattctgctatgggtgtctcccagtcaccccaaattaatcatttcaaagtgaacactcaatctgcccagcccctagcttcctcccctgacatgcccatgaatatgacagtccctctacatgcccaagatcctcccctcctcatccactccccatgatccccaagatgagtcactgtgctcaaatccatcctctctcctccagccctctgcctccatgacctccctccagccctctgcctccatgacctccgcctccctgcatgtccggatctcctcactgtctcccctctgagcatacacacacatacagcctgttcattctctacatgcagcgaggggactttccagaacacacatctgaccaagttccactcctgcctgtcacccttccaagagccccactgactgcagaataacgttcaaatatccggttgggcgtggtggctcatgcctgcagtcccagcactttgggaggccaaggtgggtggatcacttgcacaggaccacaggcgtgtgccaccacacccagctaatttttatatttttggtagagacggagtttcaccatgttggccaggctgacctcaagtgatccacccgcctcaacctcccaaagtgctgggattacaggcatgagtcactgcaccggtctaattttttcagagtctcactcttgcccaggctggagtgcagtagcatgatctcggttcactgcaacctctgcctcctggtttcaagcgattctcttggctcagcctcctgagcagctgggattacaggcacgtgccaccacacttagctaatttttgtatttttagtagagatgggggtctcaccatgctggcacagttggtcttgaactcctgacctcaagtgatccacccacctcggcttcccaaagtgctgggattacagacgtgagccaccgcgcccggccagcctttattgattctttttaaagccacactaaccttttattttcccccaaagacccctgggagccctcagtttttcctggcagtttcatctttgtacccctgacctccccacacacacgcctagctcagtgctggcatccaatattcactttgggtataaatgcttgtgcctgagcctatcaccttcatcacacagaaaatcctggaggccacacacccctgtaaagacgagccattacccacagaggtccaaccaacttaccaccctctcccagccacccccaaggacccagcttgcagctgcctgctcaatggctttagaaactaaaaaaggtgaatgagtttccatcactgccctcctgggctttgccgttatggctggttaacttgacagaagaacacattatacttcattttttgctgttgtcttgttggaaaaaaaagtgacagctgggtgcagtggtgcacactgtagtcacagctactcaggagaattgcttgagcacaggaattggaggctacactgagcaatgatcgcctcactgcactccagcctgaacgacagagcaagaccctcttaaaaaatacgtgagagagggtgcgtatgatggctcatgcctgtaatcccagcagtttg

SEQ ID NO: 1397 - DNA, 1964 bp, Homo sapiens
agcctgcccagtatagcactacaataagctgaattttataaattgggttttgagttaaggaatcaaaagcttcaggcttaagtcccacctctgccccagagtcttctgagccctccattttcacagacgtcagttgccctaggtggaactggactttaatattctccacatcccttattttttcccaaaacagtttaccagctttttctttcctgaaccaggagcaatagcaaaaattgggaatgggaagaaacaggtaccagccaggacacctgaacgaacttggagctcaggaacccaggaggggattggagagagtggggagactccatggtccacaatgaatgctccttccccatccgaaaaaatcccctagcccagtttttgggcagatgccagacttttattctgaagcgtgggccacaacctatgaggtaatctttggagcttcattctgaggcggaatcccattggccagttggggaagcccctcccaggattcctggcgctccgccttccctgaagcctataaaagcgcaggtccccgcctcggcagccacgggacacctgcatctgccaacaagactggaagcaggtgaggcacacagagggggaggcccgcagctgcgtgggaggaggggtggtctgagggacgtgggatgccgggaatgaggctggtttgcaggttggcgcatggacattttcccagaaagggacagagacggcgaagtttgacggtctggaaagcagagaccagcagggctgactgcttgggaggtaagttctggggacatggtacagggtgaggagcaggtatcagtgctagttgcgacccctctgtgtctcccccccgccaccccattgccattctgaagctccccaggaagaagctaggaggggaaataaattgagtgggggtggggtttcccaagaatcggaggaaccgagaacgaagaggggtgggggaacggggaaagagagaggaaaatcaagttttcttcagcacgagggacagctctccaccgaccgaaggaggagaatgctatttatttcagcaccaaatatccggacagcgcctctcgggaggtccgagaagagaaccgcgatctgtttcagcaccggggctcaggacagttcccagcgggctccgtttcgtctccagaaccctggacagctcctccagagacggggtttcaccatgttggccaggctggtctcaaactcttgacctcttcatccgtccacctcagcctcccaaagtgctaggattacaggcgtgagtcactgcgcctggcccaagtccggaattttcaacaggacatgggtgttactgtgcccatgtgacatttggggaacccaaggccctgagaaaggcagaaaaataacccacgcagggactctcagcccacaagtgaagctgagaaccgggaatggaaaacagggaggcagcacagaggcaggaaactcaggtgtcatagcttggctcaggtgagaaggaggagctgggcaggggtctcagacatggggcagagggtggtgaagaagattagagtggctgtggtctagtgctgtgtggaagactagtgattttgttgttctgatgtactacgacaacaagtcacagccggcctcatagcgcagactcccttcgaccttcgccttcaatgggctggccagtgggggagaaccggggaggtcggggaagaatcgcttccactcggagtgggggggctggctcactccaggcgatacaggcacaggcaaaggagggaagcaaacaaggacatacatcctgtgctcatacagccatgcaccatgtatggggtttgtcacatcactcgtacgcccccacaagcctggagatagaacatacctgactctaaacccaagacctctaaccaccttatggcgctttcctgggagacccaatgagggaatgacatttaaagccctccctagaccag

SEQ ID NO: 1398 - DNA, 1967 bp, Homo sapiens
agcctgcccagtatagcactacaataagctgaattttataaattgggttttgagttaaggaatcaaaagcttcaggcttaagtcccacctctgccccagagtcttctgagccctccattttcacagacgtcagttgccctaggtggaactggactttaatattctccacatcccttattttttcccaaaacagtttaccagctttttctttcctgaaccaggagcaatagcaaaaattgggaatgggaagaaacaggtaccagccaggacacctgaacgaacttggagctcaggaacccaggaggggattggagagagtggggagactccatggtccacaatgaatgctccttccccatccgaaaaaatcccctagcccagtttttgggcagatgccagacttttattctgaagcgtgggccacaacctatgaggtaatctttggagcttcattctgaggcggaatcccattggccagttggggaagcccctcccaggattcctggcgctccgccttccctgaagcctataaaagcgcaggtccccgcctcggcagccacgggacacctgcatctgccaacaagactggaagcaggtgaggcacacagagggggaggcccgcagctgcgtgggaggaggggtggtctgagggacgtgggatgccgggaatgaggctggtttgcaggttggcgcatggacattttcccagaaagggacagagacggcgaagtttgacggtctggaaagcagagaccagcagggctgactgcttgggaggtaagttctggggacatggtacagggtgaggagcaggtatcagtgctagttgcgacccctctgtgtctcccccccgccaccccattgccattctgaagctccccaggaagaagctaggaggggaaataaattgagtgggggtggggtttcccaagaatcggaggaaccgagaacgaagaggggtgggggaacggggaaagagagaggaaaatcaagttttcttcagcacgagggacagctctccaccgaccgaaggaggagaatgctatttatttcagcaccaaatatccggacagcgcctctcgggaggtccgagaagagaaccgcgatctgtttcagcaccggggctcaggacagttcccagcgggctccgtttcgtctccagaaccctggacagctcctccagtagagacggggtttcaccatgttggccaggctggtctcaaactcttgacctcttcatccgtccacctcagcctcccaaagtgctaggattacaggcgtgagtcactgcgcctggcccaagtccggaattttcaacaggacatgggtgttactgtgcccatgtgacatttggggaacccaaggccctgagaaaggcagaaaaataacccacgcagggactctcagcccacaagtgaagctgagaaccgggaatggaaaacagggaggcagcacagaggcaggaaactcaggtgtcatagcttggctcaggtgagaaggaggagctgggcaggggtctcagacatggggcagagggtggtgaagaagattagagtggctgtggtctagtgctgtgtggaagactagtgattttgttgttctgatgtactacgacaacaagtcacagccggcctcatagcgcagactcccttcgaccttcgccttcaatgggctggccagtgggggagaaccggggaggtcggggaagaatcgcttccactcggagtgggggggctggctcactccaggcgatacaggcacaggcaaaggagggaagcaaacaaggacatacatcctgtgctcatacagccatgcaccatgtatggggtttgtcacatcactcgtacgcccccacaagcctggagatagaacatacctgactctaaacccaagacctctaaccaccttatggcgctttcctgggagacccaatgagggaatgacatttaaagccctccctagaccag

SEQ ID NO: 1399 - DNA, 1627 bp, Homo sapiens
agcctgcccagtatagcactacaataagctgaattttataaattgggttttgagttaaggaatcaaaagcttcaggcttaagtcccacctctgccccagagtcttctgagccctccattttcacagacgtcagttgccctaggtggaactggactttaatattctccacatcccttattttttcccaaaacagtttaccagctttttctttcctgaaccaggagcaatagcaaaaattgggaatgggaagaaacaggtaccagccaggacacctgaacgaacttggagctcaggaacccaggaggggattggagagagtggggagactccatggtccacaatgaatgctccttccccatccgaaaaaatcccctagcccagtttttgggcagatgccagacttttattctgaagcgtgggccacaacctatgaggtaatctttggagcttcattctgaggcggaatcccattggccagttggggaagcccctcccaggattcctggcgctccgccttccctgaagcctataaaagcgcaggtccccgcctcggcagccacgggacacctgcatctgccaacaagactggaagcagaaagggacagagacggcgaagtttgacggtctggaaagcagagaccagcagggctgactgcttgggagcacgagggacagctctccaccgaccgaaggaggagaatgctatttatttcagcaccaaatatccggacagcgcctctcgggaggtccgagaagagaaccgcgatctgtttcagcaccggggctcaggacagttcccagcgggctccgtttcgtctccagaaccctggacagctcctccagtagagacggggtttcaccatgttggccaggctggtctcaaactcttgacctcttcatccgtccacctcagcctcccaaagtgctaggattacaggcgtgagtcactgcgcctggcccaagtccggaattttcaacaggacatgggtgttactgtgcccatgtgacatttggggaacccaaggccctgagaaaggcagaaaaataacccacgcagggactctcagcccacaagtgaagctgagaaccgggaatggaaaacagggaggcagcacagaggcaggaaactcaggtgtcatagcttggctcaggtgagaaggaggagctgggcaggggtctcagacatggggcagagggtggtgaagaagattagagtggctgtggtctagtgctgtgtggaagactagtgattttgttgttctgatgtactacgacaacaagtcacagccggcctcatagcgcagactcccttcgaccttcgccttcaatgggctggccagtgggggagaaccggggaggtcggggaagaatcgcttccactcggagtgggggggctggctcactccaggcgatacaggcacaggcaaaggagggaagcaaacaaggacatacatcctgtgctcatacagccatgcaccatgtatggggtttgtcacatcactcgtacgcccccacaagcctggagatagaacatacctgactctaaacccaagacctctaaccaccttatggcgctttcctgggagacccaatgagggaatgacatttaaagccctccctagaccag

SEQ ID NO: 1400 - DNA, 1572 bp, Homo sapiens
agcctgcccagtatagcactacaataagctgaattttataaattgggttttgagttaaggaatcaaaagcttcaggcttaagtcccacctctgccccagagtcttctgagccctccattttcacagacgtcagttgccctaggtggaactggactttaatattctccacatcccttattttttcccaaaacagtttaccagctttttctttcctgaaccaggagcaatagcaaaaattgggaatgggaagaaacaggtaccagccaggacacctgaacgaacttggagctcaggaacccaggaggggattggagagagtggggagactccatggtccacaatgaatgctccttccccatccgaaaaaatcccctagcccagtttttgggcagatgccagacttttattctgaagcgtgggccacaacctatgaggtaatctttggagcttcattctgaggcggaatcccattggccagttggggaagcccctcccaggattcctggcgctccgccttccctgaagcctataaaagcgcaggtccccgcctcggcagccacgggacacctgcatctgccaacaagactggaagcagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagagacggggtttcaccatgttggccaggctggtctcaaactcttgacctcttcatccgtccacctcagcctcccaaagtgctaggattacaggcgtgagtcactgcgcctggcccaagtccggaattttcaacaggacatgggtgttactgtgcccatgtgacatttggggaacccaaggccctgagaaaggcagaaaaataacccacgcagggactctcagcccacaagtgaagctgagaaccgggaatggaaaacagggaggcagcacagaggcaggaaactcaggtgtcatagcttggctcaggtgagaaggaggagctgggcaggggtctcagacatggggcagagggtggtgaagaagattagagtggctgtggtctagtgctgtgtggaagactagtgattttgttgttctgatgtactacgacaacaagtcacagccggcctcatagcgcagactcccttcgaccttcgccttcaatgggctggccagtgggggagaaccggggaggtcggggaagaatcgcttccactcggagtgggggggctggctcactccaggcgatacaggcacaggcaaaggagggaagcaaacaaggacatacatcctgtgctcatacagccatgcaccatgtatggggtttgtcacatcactcgtacgcccccacaagcctggagatagaacatacctgactctaaacccaagacctctaaccaccttatggcgctttcctgggagacccaatgagggaatgacatttaaagccctccctagaccag

SEQ ID NO: 1401 - DNA, 3273 bp, Homo sapiens
agcctgcccagtatagcactacaataagctgaattttataaattgggttttgagttaaggaatcaaaagcttcaggcttaagtcccacctctgccccagagtcttctgagccctccattttcacagacgtcagttgccctaggtggaactggactttaatattctccacatcccttattttttcccaaaacagtttaccagctttttctttcctgaaccaggagcaatagcaaaaattgggaatgggaagaaacaggtaccagccaggacacctgaacgaacttggagctcaggaacccaggaggggattggagagagtggggagactccatggtccacaatgaatgctccttccccatccgaaaaaatcccctagcccagtttttgggcagatgccagacttttattctgaagcgtgggccacaacctatgaggtaatctttggagcttcattctgaggcggaatcccattggccagttggggaagcccctcccaggattcctggcgctccgccttccctgaagcctataaaagcgcaggtccccgcctcggcagccacgggacacctgcatctgccaacaagactggaagcagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagcctcagggcttttgcctctgctgttcctgcagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacacttaagggccggccagccaactcacagccccaagagagagagccaggctcatttaattagcaattacaaggcactgattcctcattagctctggcaaccctcgtctccctcctcagccccagacaaatgaaatctttctctctctcccaggagtactgcctcagtgggtccattaacaagcagagaaaatgagattagaagacacctaaatgccagaggcactttatgaatgggctgagcagagggaggttcaatgtctgggttaggtctaattgtgggaggtttcctggtctatttagaattgccccctgggaatgcaaggtctttcagaaaggaaaaggcacacagatattgccttctggggtcctcaatggaggaggacattctgctatgggtgtctcccagtcaccccaaattaatcatttcaaagtgaacactcaatctgcccagcccctagcttcctcccctgacatgcccatgaatatgacagtccctctacatgcccaagatcctcccctcctcatccactccccatgatccccaagatgagtcactgtgctcaaatccatcctctctcctccagccctctgcctccatgacctccctccagccctctgcctccatgacctccgcctccctgcatgtccggatctcctcactgtctcccctctgagcatacacacacatacagcctgttcattctctacatgcagcgaggggactttccagaacacacatctgaccaagttccactcctgcctgtcacccttccaagagccccactgactgcagaataacgttcaaatatccggttgggcgtggtggctcatgcctgcagtcccagcactttgggaggccaaggtgggtggatcacttgcacaggaccacaggcgtgtgccaccacacccagctaatttttatatttttggtagagacggagtttcaccatgttggccaggctgacctcaagtgatccacccgcctcaacctcccaaagtgctgggattacaggcatgagtcactgcaccggtctaattttttcagagtctcactcttgcccaggctggagtgcagtagcatgatctcggttcactgcaacctctgcctcctggtttcaagcgattctcttggctcagcctcctgagcagctgggattacaggcacgtgccaccacacttagctaatttttgtatttttagtagagatgggggtctcaccatgctggcacagttggtcttgaactcctgacctcaagtgatccacccacctcggcttcccaaagtgctgggattacagacgtgagccaccgcgcccggccagcctttattgattctttttaaagccacactaaccttttattttcccccaaagacccctgggagccctcagtttttcctggcagtttcatctttgtacccctgacctccccacacacacgcctagctcagtgctggcatccaatattcactttgggtataaatgcttgtgcctgagcctatcaccttcatcacacagaaaatcctggaggccacacacccctgtaaagacgagccattacccacagaggtccaaccaacttaccaccctctcccagccacccccaaggacccagcttgcagctgcctgctcaatggctttagaaactaaaaaaggtgaatgagtttccatcactgccctcctgggctttgccgttatggctggttaacttgacagaagaacacattatacttcattttttgctgttgtcttgttggaaaaaaaagtgacagctgggtgcagtggtgcacactgtagtcacagctactcaggagaattgcttgagcacaggaattggaggctacactgagcaatgatcgcctcactgcactccagcctgaacgacagagcaagaccctcttaaaaaatacgtgagagagggtgcgtatgatggctcatgcctgtaatcccagcagtttg

SEQ ID NO: 1402 - DNA, 15524 bp, Homo sapiens
gtaccacaaagcctctggtgacggtggagcaaaggaatagatggtgaatgtctcatacccacttcggatccagaacaggcctaggagagactcagggacacggcttcccctgaacgcggatcctagaggccaggcagaagcagcatgggtttccactcacacggtaggcggctgtgcaatttcgtctggagtccccagacccctcctcatccttcccagggttgctctgaggccattccttgtcatctaggaggggtctacataaaagcatttataaacacctccaaatgggagccaggcgtgcccacctttggagcacttttctctactgcaaatttatctactgctcgtgaaatctctggatttaactctgatgaaagactggaggctgaaggagaacttcaatatcatatattttaaaggttgattcacagtttggagcaagaattaaagaaccacgaacttcaaggtaaaacgggcaacggcgttggggcaagcctctctgcatctgcgtgtccagcctctcctgcgtgccagaagttcccaggcaggagtgtggtgggacatccggctggggtaaggacaggcaccctcccactgtgtcagggcccagagagtgggtggagaagctctgcaagagacctgtgcaagggcgccttgcaggagcctgcagtccccacaggtgtgtttgtggataacacttggggagccctggccttttggggtcacggagggcttggcctctcacctcagagctgcagagaagccgcttctacatcaggacatcagaagctggaacaggatggccggcgaggggcctcttgttggggtcacagagatgggtcgcagagatggcccgtgtggaaggttggattctcaccccacctctgcccctagatgtcctggtgaccctcccctctgtagtcttggttttttgcaaaacagttatgacctcctgccatactgggtactttgcttatgtattgtgtttactctttactgtgtgtctctcctgctaaggtctacgaagaagggtctttgtgggtggggttcttagaggcatcccaagtaccagaagcagtccctggactaaggggctcaataaatattttttatttattattttttctttttgagatggagtctcgctctcttgaccaggctggagtacagtggcacaatcttggctcactgcagccttcgcctcctgggttcaagtgatttccggctaatttttgtatttttagtagtgacggggtatcaccatgttggccaggctggtcacaaactcctgacctcaagtgatccacccgcctcagcctcccaacatgctgggattatagacatgagccaccatgcctggccaaatatttgtcaaattgaatttgtatttccatacaaattttagtctggataaagtgcttcatgcctgtaatccaagcactttgagaggctgaggcgggtggatggcttgagcccaggagtttgagaccagcatggaaaacatagagaaaccccatctcaatataagaagaagaagaaaaagaaaaaaaaaatcaaaaacgaaaacaacacaaattttagagtgatgtaaaattctcaaacaatgagatagataaaaagtacgcagccaaaaagttcaagaagaagtgttatggagatggagcaggcccttcgtaaaaacacgatgttggttttctggattttggaggcctcacaaaacccggatcagactcgcccactgccctgtgtctgccctcccgaccgcctctcctgcccagcagggatgagggtggcagtggtgctgtgtggagggtggcgggaggacctggaagactgcgaccagtgagccgggaggccttgggacagcctctctctgaatcatcctgtgcactgccgggtgtgacagaggctcctagaatcctgtctcaagtggccgccttcacagagggagtcactgacgtccctgctcagcgcagccctggcatgtgggggtccctctactcatgagaaacccccacccaatcaccgtgaggtgtgtgacccatgctcacatccaggggccactcattcattcaggaaacattggccgagccctcagcagggggcggtgctggatgccgggatgtagagagtggggtgggacaaggacttggttgtgagacgtcccagtccggggaaggactaagagaaggtgacatggacagtctagactacccgtcattggttctccactgggggcagtattggcaatgtttaggtataaatttgttgtcacaatgaatgctaccaacgtctagtgggtggaggccgggggtgcggctcagcatcctaccaggtgtcggacggcccccaccaccgagtgccagccccgagggcagcccagggtgccccagtggtgaggagccccggtgtggagtgcagggttcgtttggaccacggctgtagaggcctaggggagctcccgccatcaggatggccgggcatcagggctctgtgagggggaagggggcatcagtgcagcggcaggcaggggttcgacgggctgagtcctgcgacgtgttgcatccacaccagtgtctggggccagcaccaccgctcagtctctgaacccacttatttcgcccaatattgcttgagtgggaagttccaccttccccagtcggctgcttatctcgtctttccaatgcagttaggaagggaaaatattttctccccattttacagatgaagaaatggggcctggcgaggagcaaagcccagaactgctgcccaccaccctccctgcctggtgctttcctgggaacatgtgggagcccctgcctggaccttgggacctcccatctgtaattgcaggccctggtctgcctgtatggatgtggaatgtgtcactcgggatcctggagtcctcctgagcttgtccagcagggctgcattcactgatgtgctgacagaggcctaggctcggacctctaggaatatccaaggcatctcattatgcagaaaaccaccctcatgaggtcctggaggcctctctccatcttcctgggggtgatgcaatagagtgtaacttccatgctgccgagacaggccatgaggggttgcccccgttggaggggcagagtggtatttgtggggtggtaggaatcattcaatgcccagctgcaaccccccgggctcacagcacactcttaaggccagtgctaccagctcccttgggtggatagaggagctacggctcagaagcatgcccacagctcccccaggaccctgaggccagcctgtggcagggcctgtgatttgaacccctctacaaggcttcaaatcagtgctgtttgtcctggcctcataaaacctggctgcccagttgggattggtgtcatctgccttgctgaactgggcactccttgggaagagggtgggtgctgcgagaaggcggtggatcctggctgtgcaaccttcgcaggtggctgaacctctctgtgtctcagtttgctcatctgcaaagggggctgggattcctgcctacatgcatgtgctcaagagggaaagccagccaggcatggtggctcatgcctgtaatcccagcactttgggaggctgaggtgggcagatcacttgaggtcaggagttcaagaccagcctggcctaaatggcaaaaccccatctctactaaaaaaaaaaataaaaataaaaaaatagctggacgtggtggcgggtgcctgtaatcccagctactggggaggctgaggcaggagaatcacttgaatccgggaggcaagggttgcagtgagctgagatcccaccattgcactccagcctgggtgacaagagtgaaactccacctcaaaataaataaataaataaataaataaataaagtaaaagagggaatgctgagagctgggcgtggcctgtggctctgtagctacgcaggaggctgagtcaggaggattgctttaggccagagattccaggctgcagtgagctatgatcatgcctgtgaacagccgctatattctagcctgggaaacacagtgagaccctgtctctgaaaaaataaaatatttaaaaaagagtgaatggtaggtcagggtcttctgtagtggggtgggtctgggcaggggtggaggcccagccagagtcactggggtcagggagggactggtaacaagaatgcacagccctgaccagggaagcacccagggagctttccccgtgaaggggggacctggcctcgccctggcctcaccccggctgtgagttggaaccagcatggagggaagccaggcccggtgcactctgcccagggggatgtagtttggccagtgggggctgccatcagaggctgtccttactgtgggatcgctgtggatgctttcccttctgaagcctggaaccttgggtccccatgccctccagctctgtgtctcctttgtgggcatcaggaagacacattccctggcctcctttgcagtggctggctgtggaaggaggtgcctggggtcaggtgggtgtaggtgggtacgtggcatcacgaggacatatttttttagagggaattacattctttcttccaattttttattataaaagttttccaattgaaaccacccacaccccaagcctggggccggcctcccatcactgccttctcagccctgggggaggcctccttctttctgcatggcctctgggcccatctgagcattcctcttccctgatgggagaaacgcctggtgggggagaagtggaagtgggtgtccaggcaagtctcaaatcccaatggctgacccggaatcccctctgcacacctctcctcctggtgcccggagggggtgcccactctgctgccagggatttcctgagtagctgctccgaccacagccagggaagagtccttgcaggaactctgcgggctgggcctgccctccccagccttggcatcttcttgttggtgtctgagtttgagtctgttctgtgggctctgtgggaggtgggcccagcttctcaccatgcaggacccctcacccagagcctgaaacccgctttgactaacatgcctctgggttccttcactggccctgcccagtcgcatcccatgggaagaaggactggctgctcggggttctcagaccctagcctgggaaaaccagtctgagggcagggataacccttggccctgcctctgattgggccctgagttaggtggggttcttccctgctgggggtcctggaggcatgggagggttttggggttctgtgtgagagaggcctcagtcccttcagttctcacagatcccccaaggctgtgtgtctgatccattgctttacataagagaggaattggagccaggcaaagcccaggattaaaatgggtggtggaggggggaagctgtgatttgaatgtgtccctctaaaaacacgtgttggaaactcagtcctcaatgcaacagtgttgggaggtagggcctaaggggaggtgtttaggatgatccatggatgatccatgcaggtaacaaaaggcctcgaggctgggtatgtgttctctcactctctcacactctcttgccatgtgatgccttctgccatgtgatgacacagcaggaaggccctcaccagatgcagcccctgaaacttggacttcccagcctccagaatcatgagccgaatcatcttctattttttattttttattttttttgagacagagtcttgccccgtcgcccaggctggagtgcagtggcatgatctctactcactgcaagctctgcctccctggttcatgccattctcctgcctcagcctcccaaagagctgggattacaagtgcccgccaccacaactggctaatttttgtgtttttagtagagacgggatttcaccatgttggccaggctggtctcgaactcctgacctcaagtgctccacccaccttggcctcccaaagtgctgggattacaggcatgagccaccacacccggccttttttgtcttcttataaggaggtaagttgtattgaatcagggcccactccaatcaggtgtgactgcgtcttcacttgattatatctgcaaaggccctatttccaaaaaggttgcattcataggtaccaggggttgaggctttaacatatcttttaaaatttttattatttttttgagacagagtcttgctctgtcgcgcaggctggagtgcagtggcgcgatctcggctcactgcaacctccacctcctgggttcaagaaattctcttgcctcagccccccgagtagctacaattacaggcgcccccacccaccccaccatgcccggctaatttttgtatttttattagagctagggtttcaccatgttggccaggctggtctcaaactcctgatctcaagtgatccacttacctcagtttcccaaagtgtaacatacctttttgggggacagaattctacccacaaattctagataaggaggcattgcttcttttttcttctggtattgaatgtcactttggagaagtctgatgtcaagttggttttctttgctttataagatacttggtctttctgtctggctgcctaaaggattatttctttatctttaaagtccagtgactttacaaaggcatgttttgtgttgactgttctgggccaacacacacaagtatacagcttgcacttttacaggcaggtgcaagtctgcctgcatttcaataaagaggtcttgaatgatagtttcaatccttgttcagcaggtgctgtggtgcacacctgtgctcccagctactcaggaggcctcctttttaatctctttcctctttctttccatttgctcactttttccttttttacgtgattttcatggtgtctgtgctctcatattacctgtaacttcatttcttcatttctgaaatggttctgtctttttcttcagtttccttcctgaattctgtcatgtcctaccacagactcggctgctgtttggccacctcttccctgcattcttattctgtgcttattctcctctgttcttatcctgtgctgtagtctccctttggagctgaagttcttgttggaatattagatcattattttcatctggtttgtggcagtatttgtctgatgagatttcttcatttgtaggaaaatagcactgcttttatttttttttttttattttttaagactgcagcttgctctgtgacccaggctggagtgcagtggcacaatcgtaactcactagagccttgacctacagcctgcactcgagcaattctgctgcctctgcctcctgagcagctggggactacaggtgcgtgccaccatgcctgcctgggtttctttttctatttttttgagagagggtctccctctgtcacccgggctggagtgcagtggcgcaatctcagctcactgcaatttctacctcctgggctcaagcgattctcccatctcagccttctgaatagctgggactacaggtgcacactatcgtgcccgggaatttcttcgttttttttttgtttgtttgtttgtttgtttgttttttgtagagacaaggtttcacgatgttgtccaggctagtcttgaactgctgggctcaagttacctgcccacctcggtctcccaaagtattgggactataggcgtaagccaccatgcctggcctttttttttttaagttaggcacttaggtctccttatgttggccaggctgatcttgaactcctggcctcactcaatcctcccgcctctgtctttcccacaaagtgctggtgttactggaaaagggggggctctgatccagaccccaagagaggtctctttgatctcatgcgagaaagaatttggagcgagttcacagagtaaagtgagagcaagtttatcaggaaagtaaagggatgaagaggaactgaggtctcctccccgcccttttgagaccttataaggtaacctccagacattgccatggcatctgtaaactgtcatggtgctggtgggggtgtcttttagcagcaaatgcattctaattggcatataatgagccgtgaggacaatcagaggtcactctcgtggccgccttggttttggtgggctttggccggcttctttactgcaacctgctttatcagcaaggtcttcatgacctgtatcttgtgccgacctcctatctcatcctgtgacttagaatgcctaaactcctgggaatgcagcccggcaggtctcagcctcattttacccagctcctgttcaagatggagttgctctggttccaacgcctctggcattgggatttcaggcgtgagccactgtgcctggccagcattgcttttggaagtggagagcgtgcccatttttgttactcgtttatttgaataggatggctgttccggccaggaggtgctgggccacggctcctgggaggaccatgtgctgccgcacatgtgcctcccgggtctgtcctctgtccctggctgctcgggtcagcctggcctccggttctctccctttctgtcccttttgcaccctggctccctctctaggctgcggtgcagtgaggacgctgctcagggctggaggctggcgggaggttgggtgtgatgcgaggctgtgttgccggctgttctggggatgctgacaacattagcgtggctcatgtttatcgtgggtctagctcctcttgtacagacatggtcctcttcccttcctccacgaaagcagaaccctgatgcgtggcggggcatgtagctggccggaatgaaaacctgcatctcccagcttcctccctgatgctaagtggagctgagctgctaagtcgtggccagtgggttaaaggcagaagtgctgtaggagacttccaggaagatggctaaaaacaagctgactcagctgggacttctgggatgggcccttttctgccctgtacttttccagcttccttccacctgtcctgtggtcttgatggctggagcaccagcagccaccttggaccatggagtggctttgaggctagacaccatgcgtggaggatgaggagcaggacagccaggatctgggtccctgaggacatcgaggagctgccacctcaccctcaatcagtcatccccagattctcccttcagaaagaaatcagcttctttcttgtttatgcttcttttgctgggattgtcatatgcagcgaaaccaaactgtggagtcccgatcagctgatagaaatgaggaaggggttccctcctctgcacaactccatggcaccacaggccctagctggcaagaacatgaactagggtgggggagagccattgttctaagaaatggataaccacaagcagcctgcttgcacaacctcctgttaccaaatacctagctctgcacgttagctccagcagcatgaccctgtctgcatggggcctctccagcgtgaccctgtctgcatggggcctctccagcgtgaccctgtctgcatggggcctctccagcgtgaccctgtctgcatggggcctctccagcgtgaccctgtctgcatggggcctctccagcgtgaccctgtctgcatggggcctctccagcgtgaccctgtctgcatggggcctctccagcgtgaccctgtctgcatggggcctctccagcgtgaccctgtctgcatggggcctctccagcgtgaccctgtctgcatggggcctttccagcgtgaccctgtctgcctgttgcctctccagcatgaccctgtctgcatgtggcctctccagcacgaccctgtttgcatgtcgcctctccagtgtgaccgtttccacatgtagcctctccagcgtgaccctgtctgcatgcggcctctccagagtgaccctgtctgcatgtggcctctccagcatgaccccgtctgcatgtggcctctccagagtgaccctgtctgcatgtcacctctccagcatgaccgtatccacatgtggcctctccagcatgactctgtttgcatgtggcctctccagcatgaccctgtctgcatgtcgcctctccaatgtgaccctatcaaacttccccctggcctctgcccctggggaggtggccttctctctgccatgctgcctgctgttctcttgcaaggtgtcttcagactttctttacccatgactgtctcggtaaattcttttaccacccgtgacaccagccccagccagttgcacctgcaacactggctgcagtggattccttgttgttgatactccacataaccttgctaggtgtcatatatgatcattctttaacagaggggcaagctgaggctcagagaggttaaggcacttgctcaaggtcacacagcagagaggttgtgggtaagccaggctgctggcttagaacactgccatggcatttctcagatcacctcgctcagggactcctggcagttccccctgtgtcatagcggtgagtctgtccaggacgagccactccaggctaccgagggccagctggagggcctgcagacacttgctgtggagtcaaggtccacaccatcagctggaagagaggtctcaggaggggcattagtgtttgtcctcgctgtgattgcaccaactgacaaatcagctgtgggacaatggaaaacacagcagcagcttgttactgagaagggaggactcagggtggacctgacccctctgcagatggcttggtgagaacgtggcctgccctgttggctcctccctctgggtattggaattgctgggcagccagaggcttacctgggcttactggcacccagggaggagaagccctgagctgtgcggctgctgaggaaggctgtctgcaggggagagcccaagcgctgaaggaggccagtgggctcagcctgatgtctccattctccttcctacagcaaccagggttctttggaaagggtcaattgccccaccttaccaggtagggatgcaggagggagagcgagccattcctctaacgtcagtgaccatgtcttggttccaaaaccccttaagccttgggttgtctatcagcaaaaagagaagggatgtgctcagggggtcttcgtggagatcctctgctcccctcaccttgaatgtggagagggcccaagactccctagggaaggcagttgatacagactccaggtgtgccctgctctctcctcggcaccactctgcagcaccacaggcagtctggggtgcagataacatctctctgggcacagctttgcaccagggcatgctgggggtagagccacacttgcatggcctgtggatccctgcagcctggggattgggctgctattcccactgcagggagggaggtggttggaggtaggggctgctcctacctaggtacttctggcctcaccagaagaagggggagggtttgcacattgagtggcacctgctccatctttgtccctgtatttacatcattattctgaaggccaagagattagacctgccggagctccatgcacagaccctgggcaggtgcatgtgggcttctggcttcctggtgtgcacagccccttctctcccttctggactgtggcagtgtactagggacattgtagccactgtgtaaagtctcccgctttctgggacagttttattcactcatgtgtgttgagagctcgttttgtgctggggtccctggggagaacgctgggttcactcatagttccacaacaagggacctgtggcctttgttgtggacaggggccaagagcatgtagagaaggcactgaatgctccttggcttccaggggaaagatcaggactggaaggatgtgggaactgcccaaagctacaggatctgctgtctcaatggctgagcagggtgcagagtgcatgcggctgtttgttctgtggcactggtaaccttggcacttctccaggtgtgaaggacagcatgggagtgagcctgtgaagttataggcagagtccaggcagccccaagcctgggtgggttgtagctgtcagagtggcagcaggtggacagaggggatgggctcggggggaggcggggggacccgcttgaatgggagtcagcctgggggcatctcaatccctctgatgcctggtttgggtccccagcactacttagcccaccccactgagcctgtctgtgcctggcctggcactggtgatgcagggactgagtcaggcagggcctgacccagagagcccatgggcagacagtcttggtgctgcatgcccgggcttaaaccaataagcctgattctgaatgtccacaagctcttggctggtggggccacaggactgggacccaagcctcctagcgacatggctgaggccatctgtcatgggtccttctctcaggccacctggttccctgtgactcacttggtgttgaccaggtgcatggatgcagagctgagcagacagtccctgtgtccccagtctggttgggggtgcaggggtctggagcccatgtgagcctggtgagagcctgggaaggaaccactttttccatggcagagctgagtgcaaagcacgctgttgcactgctctggtggtggcattttactctgtaacctattcatccacatactcatgtatttctccacccacccattcatctacttatccacccattcacccatccatccacttatccatccacccatctacacatccatccatccacccacccacccatccacccgcccatccatacatacatccacccatccatcacttatttgttcatctatccatccattcccccatctctccatccacctactcacccatccatccaccatccatccatctattcatgcatccatccactcatccatccatccatgcatccatccatccatccatccattcacccacccacccatccacctattgacccatccatccacccatccatctacccatacttccatctatccacatacctgcccatgcacccactcatccatccacccacccactcacctatccacccatccacccatccatgcatccatccatcaatccacccacccacccatccatgcatccatccatccatccacccacccacccgcctcgtccctccgtctgaaggtctttacagaacagctgtgaagctgagatgctggggacccagtggttactcaggacagtcatggacactgccatctaggctgtgcttcctggcaggcaggagcagcgaacaggaccctttgcagatagtggtgtctgctgtaaaggagagaaaacagtgagagtaaaagagttgaagagttactggggtctcctgggactcttttccattctgagtcctgagcccaccgagaagtaaggcatgaaggcaggtgctggaaacccaaaacccttctaacaatgccaacccctccatcaggttgtaaaccaaagggtatctgagacaggtctcaataaatttaaaatacttattttgccaaggtgaagtaagggcctgtgacacagcctcaggaggttttgacgacatgtgcccaaggtggtcagggtacagtttgcttttatttttattttattttattttattgagatagagtctcactctgttgctcaggctggagtgcagtggtgtgatctcggctcactgcaacctccgtctcccgggttcaagcaattctctgccccagcctccccagtacctaggattataggcgcatggtaccatgcatggctaagtttttgtatttttagtagagacggggtttcaccatcttggccaggctggtctcgagctcctgacctcgtcatccacccacctcggtctcccaaagtgctgggattacaggcatgagccaccatgctttcttttatacattttagggggacatgagacatcaatcaatatgtgtaagatgtacatttgtttggtcaggtaaggcggggcagcttgacaacttgcgggggtgggggacttccaggtcataagtaggtaagagacaaactgttgcattctttcgagaccttgatcggcctcccactgaaacacaatttagtctggctcagggaatctgtatttttatatcaacaatagggcagaggaagccatcagatatggatttgtctcaggggagcagagggatggctttgggtcctgtctgtcatttgtctacgaggaatttccttctgggcaaattttgagggaggtggtggctttttagtctccgtagccatcttattcaggagtggactgggaggcaggtttgcctgagcagtacccagcttgactcttcccttggcttggtaattttggggcctgagatggattttcctttcacagggtgtagcaggcttagtgccagggcccagaagacttttaggcatcaggaaagtggtttaatgccttctaaaatcagaataaacacagtgcagcctgggctatagtcatctttctaccaacgcagttatgaaacatcattggtaatactttagcccagaggaggggcccacagaggctgtaatgccaggctgcccgctattcccaatggaggctggtcggaggacgtggctcagagtgaaggccaagggggccttccctgaaccccagagtggaggggccacctgcccaaaggcgcagcccaggccagcctccagggagcccccacctgttcagcagagcaggccacccctgcaggtagcagcggagagtgagctcagcctgccctgcagaccctgcctggatttgccaatccctccctgcgtgggggtgggtgacaaatggtgggagagaggcaggggtcagagaagtcagttttctccacgtggaaggaggctcgggagttggggaggacacccccaccttccccggccttttgttgccctacccaagggcctcgtggtcacacttgtggtgagctggggggccgcccctagggagaggagaactgtcggggtccccttcatgaagccactcccaggactgcagggggccgtttgggtttaccccccatgaaactgcctttgcaaaaattataactgaggaaatgatgacagtgaaagaaatcagacctaaccgactccacattccttctaacctttaagctgtccttattcatccctgggcgtaggccgaactaactttgggaagtaattcagttcatggtttgactctgaaacaaaattggtaacagccctttcccgaatagacccccttcttgcctgaggaccagtcggcctttgtaggactaacaaattagctgcaaggttagaaattatggtttaggggtcttgtggcctccggctgtgagagtctgaacctccccaaattgcttctggggatcacctcactattgtaaaacctgagatcagtgctggggatattctgcagaccccgcactcatggatcagctgacaccacctagaccagtcatctggctcaaccagttccgccatcccacccaggaacagaagacagcaagaaaaactcactttgaccccctatgagtccatctccaaacggaccaaccagtattccccactttctgagcccctacctgccaaattatctttaaaaactctgatccccaa

SEQ ID NO: 1403 - DNA, 1006 bp, Homo sapiens
ggctgctgcacggcagggctgcactctgccagggagcgtcctgtgagggaggggctgcactgccactttactgatgaggaagttaaggttcagagagatgaggtcatttgttagaggccagacagcctcctcagcccatttctaaggttgtttctgtggtatttgccataaagccataggttcattgatttgttcttaagtagttctgagcccttcctgcatatcaggcagggacaaacaggaaagtccctgcctttggcaagtgcgggggaaatgaaatgattctgctcagcctcatccattggtctgaacaatcacgtctcatgaccgcagggacacggcttcccctgaacgcggatcctagaggccaggcagaagcagcatgggtttccactcacacggtaggcggctgtgcaatttcgtctggagtccccagacccctcctcatccttcccagggttgctctgaggccattccttgtcatctaggaggggtctacataaaagcatttataaacacctccaaatgggagccaggcgtgcccacctttggagcacttttctctactgcaaatttatctactgctcgtgaaatctctggatttaactctgatgaaagactggaggctgaaggagaacttcaatatcatatattttaaaggttgattcacagtttggagcaagaattaaagaaccacgaacttcaagtctggataaagtgcttcatgcctgtaatccaagcactttgagaggctgaggcgggtggatggcttgagcccaggagtttgagaccagcatggaaaacatagagaaaccccatctcaatataagaagaagaagaaaaagaaaaaaaaaatcaaaaacgaaaacaacacaaattttagagtgatgtaaaattctcaaacaatgagatagataaaaagtacgcagccaaaaagttcaagaagaagtgttatggagatggagcaggcccttcgtaaaaacacgatgttggttttctggatttt

SEQ ID NO: 1404 - DNA, 3938 bp, Homo sapiens
ctgatttcagtgggttcttaggtagagtcataggattaaatcagctcatactatgagttaataattcctgacaggggctaatggtgattacaagtctagggtgtttgcataagaagaacaatgttctactgaagaaataaatctttcatggtgacatttcagtggctttgaatgagaacccttccagtgtcattgtgaccctgttccagcgatctacctcctgcagcctccttggagtttgggccaaggttcttttccctcaacactgtggccagttgttttaacttcactacttgggatggtaattggcattaggcgttttaccaagttctttaagcctttcttaatataacatctgaattgggagatagctcattgtggcctgggtgctggacttttcatattaagtcctgtcttagccaagggagaagaatgtaaggataagaccaccaatatcacaggggctgtctgagcctttacctgtgattttctaccactctgtggccttctggagcaatggacaaccaagtcagctatgcagttcataaaagtggacctggttatatgtcatccaacagcatatggtccctgcaagcctgtttggaagccaatattctataacctacaggaatccactgaatctgatgtctttggaagcaatatattttccagggttccaatggactacggaataaggcaacacagggcctgttttcccgcagtgtcctctgctccaaggaactttcttaaggaagcgggacgtgtcaatgaggtacctcccggggttctacagttcctcctgcccactggccagggggaatctggcgggagcctctcggtggatgctgtcacatgactgtgccttctgaaagaacatctgtgaagagcagtttctggtgtccctgagtaacccttttctaacaattcagccagtgtatttcctccaagagtagaaaacactggcttggaaaatctagtgaattttcagcttcttgtgaatgtgtatgaacaaaccaacctactcggtctgtgaaattctcgctaattcagatgggacatgggcaaggcttctaatactttcatcccatgaacataaattttgatatttcagctgcagattttttcaaatatacaatgacctgaggccaggaaagttaccttgtcaatttattttcttataatttgcatgtcttataaaagtagactacagcaggcatggacaaaaacagaacaaaagtctaactgattgaaagcttattccatagagaagacattgggttctagagacttacaggctatgcttgtagtttctcatatttaccttccttttgttggaaaatatagcagaaaatagagtggaggagggtgagaaggtgaggttatttgtgtgaagaatggttaggatcagtttgtttacctcctccccatccgtaccactttttggaacagttatctgtaaatataaggataaagtagtctgaacctgggtacagaagaggagaacactaacaagacaggcatctgatggtaataccaacagctttttccccaaacctaagttacaactttagtgatcattatgttctaattgttatagaaaaataaaatgtgaaaatactagttacaacatcccaatgctttcctctattgaatatttaaaaatgtttctgaacgtgaactttgagttttcagatatgattttaattgtgtattgatatgtatttctctaatctacaaccaagcagttcaatttagacaactacttacaggcacttcaaacatttcttgtgacattgttaaaaggggcatagcttggaatcaaatgcagtctaattaggtgatatgtgtggttcattttggggaaatctgtgagatgtctaacagataaattattacttaggagtatattcagattcttagcccagcacattgggtccacagactaatggttttcatatactttatccaatatttaattttatttgttctgaaagttttaagcccagtcatatatctgtgaagtgactatattaactataaactatgacaaatgtgagtgcatatattataatcctaaagcaggtgggttattacctatagcatgagctgtaaccatctagttaaatgagatcatcacagctctctctgccagcaatttcctgtttccaatggaagacaaggataccaaaacgtctctttcgttttcagtccattactagattcctctggaaacaatcatcatctttattttatgggttaaggtaatgttaatgtcacttagaattctgggtgagatatgataaaatgagtatgtgacctggattaaaacatactattaccagaccacaaagcgagtccaagtctttggaagccaacacagttctaagactatcatagaagagaactaaggtcccgtagcctccaaggttgtgtacgtctgtattcccccacccccttttttgtaaaggccagtatattaattcgttctgggaaccaagactccaaatatttcctctcagcctcagcctgcccttccattagtgaaaaataaagatttctgcacattctactgccacgtacagctctgaaaactaaagatggtgcaaattctgtttggaggctcctcccgcatcagctttgggctcatgctcaagaagaatctccatccacacggcacttgtccagacaggaacatctcgaaaacgttcttgctgctgcacattaccattcgcatcggtctataaatacctggccctgcatctcattctagaagggtcccgacttcagcttccagaaagttatacaaacacccacggtgactatcacagatcttcggggctttacacgcgaagtggggatacacagtgcagtccccatgtattttaaactgtaactgagtgggtatgtcaagcttatgcactgaatgttcatgaagctgcattgcttcagcacaaataaaacccaaaatgtcagtagcagatgccaggtcagttctacatgcaatgattttggaagaaacaacataggcagccatctcgccataaccttctgaatagaaaagactctcacgttcttcctgcacttgggctcagttacacacttcctgtcccttgagcagactgtagccccgccaccccccaccccccaccctgaaatacccttcctccatcccctctctctcagctcctgttctggaaagtgatgcacacctgaggctttaggctaaaatgctcacacacgctgcaggacaaaggctgctgcatctcacatctcctggagaccagaaattgccagggacctgtcacagtcttccccaagaaactccaggcacacgagttaaatgtgaaaatctcccagaggtttgccttactgtatttcttagaggggccacaggaccttccctcatgctccctctctgcctgcaaggacttcttcctccccaccccaagtcccagcctcacacatttagcccagttaagaccccatcctcaagtcttgctccatttcccaataaagccttgtgtgaactctgattaaatcagtggaggaaacctgaaagtccagaaccagatgcagccaagcgtgagaagtttaaagatgaagaccacagcatttcaaattgtggggggaggggcagggaagactattgggatagatgactgttcatttgcaagaaaataaaggcaaattcctactttatgtgatacataaaaataaattccaactactccgaagatctaaacataaaattagaagtataaaattaatggaggatataaaatatttttataacctggaaataggaagtcctttttaagcatttcaaacacctcagaagctgtaaaggaaaacaccagtggatcagatttcccctaaattaatttttttcaatataaaatacaccatattaaagttaaaagcaaatgacgggccaggag

SEQ ID NO: 1405 - DNA, 630 bp, Homo sapiens
aggagctacatttaaccatccgcgctagacaacagaaacagacaccggcacaggctgggccagcagcatggcccgctcacacctgcctctccaggttacacagttcaggatccaagtcctgtgcaaatgcatctgactggcgaacagaaatcccatcaagaacagctgcagggagactggggtcacggttttcagctcctggccactgcggtccaggaaggccagccagaccaggcctaagccaatcccccacatcctccatgaggggacctgccaagagcgtccaggactccgcgccgccctccgtgctatgtgctgtggggccagctgcctcccagccatggaccacacctgctcagagttccttagaagccgggctccttgccttgctgccttggctctggtgacctctgcattttgcagacacccgggaggagctgcccaagacggcagccccactccagaccctgtctgatgggccgtgcacgtctgcacattccacagaatgtgaccagctgtggagctcaatacaaaatggccctctgctggccgggccctgacttcagcctggacactcgtccccatgtcctgcccagatgatcactgggcagagccggagattcctggctg

SEQ ID NO: 1406 - DNA, 630 bp, Homo sapiens; identical to SEQ ID NO: 1405

SEQ ID NO: 1407 - DNA, 2035 bp, Homo sapiens
cagttcgagactagcctggccaacatggtgaaaccctgtctctactaagaaacaaaaatcagccaggtgtggtggtgggcgcctgtaatctcagctactcaggaggctaaggcaggagaattccttgaacccgggaggcaggggttgcagtgagccaagatcacactactgcactccatcctgggctacagtagagcgagactccatctcagaaaaaaaaaaagatacaactataaaagatacctcataaagaacacggattcactaggaagaggcgtcattaactgtgcccttttagaatattttgtccattaacttaaatatatttaaaaccaactaattggctggacatggtggctcgtgcctgtaatcctagcactttggggaggcagaggcgggtggatcatgaggtcaggagttcgagaccatcctggccaacatggtgaacccacgtctctactaaaaatacaaaaattagccaggtgaggtggccataggcctgtagtcccaactactcgggaaactgaggcaggagacttgcttgaacccaggaggtaggggctgcagtgagctgagatcacgacactgcactccagcctgggcaacagagtgagactctgtttcaaaaaaataaaaaaaaaaaaactaatttatgtgcttgcaattattagtggtctcttcaacctatagcttcttggcagtagtctttttaagctccttgtccattttataatggcatatatgccacataacctggccttcacattgtagtaccttacaaattacagcaaagaaggaggcactgtcatgcaacatattaaagtaacataaaaagtatcaagaggccaggtgcggtggttcacatctgtaatcccagcactttgggaggccaaggtgggtggatcacaaggtcaggagttcaagaccagcctggccaagatggtaaagcctgtctctactaaaaatacaaaaattagccaggtgtggtggtgggcgcctgtaatcccagctacttgagaggctgatgcaggagaattgcttgaacacgggaggcggaggttgcagtgagccaagatcgtgccactgccctccagtctggacgacagagtgagactccatctcaaaaaaaaaaaagtatcaaattaagtacagtagcagagtatagctttatctaatactatgcactgagttacataccttactttttggagggtcttctaaaaccttgctataatatgagaggatcttgattttctacaactaagtaaaagataacatgctgctccattttcttaaatgatgaagggatggctttcctaacatggaacacttaacagatgactaccattatacctaaatataaaagatggtaagaactgatttccagaaggacttcaaaggattggttcggtgaaggaaacagagtatatcatgataacatactatacaattcaaggaagatatctgacttcctttcttagcagctctgctgcatgttggttcctagtgttgccattattaactgacaatcatagaatggcttctgcttgcttcacaactgaaactaggagggcggaggggaggaggtggcaagaggggtaaaggcagtagcagtaatgatggaccggttaataagagactctgagtgtgatgtaaatagtatgtttattaaacaatagagcccattggaatttttttcttccacgtattgttagatgtaaaacctgatacactaccatacagacaggtgattgactagaccttgtttatgtagttctaatgtggaatacttagagttgttatgaattacgattatccataacttttgaatctaaaaagctggctacacaacgtattttgttggaatctttttgtaataccaaatgtctacactctttgatctagagaatcacaaaattttagaaacatcactacccaggttaattgacttttttattgtttactgtccaaatacctgttacatattaatagtattctactttatatacctgtaataaactattcagggtttctt

SEQ ID NO: 1408 - DNA, 3210 bp, Homo sapiens
gggcttgaacttttctccgttcccacagactgtatccacagagcggtgctcttgccttgaaaggaaggatttgccccggtttggaaggaagtggaataaatagaactggaaatggcaaggtcacctttaatatcatatgaactgcctattaacaagcttcacaattgctttgtttcttcctcctcccgtgctataaacaggctcaggcagagcaaactcttggagcacacacagtgtggggaggaagctctcagagcagcaaggaaggagaggctgcaggctcaacagggcccatcaagcataccagggttacaattgtgttatggtgtggtggccaggagggaaaaatgcttgtttttcaaggaaggaactatattgtcccaaattcctgtgtataaaatataggacaaacaagttacagtgggaatatttaattggagcatgtggaatagatggaataattgcctttcacttggcttttccctgctctaagtagtatcacatggtggttacataaagacaaaaaagttattttaagaacccttctccttaggaccctgtttagttggtattccaaacacacagagcaagctcttcactggcattctgcttgacagatttttctttctttccaggctccttcaggcacattctgttgggcttccctctacctccccactctgctgcttccccgctctttttgaatttctccctgttgaggagagggaagaccagctaggaggtatggaaaaggcactcacgaggtttggaggacaaagggttaggcaacaggcaggtctggaatttcagtgccctggctttcaggaattcttagatagtccaatatataaatcatcttggaagatcttttgggagcagcactgtcattaaaaaacaaacaaataaaaaacaccaggctgggcctggtggctcacacctgtaacctcagcactttgggaggccaaggtgggaggattgtgagagccccagagttggagaccagtctaggcaataaggcaagacccgtctctacaaaaaataaaaattagcttggcatggtggcacatacctgtggtcccagctactcaggaggtggaggcaggaggattgcttgagcccaggaggttgaggctgcagtgagccatgttcacaccactgcactccagcctgggtgacagagcaagagcctgactcaaaaaaaaaaagaaaaagctccgtctctactaaaaacacaaaaagtaactgggcttggtggtacacacctgtaatcccagctactcagaaggctgaggcatgagaatcacttgagcctgggaggcggaggttgcagtgagccaagattgcaccactgcacgccagcctggccaacacaatgactctgtctcaaaaaaaaaaaaaaaaaagcatcactaagcttcgagtcaaagagaaataatctcatatggcttaagtgcggataatcaaaggtaacataaaccaaacaaaactgagttggtatttgtgaattgttatttatccttctctatggattctgcacattcagtcaaggtgtttaggaaaacctcctccctaccattttgaaagtgtcatagagctatgaactgttgtaatttcaaaagtgcaattaaaaaggtgtaagaaagatacagtgagtctctaaggggtagaaagaaaaccctaaagggtagtttctatcaaatataaattttggctacttctttacaattctaggatgatgtgagttctcatcattgcagataatgggtcagagctgagctgttgtgggaactgctagatggagctagagttgtcatgtggccaactattttgatctgtggctaacatgtaatatcaggagattctgatctctgtctggtagatgtgttaaattaagtgtctggggagtagacattgaggcatcagtctagaaattcaaacagatgtgctctactaaaatgctatgctagaatgaacctgaccaagctaatcatcctctaaagtgcactacaatagacagaagacattttctcctggactgtacaagggatagggtcggggaggatgagctctttcctttgtcctctgaccacctagaacagcatagctaatttgctttgtctagcaataagaaatctcacaatatatttagcagcaaggttgagtacacacatgtgcacacatacatgcactcacattcatttcataccttaacattttttttcaccttttaaaaaatatgaaagcagaggatctggattgagaaacttgccatgcttttctctcagatgttctcttttctctgaagacagcaggacctcatccaaagctctgtttctggcaggaatctgacaccacttactccttgggtagaaactcccccaagtctgaactatgtgattgcctgagccctgcttcttgttcattaagactgctcctctgaaacggaattgatgaatttttagtggctattagaagcatttgggatccataggcatcagggtttgatgcatggccctcatctctgtgggctcctgtgcaatgattctcatctgtcttagttagaaagtgaattaatcttgaccttggcctcaggggtgtggttctctgccctcttacacatcttcaattcgcttctttatcagaagcacttgttttaggcccaggctcccccaattttaatgacatttagacatttgtctttaagttacattgctttgattttaatcaaaatctatatttctagtattatatgtttccagaaagttctcattctggattgtaatttaattacatggatcattaaagctttgaaggatgctaatgggcagaaaaaagagacttaacaaaacgaaagttattattaggaattacaaatcacttaacatttcaacatcactcgtcggatgtgggcattttgttgaaagagaccttgttttgaacagtgacagtgcagaagacctatggaagaaacaagcttccaacttgatttctattgttatgcatgcatagcaaattattaattctattctaatagggtaatagatttagaaatactattagcagaaaacttgatgtattaggcaatactacataccacattagtctaaccgctcaactgtaatttttcatccatactttcttgggatgtaaataaaattgatattatacaatgaaaataaaattgcccactagtcttgcttattctcttgg

SEQ ID NO: 1409 - DNA, 2984 bp, Homo sapiens
tggttatatcttttttttttgagattttgttttcatgttgggtgggtagtttttctaagaataagaaatcccaatgacaacaaaatgtcattgtttttaagagaaggagataaatacattttaaactgttatatttatttattttcaaaaaatgctggaggcatcatgttagcaattgcaggggataacatgaatatgacaaagctgctctcaaaaaacttaccactttgtagaagggaaagctaagtgcctattccaagcaaaatatgatatgatacatgcctttagagaggagtaaattttaatgaggcttcaaagagctggaagaagaggtcaaggttcaaagagcctaagataaggcacagaactggggttctggtacaatgcattacagcatggccaattttcaaaggccagctgttcccagtcaaacgaagatgaagctgagggcaggtgcaatcaatgggaaaatcaggccaccctctcctattttcccatagatgcagtttcatgatcaatagttttataatctcattttgggtagcaaaatgaaaatgaatctgaagcattctttctagtttatttcacactaataaaatccaacctgaaggattttatatgttggctctatggccgttagtatttgattaaggtgtttagcctcattagtaatcaaaggaatgaaaactagaataaaaattcagtcattgtttttggtttatcaaattgataaagacttaaaatggccaccaagcattggggaggttaggagtgataggctctctccttctatctatggaatattccttggctcaccatggctggagaacaatccacatccaatagctcatcaagtctacttccaggaatgtattccagaggaatagtatggacctatgcaaaaacttgtgtacaaaattattcctcagagctttgcttattattgggaagaatgagtaaagaaataaatgcccggccaggcgcggtggctcatgcctgtaatctcagcactttgggagccaaggcgggtagatcacctgaagtcaggagttcgagaccagactggccaacatggtgaaaccccttctctactaaaaatacaaaaattagctgggcgtggtggcaggaatctgtaatcccagctactcaggaggctgaggcaggagaatctcttgaacctgggaggtggaagttgcagtgggccgagattgtgtcattgcactgcagcctgggtgacaagagcgaaacttcgtctaaaaaaaaaagaaaaaaaaaaaagaaagaaagaaatgccccgaaacaggttaataaatttaaaagtattatgccaggaagggaacagtagcagtccactatgcctagaaactaagcctagtaacttagaaaaaaaaatcttccaagtgttttaggtaagttagtattaataattctacccaaggtcaatcccctcccctccatttcctcctcttcagatattctgtgcttctgccaaataggacaacttgctatttgtgtcctgaactgaccttatacactttcttgcctctctgcctttgctcgtgctttcccactgtctcaatggctttccttaatctctgaggtctcacctcttcaagacccaattgtgtaagccaccttacataatgttattatgatgtcccccttcctcatccagccagaaggatttacttccttctctgtatgctcatagcaatttgttcattttctattcttctcacccttgtcctgtgttagagttaccgaaatatatgtatatgtgtgtgtatatattttttgtcttgttttgttcctgttagattttgaacaacttgagggcaggggccaatcttgttcagatttataccccccagagttataaagcatgctgtgaaaatgattgttgactgaataagcgagtgagtgaatgcaaaagtacacttggagccaaatgcttatattctctgcagacatggaataaacttgacaagtgctaaagatgctctttgatttttgtgtggcatgagacctcaggctgaaacttctcatctgagccattgaagggagcctctcatctctccaccgagaggggagaccagaatgctctgtttctggcaggaatctgacaccacttactccttgggtagaaactcccccaagtctgaactatgtgattgcctgagccctgcttcttgttcattaagactgctcctctgaaacggaattgatgaatttttagtggctattagaagcatttgggatccataggcatcagggtttgatgcatggccctcatctctgtgggctcctgtgcaatgattctcatctgtcttagttagaaagtgaattaatcttgaccttggcctcaggggtgtggttctctgccctcttacacatcttcaattcgcttctttatcagaagcacttgttttaggcccaggctcccccaattttaatgacatttagacatttgtctttaagttacattgctttgattttaatcaaaatctatatttctagtattatatgtttccagaaagttctcattctggattgtaatttaattacatggatcattaaagctttgaaggatgctaatgggcagaaaaaagagacttaacaaaacgaaagttattattaggaattacaaatcacttaacatttcaacatcactcgtcggatgtgggcattttgttgaaagagaccttgttttgaacagtgacagtgcagaagacctatggaagaaacaagcttccaacttgatttctattgttatgcatgcatagcaaattattaattctattctaatagggtaatagatttagaaatactattagcagaaaacttgatgtattaggcaatactacataccacattagtctaaccgctcaactgtaatttttcatccatactttcttgggatgtaaataaaattgatattatacaatgaaaataaaattgcccactagtcttgcttattctcttgg

SEQ ID NO: 1410 - DNA, 875 bp, Homo sapiens
ctttgtttaacattccaaaggcgttcccagtgtcccccagagtcctcattaattacctggagaattaccaaggggttcttggacaggatgagagcctccttccactgcaactcaccacccctcatgacacttggatgacgaaaaacagcacttgatgagcccgctgaatatggactccaacggtgccctaggggatggtggagccaccagatggaaggagcctggtgatcccgagaaggagagatgcctcgctgacctgaacatctttccagaactgttaaatgaagcctgcaggacaccagctgacagtggaaggactgaggaaggttgtataattttgtgcaaggtccaccacaaatccagctgaagaactgctccaaagtttaggtcatggcaagaacaagactggatcactccatgtcagtggaaacatgtccaccaacttcatcattgtctgttgtcatggttcactttagatgtaaacttgactggattaaggattccctaaagtgtcaggcctctgagcccaagctaagccatcatatcccctgtgacctgcatgtacacatccagatggccggttcctgccttaactgacgacattccaccacaaaagaagtgaaaatggcctgttcctgccttaactgatgacattatcttgtgaaattccttctcctggctcatcctggctccaaagctcccccactgagcaccttgtgacccccactcctgcccaccagagaacaaccccctttgactgtaattttcctttaccttcccaaatcttataaaatggccccaccccatctccctttgctgactttcttttcagactcagccctcctgcaaccagttgattaaaagctttattgctc

SEQ ID NO: 1411 - DNA, 2408 bp, Homo sapiens
agaaaattgagccaagagctggaagccagaagttccccatgcctgccctacacatccaggctctgagtttttactttttctactatattgccatgcaagtaactttaactttgcttctctgttctctgtcactgagaaataccatgtctccatggcaataggaatgcatttaccttcaccaaacctgctcaaatccttgctgaacaggacgtagcaggagttgactttccaatggtggaggttcagagtacagcctgtagccacagagaaaagttgcttgttcctgaaatgcagacacacctccaatccagagagcaagtcatctcgtggaggaagtggtagctgtaaaaattcaaatggaaaaggcatagagacgaagtcttgctttgttgcccatgctggtctcaaattcctgggctcaagtgatccttctacttagggatcccaaagagctgggatcacaggcgtgagccaccgcacctgaccacacaaagagttttgaaccaggaaggaacctggagaaattatgcagcagtggacaaggtgctgtttataaaccagcccagctttggctcaggacaagccacccatctccaggggctggcgtgtgtgcctctgctgaccgcagctgctgacctgtctcctgtacactctggatgctgtgatgcccagacagcaaaacttcttttcaggctccccaagaaggcagggaccccagttctctcaagagctaacattagagcaaatcagtctcaagagggagtcccagaatcaagaggaaatatgggcttgctccttgatcctggagtagagcacatcttccctgcctgcatggccatgctgtgaatctgcagctcagaagttggtctccctaatgccacactctggaaccatgtcagccacatgattgtggcttcccgaggccacggcgtgtgcactctgcctgttcatgttgtgttttcctggtgactccttcctttgctattcagtaataaggctgatctgccatagcaacgcccacagccaatggcacctgcacagtgcgttccttctctactccacaatatttccttaaagaaacacacacctggaaattgaatttctggaatgattcccagatgctttccagaggaagcctggcgacgtgggcaaatagccctttattttccaccacgggaacaaatatttctgatctttctttagtgttggggctgcatgcaataaatactcaggtgacacttttctgggtggcagtggtgagtgatgggaatgaggctaaataaatacttgtcagtttgtgtcatttccaccagcactgagagggtgactgtttcagtatccaagcggaaattgtggactcagggcaaaaagacagagatgaaaattcagtagttatcttcagagggaaagaattttaagctgtggggatggataaaatctctatggaagggaaaaaaagagagacagacagatgaaaggagatggggcctttgatcatataattcattgcccaaactggaacaactttgagagtgaaaggaggtcactattaatagtgacactggggcctcagatgtaaactaggattgtcttgggcacacagggacttatggttgccctaatgctagggtcagtctattgaaggggccaatgatgatagcctgacccttgccacagccctgacacttgccacataacagtagggagtggtaatgaggcagtcactcaatatagctcagaacataagaccttctggtagggtcttcactgggggtgggggatggtgcttcatgaactcctgaaacttgtcttcccttggctgccaaaggcctccctcccttctctcatcttcctctttccatggggatgagggaggtaccgtgaggccgggacacagatgtccatgtgctctccaaatgtcttgggggaggggagaaaactataactcttggaaatttgatagaattgtcaaaagaatataatcagctacatacattgtttaaccaaagttgtagttctatgataaaagataaaaattttcttttatgagaataaaatacctaggaatccaacttacaagggatgtgaaggacctcttcaaggagaactacaaaccactgctcaaggaaataaaagaggatacaaacaaatggaagaacattccatgctcatgggtagaaagaatcaatattgtgaaaatggccatactgctcaaggtaatttatagattcaatgccatccccatcaagctaccaatgactttcttcacagaattggaaaaaactactttaaagttcatatggaaccaaaaaagagcccacatcgccaagtcaatcctaagccagaagaacaaagctggaggcatcacactacctgacttcaaactatactacaaggctacagtcacc

SEQ ID NO: 1412 - DNA, 6854 bp, Homo sapiens
actgaggcaggagaatcaggcagggaggatgcagtgagccgagatggcagcagtacagtccagcttcggctccgcatgagagggagaccgtggggagagggagagcgagagggagacggagagtgagagggagacggagagggagagggagagggagagggagagggagagggataaatcttatttataaaaagagttcatatttctgaatatctccttaggattaattcctagaagtagatttattatgtcaaaaacgatgacagttctaaagaccttttacacatattgccaaataactttccaggaatactgcctatttatatgtctataagcagcacaagaaaatctccatctctttgtatctttacttacattgagtattgccacattaatacaaatcctggccaattaaataagtcaaaaactgtatccctttgatatttgaactgattagcaagataacaataaagagtattatcttactatgttacatatgaaagattattgcaattaaagtagtttttgctttgttttttaatagatatattatagatattgatgttattaagcctttttttttttttttttgagacagagtctccctcttgtctcccaggctggagtgcaatggctcaatctcagctcactgcaacctccgcctcccgagttcaagcgattcactggctaattttttatattttagtagagacagggtttcatcaccatgttggccaggctggtctggaactcctgacctcaggtgatcctccttcctggcctcccaaagtgctgagattataggtgtgagccactgcacccagcttaagtcttttaactttataatttattccttattttgtgctcagaaagccattgcctatcttgagataaggtaaatactcacctctacttcttgctagttgtttaaaggtttcatttttcacacgtaagtccctcatctgtttggaatgattttagtctatggtataggatataaatccaactgatttttttttcatttaattaatggtcccaatataatgtaaccaagtaatcttccttttctttatttgattgtcactttcatcacataatctttttcaatattcaatttgttccattttgtcccagcatcaccttgtttggcattttccaacttcatatgaaggttaaatatttaataaggcatattgcctcaaattatttccttgtaagttccatatgtgataactaatatgttgttatcactcctgttgagtttgaatactggtgaagtggaatgcttttttattttttattttttgtctatttatctatttgagataggatctcgctctgtcacctaggctggagtgaaatcggacgatcatagctcactgcagcctcgacctcaccgacttaagcgatcttccagtctcagccttggagtgctttttcttttcttttcttttcttttttttttgaagcggaatctcactctgttgcccaggctgcagtgcattggcacgatcttggctcactgcaacctccacctcctggattcaagcgattctcctgcctcagcctcctgagtaggtgggactacacgtgtgtgccaccactcctgactaatttttgtgtttttagtagagatagggtttcaccatgttggccagcctggtcttgaactcctgacctcaattgatccacccgcctcagcctcccaaagtgctgggattataggcgtgagccaccgtacccagacggagtgcatttccaaatgtgtatttattgaccacttgtatttttcatttgtttgttgtctgtccatataatttggcaagtttagggcactcaattttttttactgatttgtaatcacactctattaattgaacatagcacatggtttatctttgtctttattttaatttttcatagctggaatatttgacccacctataactggccgaatttctgcattaggaacttgctattattggagcatccattcttttcccactgatttgaaatgtcacttttatcgccttgtgtttataactctaagatcaggctgctgccattcatacaccacaaacctctttaccacggttttctataaggttgtgagtgaactggaacagtggcctttaacacatggtaaatggcatataagtgatagctcttattattgcactggctaaaagatctctccctttgtggttttgtttgtttccacttccccctttatttggtgagaacaacaagctcagtaaggctcaacctttgctctttgaatcggttcagttactcacctccctagaggcagtttagaaactccctcgagcagaataaatgaagctctcctaattctttgttttgatgtttctgcccacacccacactcctgacactgtcaaatattccagcctctgactttgggatcctaagagatgctgtgggatttaactgcggaggtgacacattcaatgtataatggtaacctgaaggggcactgatcccactgaactccttagctcccagcttaggaactgactgtggcaaatttcagttagcaagtacatctagcacagtgaaggctagcaatttctgaagtccttcagttcacttcccagcccctagttctgtgaattgcctcagggctggctcctaacagctgtgcctgggctctgagcttggaattttcttctttgaactcatacagaaaaatttacgtgttttcttttttttctgtcaatctatttccagatgctttatagctttcagaactatagctgagtacaatctaccaaaaacgtagtggtttaaaacaacaatttattattatcttatgagcctctgtgttgactgagtttagctgagctgttcttctggtctcacttctggtctctcatgcagtcatagatagcagctaggacggcagtcctctggaggctgtgctgcatggagacatccaagatgacttctctcacatgtctagcaacttgatgcttctccacatggcctgtctcctcatccttaggggtatctcatcctccagggtttctacacatgaccactttctacagcgtggtagctggatgcatacattatggtccgctttcatgagtgcaaaaaaggaaggtgccaggacttttaaaggcttaaatccaaaatgctacagcatcactgtcactgcattttattgattaaagtccacctgcaatatgggaggagactacacagaggaataagtaccaacaagcgtggttcactgggatcatttttgtataactatcacatcactttgttttggtttccaaagctgttgtgttttgggacgttttttgaaattacttcaaaaagatttagaggagaaaaaaatgaactcagttttaattcaccatcttaaagtgggaatccagtatttgttttgaaaatggctgtagaaattattttttggtatttgtgttattctctttttactatgtgcattgtgtaatacaacatatacaataatctcattttctaatcctgtcaacatcacttaattgaaaaaatatggttttctttgaaaataaaatctctcagaataagaatatattcaattctttaattcaataaacatttaaaaaaatcccttatatgctgggtcctataatcaaggtacagagtgactaatattttcaatttgattcaatgatcagtaatcataaagcattcttttttttaaaagtacattaagctcttattaaatttatggaactataggggtataaaggattttaaggcagtgttgtcctcagggagccttaaaataggaatagttattaaatgtaataaaaatgaacatgttgtgcacacacaaaagacattcttgggcccttatctaacaccacatacaaaaattaattcaatatggatcaaagacctaaagatctaaaactaaaaaacttttagacaaaaacatagcataaagattcatgacattggctttgacaatgatttctcagatatgaacaaaaaccacagacaacaaagaaaaaaaataaattggacttcaaaatttttgaaatttggacatcaaaggacactgtcaccagagtaaaaaagcaactcaaagaatggactaaagtatttgaaaaatcacatatctgataagggagtaatattcaaaatataggaagttgtaaaactcaacaacaaaaaaataaacaatttaaaaatgagctaaggacttgaatagatatttctccaaagaaaatgtacaaataaccaataagcacatgaaaagatgctcaacatcactcatcattgggaaaatgcaacccaaagctacaataagataccaccttacaccatcaggatgactattattattattattattttgagacaaagtctccctctgttgcccaagctggagtgcaatggcgcaatctcagctcactgcaacctccgcctcccagattcaagcgattctcctacatcagcttcccaagtagctgggattacaggtgcctgccaccacgcccaactaatttttgtatttttagtagagacggagtttcaccatgctggccaagctggtcttgaactcctgacatcaggtgatccgccaccttggcctcccaaagtgctgggataaaatagaaaacaagtgttagtgagaatgtggagaaatcaggacctttatgcgttgacggtgagaatgtaaaatggtatagccactatggaaaacagtatggcagttgctcaaaaaattaaacatagaattattatttgatctagcaattctacttctgggtatatacacaaaaagattaaaagtaaagatttcaatagatatttgtagatccatgtttacagcattgttataatcatcatcattatcatcatcattgctacttatgagactaaagaatctggtgatttcgggggttttttgtttgttttttgtttttttcttctaaatacagggtctcactatgttgcccaggctggattcaaactcccaggctcgagcaatcttcctgcctcagccacacaggtagctaggactacaggcatgccctcactgctcctggccacaacagcattactcacagccaaaaggtggaaataactcaaatgttcatgaacagataaatagataaataaaatctggcatattctcacagtggaatattactcaatcttaaaaggaatgaaattctgatacatgctacaacatggatgaaacttgaagacatgctaaatgaaataagccagacacaaaaagacaaatattatatgactccatttctatgaggtacctaaagtagtcaaattcaaagaaagtagtacagtgtttaccagggctggggagagggagaaatggggagctatcatttactgggtaagtacattcacacttacgtgcaaccaacgccatgtgaatctccagaacttttccttccgaaaaagtttgttccttcttcagaaaaaattctggagattcatatgggtgttggttgcatgtaagtgggaatgtacttaattccactgaactgcacattttttaatgattgaaatggtaaatttaatgtaatttatattttgctacaataaaaatacataagtgtatgtattcacacataagagtcaatgtacttaagtccactgaactgtacatttttaattgattgaaatggtaaatttaatgtaatttatattttactacgataaaaaataatttttaatgaacacagaaaatagtgataaatactataaaatgaggacaaataatcttttccagagttttcttcagacagcctgtctaaaatttcaattctattcccaccctgatacttcttatcttctatgtcagctttattttttccttatggtttattactatctaatattctataaatgtaactttatttttagtgtttgctttcctccttagaatgtaagctccaaaaaggtagaaacttttgcctagtttgttaattgccttaagtgaatagaacacatggtaaatgctcaataaatatttttgattgagtggataaaatgccaaaggaaatgagaggaaggaaaaatgacttcctgagcaattgaaggaaatctttaatgacaatgtagatttagcattgccattttgttcattgtgttctagttgttcggcagaatcattgcccctttcttcctctcttgctggctttttaaaaataatttaataactttttggcaggcatggtggctcacacctgtaatcccagcactttgggaggctgagggtggtggatcacgaggtcaggagatcgagaccctcctagctaacatggtgaaaccccatttctaataaaaatacaaaaaaattagccgagcatggtggcacatgcctgtagtcccagctatttgggagcctgaggcaggagaattgcttgagcccgggaggcagaggttgaagtgagctgagatcgcgccactgcactccagcctgggctacagggtgagactttgtctcaaataaaaataatttaataatttttaaaataatggtatgctttgattcctttctctttatcttttgcgtatatctaccataggtttttggtttgtagttaccatgaagctagtataacattgtatagttatactagtctattttaggatgataacaacttaactttgatcacgaacaaaagttctgtacttatcctcccattttatattttgatatttcacttaatgtctgtttatattgtgtatctgttaacaagttggtggagttatagtcatttttaatacttttgtgtttcaacctttatcctagagttgaaagtgatttacataccatcattacaataagttctttcatttcag

SEQ ID NO: 1413 - DNA, 6854 bp, Homo sapiens; identical to SEQ ID NO: 1412

SEQ ID NO: 1414 - DNA, 8184 bp, Homo sapiens
ggcctcagattgcccaagacaccatttgctcacggaggccaccatgccccaatatgtacttcccgtttcgggaccaccaagctctggggactggaatgcaggcagtggaagccccagattgacttaacctgttgacagatcttcagagaaactgctggtaggaggcagctggggaaggtggcgatggccagtgggcaggggctgagccgtccagcatccccatgtagcatccagaggggttgaggggctgggcttctgggatgtcacagtatctgagcccagagcaggagggagggaaccagggccgaggccaaggaggccactcacagagccagccctggctcaaatgcacctgccccagacccagccacaacagcccactgtcccccagctgggctagatgacctcaaagtttggagagtcagggacagggtctgcaagaaaaggagaagcaaagtgaacggggcccctctgcccctcaccctcaaccccaccccgtgaggccgtggaactcttcagggaggtgaatgggggcccctctgtccctcaccctcaaccccaccccgtgaggccgtggaactcttcagggaggtgaatgggggcccctctgtccctcaccctcaaccccaccccgtgaggccgtggaactcttcagggaggtgaatgggggcccctctgtccctcaccctcaaccccaccccgtgaggccgtggaactcttcagggagggcagggagtgaggccgatgccctgcaggccatgaggtcatgaccttacaggtcatcgtgctgtgaaggtcaggaaacacttacccagggatgggaagaagacgtctccggggcctggaggagacaggggggtgctgggctccgaaagcagatgccgcccagactcagaaggctgccgctgggccacataggacagggggtgcctgactttggcctcgggtatcccctgggcaggtggtgaggcttcaaagccggggttttcaatcccttgaatgttgctgccacagaaccagaatggaaggtcatctgtgctgtccggagcgtgaactctgccctccctgcccccagtttttctctcctccctttctctcacctacatccccatccccaagcctcagcagcatctccaagcaagaaggcaggagccaggcccacagagcaaaggccatgggctgcacctgcccacctgtcctgagctgagggcatcagggcccaccagaacagaccccagctcctccctgtggtctgaccatcaaccccgggcacagccaggaagccaaaaatcacagacacttctagaacttcagcctcaggaatttggggacaagtttctctttggtcaatagagttgatggcattaggatcgaacatccccaaagcctgtcttgagctgaggggaggggttctcttctcttcccagttgggagtgggataacttctgaagacccctgcaactcttagattctagatgagttgcaagcaggacttccttcaacctgtcttgaagatcatccctttcaaacacctagaggagctttgtgtttggtgttgcaggtaccggggcaggaacttgggttccctgaacacaccctccaggccaggctgcatggcagcttcctgcccagagcacaccaatacacagtccccatcccctctgcccctagacccagcccactgcaccactctgggacccctcagcctctgcccttgtggcctgcagcggcctaacagctttctccttggagttctctgcgggcaggaggcacagctcaagggctgtggctggggctgggcccgctggcctcctttgcatgtctcactgtctgccccagacagtgcttcctccctgtccccatcctggcccaggctgaccactgagacccgaaggtgggtgcatgacacatctgagcagaatcagagctcagcctgctgagtcggggtggcaggagaacagccaatctgcacagatgtgcaggcttcagcagcagatggcagaggctcttctgaccagctgctctaggcagctaaacagggcccctactgcacagaagtatctcttcctggatagccggcccaggaagttttctcaagaaggtctccatgggccttacctgtccatccgcaccagctcctgggcacctagggacagacagacagagaagctggtcatggaagggaaggcttccccatacaacatccctgcccctgctggcagatgccctgcagggaacaggagcgagcccaggagggccctgcacagctccggactccatttcttttcacatgggtgctgtccagcaagcgatctgcgtgtctgtccagcagatggggcctccatgaggggcccattttgacgactgataaatgaaactctatctgcattttccaggagtgtaagaacgctatctgccatcaggagaccaaaggcagccagcgctttctcctatggcttgacttacacagtgtcagaccttcaggatttaagtatcgagcaaaggtcaactcttgaatttgctaactggtgtctcttgtttgaacatttgccaggttctggtctttagccatgacttactgggtgggagtgtttaaggtcagttcctaattagagggctcctggtcctctctgtcctatcccctacattgcctaatagggtggcattctaggggacatctctcagggaaaccttacaaggtgcaagtccccgatcacttcccagccacttcactcactttctgcttctcatccaagttgctgccgcttgcctcagccttgggacaccccaccccccaaactggccaccaattagatgcagtgaccccaacttccctctttcatgcagcaccccatgtcctcccacagatgcttctcgttttaaggagatttactgctgattacgatggggaaacagatggtgggggaggggcacaacaacagaacaaacacagggaagttacccaaaagttcctgaaatctattcaaaccatggctattgcttacagccgactcatgggtcaggcttcgtgcaggtgcacacgggtattccctcatctcatcctctgtgccaccctttggggtgagggttgttggtcccattttagagctggggaaactgaggctcagtccaaagcaggatggaaatccacacctgttggcctctccagcaaactgccgtcctcaaggctcccagccctttccttttctttttttcctgagagtgcctcattcctgagcaggctctctgggccagccttccaccagggagggcacagcaacacctgctccccctgccctgctgcccagcgttgctcttctgttccaagccctttacctgcccccacccacccccagccatgggtattcctgcaggtaggttgtggtgtgttctaggagaggaataggggagttctgaaagcaagggtgaggtggccacagcccccgagtgacccactatggggcttcacgtgggggcccccgggaatgaggggagggagggatgacaagttgttaagggccggccacaggaaataagttgcgagccaaaagccacctggcaccagagcaatcctttctcagttacctctgtagccaggcagacgggaagaggccagggaggggaggcaagggtaaaaaactccctagccccttcttggaggactcagactaaccaagactcaagggcagggtcaggaactaggcaaggggcactgtcacctggccagggtgggaggtgaaagatgtttgtgcccatgacttaaagcccagccccaccacttatttgctgtgtggttccttaggcaagttacttaacccctctgtgcctccgtttgcccatcagtaaaatggggacaatggtaggaccaaattcttggacttgcaatgaggagtaagtgagagcatttttattatatggtggacttctattccctggaaagagcatgcgttgaaagctctgagattgagtcctagctctgccacttactaagttacgtaacattcagtcagttatgtaaccccactgatcttagccttctcatctggaaaaagaaagggttgagctaagttgtctgtaagaccccttccacttctgatattccaaagatcattttttgtcccaacaattgctactaattacaaaacaagcacgcccataccttaaacaggtcccccaaggatctctgagtggcagcaacttgcttttataaagcaacttgagctactgcatatgatcattcattcagaagacatgtattgagtgccgagccagcactgcctgggagccaaaggggctggtgggcacttggcccccggaaatggcatgcctcctttctctcggccatttcgcccagctcctggcgggaagtgcagctgctcccaactctcaaatgaaaaggaattgtgcctgcatcgtgcctttgcgaatcccaggggctgaactgggggctggagcaggtcactcgcaccgtccacccaccccaggcagggaggaatactcacggcggttggaggctgcctgcctttgcttgtagaccaggagcaggatgagggggaggcagaggattcctacgatgcaggcacccgtagccagggctgcagccgtgatgtctgaaagggcagagaggtagccaaggtgaagccccattcccattgctcctcctgagcataaactgaggctcagagagggaaggccaggaagcaggagacccgcctttccccagagtcccacagctagacccccagcaacctacagaggcatggaagataaggcggttctcctttcaaagagagccctgtgcctgccgccctatgcccctggagcactcagaaacaagacctgtcacctacagctcaggcagctccaggcaagagagggaacagagtcctcatcccagcccacaaggtacagctggaacacccttggctacaggttgttctctgaaaagggagagcagggccttcgcagaccccatgccacagagctcaaggtcaaaagaagcctaagtgatgaaagttttgaaaatagacagtggtgacggttgcacattgtgaatgtaattaatgccaccaaactgtaggcttaaaatggttgaaatggcaaattttacattatatatgttttatcataatagataaaaagccccaactcatcccagagactccttagctctgggatggggcctctagaaccccttgatctcaccacacaagtcacaggagaaacacccggggtgagaactagaaaaacgtgaatccttgtacaatgtttttcaattttaaacttattaaactaccaaaaaaagtacaagtttaaaaaatattcgaatctcctcctccccttgtaccaagaccccctctgaagagatcatccctgtgtgccggtttttgtgttatggtcctagttatattccctgcaaatacagcagacgcagcatcatatgacaatgcttttcccactgagcacagcttggacatctctctgtctcccctgcctcattctgcttagagttttatcacatggctcccactaaatttattgaagcagtcccctgttggtagacatgttgtttccattttcagcataactaataatgtagcaatgaacttgtgcacgcagcctggctcactcagcaaggaaatctgtagtaaattcctagcggtcaaagtgctgagccaaagagtatgtgcattttcttttaggctattgctaaattgccctccaaaaaggtgtacacgaagcttcgctgtcccaacagcatgaggaggtttgatttatttcagggcatctgctgactgcaggagtttagctgggaacagacgtgccctcagaaccacaaccaacataaacgcatttccttcccaattttagcctttcccagggccaaaagatgggctgggataccttgtcacagtgtcaacttcgccccaaagagctctgagaggtaaatggctgtggtctaaatgttgcctttccgctatttgtttgggaataaaggctgtttttgttttgctctacaatccgacagcgtaaacaagctttcaggaggtttgttcatactgcaaatgagaacaaactgttttcagtcactttagaagtacccactggtacaggaacagttgctatgctaattacaaagcaagttccgctccacattacagcaggttccctgcagatcttagcaaggctgcattttgacgtggaatattgaaagtaaagacattctataacccagacacctcagtatttcaaaacccccatcaaaggaccttattgtgggcaatatttgagaagccagttgcaaagcactctcttctagtgatcaaagcaggtctcctctggacggctagtaagcaacattttgtgagctttgccaggtgctcattgatacctgttccctatctgcctttggagggtgagcttggccagatatccctgcctaacttctatccccaggtagagatttcccctatgtggaccctctatcagatcaggacttaatttcactttgagagcctgaggcttccttacgatctgggctgagttgaggctggggcagaggggcgcagaggtttggggacaagtctgtggatccagctgctttctgaagccgtaggcatctctgcagagctcagcctcgccacagttccccaccccttcccccaagcgtggccagtgcctgggctggcactcacaggggaaggcaggcatactcactcaccatccagagccaggcttatcctgggaaggtgatcaggcgctggcagaggtagctgccgacaccgcactaaggagtgtgccaggccctgacacagcagggtgggatgggaggggcctggcctgctcaggcggcctttgtccagggcctgcctggtagcccacggggatatatggaggagggagttcggctgctgagggttgggctgcctggtttcccagggaggaagctgggtgaaagcagacagcacattctgctgcgctggggggtgggaagaagttcaaagggagatgagctgcctagaccccttctctgagctcactgagaaaccacagcccctcagcaatgcaggagctccttgggcaccaacttctctagtctcattcccctacctcaggttaacttgtactttcatgttatttcatagtcaagctacactcttacttcccaaggataacattaagaggctggcactggggctgggcatagtggctcaatcctgtaatcccagcactttggggagccaaggcgggtagatcacttgagcccaggagttcgagaccagcctgaccaacatggctctgaccaaaatgcatgttctaattttgctcttggcctgtttgttggtttgaaaaaagggtagctgagtaaaaagtcactgtagcctttgagttgggttttgttgggtccgtggtttagctgatccccattccggcttaggtcctcgtgcatgtcctcctggatgcctttgtatctccagggcctagcaggggctggtccccactggatgtctgacacatacagggtatagaggggtgtggaagccaagacctcttctcagaagagggaggtgcccttgcattttgtctccaagctgctgggtattctcacccaacctctcagcgccaggcacccttagggcagtgccctcttaccctgtagggcacctctctggcaagcaccggggggctaactgctacccactgcactgccccaagctgggaagaaggtgagtatgcagagctaagcaggcctgcagccagatcccagctatgctaccctgggctatgtgagcttgggcaagttagcatacatctctaggcctctctttccatggatacagagaagatggtgatgcctacttcatagagttcttataagaattccctgaggctaggcatggtggctcacacctgtaatcccagcactttggaggtcaaggtgggaagatcaattgagcccaggagttcaagaccagcctgggcaacatagcgagagtgcatctctaccaaaagtgatttttttgattttttgggacagagtctcgctctgtcacccaggctggagtgcagtggtgtgatctcggctcactgcaacttctgcctcccaggttcaagcagctctcatgtctcagcctcccgagtagctgggattacagatgcctgccaccatgccaggcaaatttt

SEQ ID NO: 1415 - DNA, 8184 bp, Homo sapiens; identical to SEQ ID NO: 1414

SEQ ID NO: 1416 - DNA, 8184 bp, Homo sapiens; identical to SEQ ID NO: 1414

SEQ ID NO: 1417 - DNA, 8184 bp, Homo sapiens; identical to SEQ ID NO: 1414

SEQ ID NO: 1418 - DNA, 1293 bp, Homo sapiens
aaatgcactctggcattcacacaggcacacactctgatggttcccacttgaaattgctcatcaagtgcaaatagctcccagcctggatggctgagctgctctccagcctcctctctctggagtaagaagatttcagcttgtgacctgccctcgggacttgtgggtgtacaaagcctgtgacccaggaaacaaagtcaacggctcactttgtccccaccccaccctaccccgtctccctcctactaaatgctgaatctcacgagagaagaaaaccagccacataaaggatttgaaagctcaacttgctttcccactctgttatccctggagttggcttggattcaccctgaagccttccccctcccggggaaagttgcttcacgttgcagctcagcaggtttgtccagctacataggctccagaaaacaagaagcaagactggaaagctggggatgattgtacgccctcgcctgaatcttacgtggttcctccttcttccacctggccagtgcagagccgtgggtgccacgtggccacttctggattgggttccccttggcctgccaccctgtccttctgctttcccactttgccagccagagtcaatttgaggacgccaagttctcctctccatacagagctcctggtctccttgtaacttgtaactcctgggcacagttacaagtgctgaattcttgcgaggatgaactcaagatacaaaatatgcttggcaactcacccctgagtggccacaggcacacgcaggagtcgaacccacccacctctgctgacagtcatgggtcaagctcaaagtcctggctgcttctctgctcaagatagtgtctcactatgttgcccaggttggattcgaactcctgtgctcaaatgatcttcccctacctccaggaaattgccacagcctccgtaaccttcagcagccaccatcctgatcagttagcagccatcatcaagacaagacccttccccagcataaacattacggcttgctgaagacttagatcatagttagcatttttaagcaatcaagtgttttaaaattaaggtatgtacattatttatttatacataatgccatcttacacttaatagactacagtatagtgaaaacataacctgtatatacactgagaaaccaaaatcttcatgtgacttgctttattgcagtggtctggaactgaactcacaatatatctgaggtatgcctgtatttcaggaagtctaacaaaaaccacgcatcatttgtctgtgggaagagggtatagtataattgaa

SEQ ID NO: 1419 - DNA, 1293 bp, Homo sapiens; identical to SEQ ID NO: 1418

SEQ ID NO: 1420 - DNA, 1970 bp, Homo sapiens
agccaacaaagtatgttttcgaggttaacaacgaagcacaggatagtacaagtggaagatcattaacatgactggataggaacctcttttaatttccctttcttggctttttccacaccctaggtggattacactcaccctgacacacctagaaaatacacccagataccagaattgcaaaattcaggaagaatgcactgcacactgtatccaggcaagccaagctcacctaaaaatggtctcaaaaagcaaagggctctgaccatcgactgatggggttgcaagcccagcctgtctgcaggaatttttaaatctgaaaccacactacagaaattattttatatattacttatttttaaaactcaactgtaaaaataagtgttgcaggaagagtgaggaagagggaatttaaaagaggaagttgggactgaatctattcgttccaacctccctaagcaatccacttattgatcagtgcttccaactcaaggaatatttaaaattttttaattaaagaaaaaattctatcaatcagagaatcttgaaggtagggggatcatttacaatcattttacaggtgaggatattgagaccagcagggagatgacctgcccaagcctgcacagatagcaaggaccaaagttgggatgagactcaaatatgccctttcagatgtgcttataaaaacaagtcagtgttcacatttactgtattaataggaatgtctttcagggggagtttacagaaaaaaaaaataaaccgaattaagttatgatgactatattttccattgttttcatttccttaaaaaaggaaaggctgttgaacttgtgagttctgcagtctatggttttgaagctaagttattacacacaagctaccttgtgtgaacatggaaagaccttgatatattacttctttgttacaatcagcagtaagtgccacttagcatgtctggctacttacagagtgaaataattgcttaggaacctagaactgcttatttaaagggtgggaactcaatatttaattactgaaccaaaaagcacctcagctttactgtgggaaatctcatgcaatgcactgttagccttcaggtggtttctcagcccaattcttcattactctccagaatcctctggaacttcccttctgttatgacataaaggtatctgtcttggtgaatctggatcaacaaggaatggcagatctctatactagaacaaggctgaaggaagcagaccatttctgcaaaataagagtttatctttgtcataaatactttaggttgacatggttctattatatcaggctcgttggtcccaggaggttgcatttttcctaaatgtgcgccgttaaggtattgtgtgattgaggaggggaagaaggctggatgggaaatcatgcaaagacaagtgcatgtgatatccagtatcttcttgaatgagctgtggtatcactttaaaagatgggatttttaacatttttaatgaccacttcaaattctccaccagccacggcatagttgtgtgggtttttcttttcaattttggtataatcacccagattacatttctctatgagaaacattcacctcgcattttgaaaagcatagaaaaattcactgccaaggactagctggccaacagtagccctagggagatatatttccgttctcccacccagcctctctgcacccatcctcacaatgacatacaccatagtggaagtaacatatgacttatggtgggaaaaaaaataacaaatgataaaatgggaaggagggcaaggggaaaatagagagactgctaccccaccacctgaatggaaggggaccccagcacaaggaggaggcttcagctacactgcacacatgtcccccgggtgtctgaacctgccagaaatctcttagtccattttcctctggttgatagcactgcagagaaattgtttaatgtgtgtctagggta

SEQ ID NO: 1421 - DNA, 1970 bp, Homo sapiens; identical to SEQ ID NO: 1420

SEQ ID NO: 1422 - DNA, 1970 bp, Homo sapiens; identical to SEQ ID NO: 1420

SEQ ID NO: 1423 - DNA, 1970 bp, Homo sapiens; identical to SEQ ID NO: 1420

SEQ ID NO: 1424 - DNA, 1970 bp, Homo sapiens; identical to SEQ ID NO: 1420

SEQ ID NO: 1425 - DNA, 1970 bp, Homo sapiens; identical to SEQ ID NO: 1420

SEQ ID NO: 1426 - DNA, 1501 bp, Homo sapiens
aagaaatgattcaaggtattcatttcaaaggctaaaccactaattcttcatccaaatgaatgtttccactgtgagtcaatacatttgccatcagttctttttaatgctatcctgaatacacaatatacacctaaaaacatgatagagtgctctgagaatagcaagaactgatagccaacatgatttacagaaatttatggctatgtagcaacggttcagagacaatctctagaaaatatgaaggtactcttcatgataggaaaggattggttttgcagggcagcttttaagttcatttctgattgtctttaaataaccactctacctttgtcccttgatctcaccccttgctaaaattttataaacatattccagacatactgcatgcaaaaagggaagtataagaatattaagattctcatgccctggacatgaatagaaaacagtttccagggctctggtgtagctatattttaggcatagctccaaggagcagcctacacaaatttggatggagcgagggaggcacagatggtggtcacgtgaaggcacagaccgatcgagtgggctcggctacaaagtctgtacatttaggctggtgtattcctcctgtttcaagtactgccaagtcccggctcttccccgtctttccaaagtcttgattcatttaattctcctgaaggaggtggaagaggaggagggttgcacaaatcttactctttcgtggtttagaggagacagtcaccatcttggcgccttgtcagattttaaatgtaacattctgctaagtgtaaagctgtgtatctgttccttttctgttgccattattgtaacttcaatatttgcaaaacacaacatcaaaatacttcaaatccagcccaaagcggttattcatgcaacacaattcttacacttatcaatatacagcgagctcatagcaaagggatcttttctttctttcttttctgtttagttctttctatttgtttatgattttttttccttggggacttaagaatgatttaatcatacaatagtaatatccccattttatatatgtatagtatatatgtgtgtgtgtgtgtgtatgtgtatatatatatatatatatctcctgacggttatactattataaagcttattacaatgtcaactcttacaagttgcattatttagaaaaaggaagcacagaagctaaaatgattctaccatttgaaataccctgtgaattactggtaaagcatagagcaccttaaggatatacagagtcttaatttttaaatataaaaacttgtagtgttcactataaaatgttgttgttaaagaaattcgggatgtgctttcagtggtgcctaattcacggttactagcattaactgctactttcttactctttaaaggatggactacaacattccagattctcagttattttcttctttgtgtaggaaactcaaccaaaaatcaaaatggattcagttactggctttttttttttttt

SEQ ID NO: 1427 - DNA, 1501 bp, Homo sapiens; identical to SEQ ID NO: 1426

SEQ ID NO: 1428 - DNA, 1501 bp, Homo sapiens; identical to SEQ ID NO: 1426

SEQ ID NO: 1429 - DNA, 1501 bp, Homo sapiens; identical to SEQ ID NO: 1426

SEQ ID NO: 1430 - DNA, 1501 bp, Homo sapiens; identical to SEQ ID NO: 1426

SEQ ID NO: 1431 - DNA, 1501 bp, Homo sapiens; identical to SEQ ID NO: 1426

SEQ ID NO: 1432 - DNA, 1501 bp, Homo sapiens; identical to SEQ ID NO: 1426

SEQ ID NO: 1433 - DNA, 515 bp, Homo sapiens
ctggaggaggagaaagtggaggaagcagctgagcctggagggatggggtcactacctttaaagcatctgtcagccatggggatctgatggtttttttattttttattttttatttttattattattattatttttttacaaacccttgtgtggagatctgactttcaatagatcgcagcgagggagctgctctgctacgtacgaaaccccgacccagaagcaagtcgtctacgaatggtttagcgccaggttccccacgaacgtgcgttgcgtgacgggcgagagggcggccgcctttccggccgcgccccgtttcccaggacaaagggcactccgcaccggaccctggtcccagcgcggggcggggcggcccgccggcggggaccggctatccgaggccaaccgaggcgccgcggggctgccgtatcgttccgcctgggcgggattctgacttaagaggcgttcagtcataatcccacagatggtagcttcgccccattggctcctcagccaat

SEQ ID NO: 1434 - DNA, 515 bp, Homo sapiens; identical to SEQ ID NO: 1433

SEQ ID NO: 1435 - DNA, 4865 bp, Homo sapiens
cactatttcattttatttttcttattaatataagaagacaggaatatcaggtctctgagcccaagctaagccatcatatcccctgtgacctgcatgtatacatccagatggcctgaagcaagtgaagaatcacaaaagaagtgaaaatggcctgttcctgccttaactgatgacattaccttgtgaaattccttctcctggctgatcctggctcaaaagctcccccactgagcaccttgtgacccccacccctgcccaccagaggacaaccctctttggctgtaattttccactacctacccaaatcctataaaacagccccacccctatctcctttcactgactctctttttggacttagcccacctgcacccaggggaaataaacagccttgttgctcacacaaagcctgtttggtggtctcttcacacggacgtgtgtgacaaggaacaccctccttgagcacagggggagggtgaatatcagaactgaatctgacttctgacaacataggagctgaagggaccttggatgttgggtaagcagttcccactgtctgtcacaagccctaataaaatacaagtaagagaaaagaacaaaactggggcaatctaatcaagaaaggctttctggaatgcatgaggccccagcgagatctaaaattcctagatggacttggtgttgtggaagcaagacagcagtcgggcaaaggagagacaggaagcaaatgaattctaccttgccaacaatgggaaacagacatacttaatgtgagtagagaggtagccttggccaggaaagtttgtttgaagatcctggtctgtcttgactttaaatcacttgcctttggaatggaagagaacagacatctcatcaaatgaaccaatctgaatgcaaggagcacccgaatccatccccactcaggaatcctggttacagatgctaaaagatgtctttgacagtgaacagtgggtcataagatctatttctgcctcctgtctgtgactcactggatgactcaaggtgaatctctccccatttctgagtatctggcccccatccatgaagaacagaagatcacatcagtatttcccttcggcaaggttggcccccgctgcagcaactgtgcaaagaccaccagactgccctctctgccagcttactcttcagcctttctggctctttctcccacttccacatccctgcttcatttttctttttctccttttgcaaatagcattgctccaaagcaacccaggcacgtgtcttggggacagcgctgcgagctacccctgagctgtggggagcaggcccaagattgtttgctattagcaactcctgtttgcaggataaataaagcgaacctgagtgcaggctcctgtgggctgggacattttcattctgcagcaggtcagcttccattccactagggggctttgaatgttaataggcatttctttccaggtacccttctcctttctctacagtgcaccagtccctgtgggaccttccattggcatcctacggagagattattactcttttcattgttttccttacaaattagtttctggatttaatggctttggttgctgagcagattttggaaattggggcagatggtggggtggggtgatctgcagagcccattatgggcactgggttattgactgcttgggatttaaggtggaattaacgctttcctgtttcttggggaattttgcgatggggttggaccttcttttcccttagaaggaattgtgtttgttgttattgcatgtttaagaagcttctagaaattgtagctctggaatacaataggtagagaatgcaggtttttaatgggatgtgggggagtgttgctcagttgtgggaagatttgtaataatggttgggactggggatagagcgttacctgaggacggttttattaatgccacaaagcataaagtttaaaaaaaaagaaaaaagaaaatccaggggtgtcttactgtcagaagctttggaaccatgttgaataggtgctgggtaaaatgagactgagacctgctgggctgcattcccaggaggttagggattcgcagtcacagggtgtttacagttaagggaacaggttaataatgtttaccaaacagacccaggacttaacagacccaagaaatgtcttgatgtcctgctatcttaagcacaaaagcattctttgtttagtaataaattttgctttaaagatagtaatatagattcttgcaaaagtcagtagttacacaaggattaacaatcctttgtcatgagcccttgtaatagaccacatccttttcatgattttttgccttgttatctcatatataaacatgcattgcacctaataaggtgggcgccttactcctcttgctttcagaaatgccctgctcagtccatggagcaaccattctttcattcctttactttcttaataaacttgctttcactttactctgtggactcacctggaattccttcttgtgcaagatctaagaaccctctttcggggtctggattgggacccctctttcataacactggtgctaggaatgtgagcacaagtgcatgccggaggagtggacaaaggtcattcagggaaagaagactgcagcatttgctcatggagaggagctgaaatggaggtgaaaaatccactatttctgctcatcatccctccccacatgcgtagttctcagctgattagcagagccttggatggaggaagaccatactgacacccgcctgaggaaatggcaggaccaagaggagagtgggcttaggttttcctcatcctataggagaggaagaatatcctgactgaggaaggacttacagtggggactgtgaaggggatggagtgggatgaggaagggaattagagaatggggaacattctgcccgaggcgttgccttctcttatgtacagataatggtagctctcctttatttgaggagctactctgttctaagctcttttacctggatggtcttgtttaatcctcacagtaatactaagaaaagacactattattttctatttccatttcatagatgagcaaccaaaggattaaaacaggcgtgtgcaatcatttggcgtccctgggccgcattggaggaagaattgtcttaggccacacataaaatatactaacactaacaatagctgatgagctaaaaaaaaaaaaaaattacaaaaaaaactcataatattttaagaaagtttatgaatttgtgttgggccatatttaaagccatcctgggctgcatatggcccataggctgcaggttggacaaacttgaattaaaagttcatgtgacttgcccaaggtcattcccctagcgagtggtggaactaggatctgtctgaggcagtgtggctctagaactcaatctctcaaactacacactacactagttcggaaatggagactaaatgatcacaaccttcagtgctccaggtctttctagctttggagaactttgataaagaattgcttcaaatgccatcagagatattactatagagtttgtgtttgcctagaacagaggtgtaaaaatgaaaaaggtaaaaataaataaaataactatacagtctgacgaagactggctaggctgtgttaggaaaggggagaatccataatcagtggtcatctgacacaccccaggtgacagctttgattacccaggcacagagaatgaccaaatgacaagtaatttccctgctatttggagatttggaggaaggagggatctgtcacatggattacaaggttggaactctggtgagggtggtgccagtctgccacatcacgtggcagtgaatgaggcttagctccaatagaggctcaggacagaaaaagtcacagaagagctaaacccaccttaagagccacccacctgtctactaagtcagggctcttcaggcaagtgcatgtgacagaaacagtcctgggcccaggcaggccttccagagaacagagatgtggacacctggaagagggcaatgaagggcctctgatcaattgttcaatacatttattaccagtggcaaatccatatgggtctgcagcaacctcaattcttgtctcctcagaaaaaagaattcaactgaggggtataaggcagagtaagagaccaaggtaagttttagagaagcagtgaaactttataaaaaagctttagagcaggcatgaaaggaagtaaagtatgcttggaagaaggccaagcaggcaacttaaaagatccagtgcacagtttgacctttgacttaaggttttatatgttggcatattttggggtcttgcatcccttctcccccgattcttcccttggggtgggctgtccacatgcgcagtggcctgccagcacttgggaggggccacatatgcagtgtgtttactgcagttgtacacatgcttacttgaggcattcttctcttgccactcaaatgtttctagaaggttattgtcaggcctctgagcccgagccaagccatcgcatcccctgtgacctgcacgtatacgcccagatggcctgaagtaactaaagaatcacaaaagaagtgaatatgccctgccccaccttaactgatgacattccaccacaaaagaagtgtaaatggccggtccttgccttaactgatgacattaccttgtgaaagtccttttcctggctcatcctggctcataaagcacccccactgagcaccttgcgacgcccactcctgcctgcgagagaacaagccctctttgactgtaattttcctttacctacccaaatcctataaaacagccccacccttatctcccttcgctgactctcttttcggactcagcctgcctgca

SEQ ID NO: 1436 - DNA, 2625 bp, Homo sapiens
gtgtctgttggtgaggtgggcggggtcagcctgcggtggaggggaagggccctagagccgtggggagaggcagcccgtggcctggagcagtggaggtgttaaccaccgaagggaggtagaatgtttttccccaccagaggaggcagcgaccacgtctcctctatggaggcattcaagagccgtccagctgaagcagcatcactgtctgagctcggaaggcacaatccacataggtctgcatggtccaccgagctgcatacccacggggccagcgggaggtgggcagctgctgggctctcttctgaagcagacaggatctcactctgttgctgaggctggatcacagctccctgcaaccttgaactctccctcaagcaattctccccactctgccttccaaagcactagcattataggcctaagccaccactcccatccactgtagtgtaaactgtctccttcaatgtttccaatagttgcggagcagatcagataagggttcttcctgtctgttgcttcaagtttcattctctctttaaacaatacaaggttggcttccatggttccttcttaaagaatgttgaagggtcttgctctgtcacccagtctggaatgcagtggtgccatcatagctcactacagcctgagctgtactgagctcgagggatcttcccgtctccgcctcctaagcagctgggactacaggtacttgcccccaggcccagataatttatttaaaaactttttttgtagagacagggtctcactatgttgcccaggctggtctcaaactcctggcctcaaacaatcctctacctcaacccccctaagtgctggcattacaggcatcagctgccatgcctggctacaaatcttaatgttttccccatggcttctttttctggcgttcttttctcaggtaatggaagtgggcagagaatgatcctttccctaggctccagtgtgtaagaattaaagaaagaggaaagaaacacaatggcttgatggtcgaggacaggtttattttaaagaaaacaaacccaagagtggcttctggctgagttagatcagaggcatgctctcttacagactaagagtttttaaggattcagggtgggagagtttatcagaggcttggactgcttctgtgtctctttaggtgtgcttatctgggagggagttgtgtgtctgtttccatacatcttcctgcagctgcaggcatacccccaggtctgcttttagcttccctatcttagtgcacctgaagggaaagaatgtgcttattaaggcccactgttatactggggcccaatgtatgagggtgaagtttggcaattacccaagagactttccccccacctccctctgtgcctgagctgtctcatctatgttttactgtctgctctttctgtctgcttgttgttagaagagaagtgattttcttgaaatgcatgaggctggaaagggagctggcacttaaagtggcggtgtttgtccgagaggatggtgctcctgctctgtcacagtgggcatggggattcaggccactgccaccgaatttcaagagcccaagcacagagcccagaactaaattgtgagggtttaaaaaaaaaaaaagctttattgaagtataattgacatacaataaacttgaatatttaaagtgtacaatttatgcgtttgggcatttgtatatacccctgcaaccatcagcacactgaagataaggaatatacccattacccctgaaaatttccccatgccctttggagcccctcccttcaacccctcaaatacttaatgcgctttttcccgaaaggcaagaagaaagcttccctacacatttatcaaggctgttataatcctgactcccaaacaaggtaaggaaattgttagacacttagagaacactttcaactattgtattcagatgttaaaatcctcagtaaaattcccataacagttaattgaacaaaccaattatgcaaaaacatacaatcaactataattgcaccctatagactcccctttttattctctaatgtgttatattccactaaatctttcttcatcttgccagtttttcttctaatttccctgcagctataattttggctgatgctatagtttgaatatttgaccctccaaacctcatgttgaaatttagtccccagtgttggaggtggggcctggtggaaggtgtttgggtcatgggggtggatcactcatgaacggcttggtgctgttctcatggcaatgagtgagttctcacataatcagttccctccagagctggttattaaagagagcctggcatctcccctctgtctctcttgcttcctgtctcatcatgtaatgtctgcacacactggctccccttctgccatgagtggaaactcctggaagccctcaccagaagtagatgctgttgccagcagaaccacgagtcaaataaacctatttttataaattacccagcctcaggtattcctttagagcaacacatatggactaagacagtgatgttctcaatttaccctgacattgcatgcaggccggctgtttcctcttaagttcccggagtgggaatgtgttccggacaaaggatgctagtgagtggcagtc

SEQ ID NO: 1437 - DNA, 2625 bp, Homo sapiens; identical to SEQ ID NO: 1436

SEQ ID NO: 1438 - DNA, 2339 bp, Homo sapiens
aagtgcaacaaacgtttattaagcacttagggttttctttgaatttgggggtgccctccccccacccggcagccttctgtgtcagcgggatacgatcttgatatagacaccattttttggacctagggcagatttggattctagctgcagcggtacctaaaatagagaaaattaaaatatttgtcaaagagatagtagcatctcactgtacaaatgaagacttggaggttcaagaaggccaagtccgttgtccaaggtcacacaagaagaaagcagagagcaaagccccaaacctatctttcagtgactccagccgtccctgctgatcctccccatctcactctccagttctggccagtaactgagcaatgccctctggcccaggggctctggggaaagcagcttcatgctgttcctgctcatgtgtgctgtggtctggcctcactgacatccagaaagctttcctatgtccagcttaaaaggcagagccagtggtggactggggactttgaagaaaaaccaaagaattactcgaggagttgggtttcctctggagctgagtaaaatgatgagccagtggctaatgtgacagcaaagagtcaccagggtcttagtgcttggggctgtacgtgtctcctgtgggagccatagccctcaaaggcatctgaaaaagctgcaggccccagcacttgtctgagcagacaaggaagaacggggagcccttgactcctggctggttcttaagccggggagtgccaggcataagcagcgttttgggagactggtctggctgctgcactgtatgttgagatcgtggggaagtgagacaagccccgcacacgtggaagccccgatgcagtggggctgctcctccgtctgccccttgacctcacttggtttggctctgctctgccgatctgcccctccctgtctccagcccagagtatgtggatgcgttcactttcagtatctcagactctatgtcccccatccaagctcattattcctccaggaccagcagctggtcccaggttctctgtcagaggcactgcctgtctcaatctagaattgttgctatctgtcaactgtgtccttatgccttcctatgcctgcctgtccaggtctgcagctgaacagtgggttccgggtggcaggacaagcatgaggataggtgcaggggacagcagtggtcaggataggcagggaatagctaacgctgtgcagagacgtagccagatgtcaggaaggagggagagcttgggagtgggcaggatctgggtgaggacccccgtttctctcatctctggctgcttatccatttgctcattaatgtttgttgaatgaatgagtgagcacctgtcatgcgcctggcattaagctagatgctggaaagtccaacaatgaatatgacagactgggtccctgccatcacgaagcctgcagtcctgctgtgtggccttaggcaagttatttaacctctctgagctttgattcctcatctaaagaatgggaatagtcactcctactctgcagggttgctgtgagtgtgaaagcaggggatataagctccctgacctgttgaggaattggtctgctggttctggagtgtgtgatgtgggggggagatagggctggaaaagtgggtgaggccccatttcaggagagctcagctctctgggtgaggacagggtctgtgcaccagtctaggacctcaggaatgaaggcatatgttgttgggaagaggctgtgtcaccacctgtgagagggaccaggctgtggccatggggacacgtgagtgtctgcacaaggggggaaggcaaagctgggggtaccgttcaaggagctgaaacccttcagcttcccctccaagcagacagcaccttgctctgtcaggaggagccagaggaagtgtccccaccttctgtaggacaagccatgcaccccccaccccgcaaaggcaggcacatgtcacaactgcaaatgccattgtctgtgtgccctttgtggaagtgggaagagctacagcaaggtgaggtccagccctggtgtgcagagaacaatactaataacaatggttaacacgtgctcgggttggcttgccagggcttacctgagcgctgtgtgaactcactggatcctcacaggatgttgagaggtagagggtgttattattatcacccccactttacgaatcaagaaactgaggccgagagaggttaaggagcttgcccaagctcacggaggcagagcctgatgttgcccccaggctggcctgctctcacgcagagaactggggtggccctcccacccctgcccctgcccctgcctctgagcagggg

SEQ ID NO: 1439 - DNA, 2293 bp, Homo sapiens
cagatgggactacaggtgtgcgccaccatgcccggccaatttttgtatttttagtacagacagggtttcatcatgttggccaggctggtctggaactcttgacctcaggtgatcccgcccgcctcggcctcccaaagtgctgggattacaggcgtgaggcaccacgcctggccattttttttttttttccaaaccaggagacatttgagtctgagacagaaaagaaagaaaacactttatttgtaaagagaaaatggaacttagtacatatgccaaaataaatctgtaacgcaggccacttctctgggccccatcttgagtaggttaaagggtcaccttagagactagaaacacaattaagaggcacaaatccacacagaaaatatgcatattttgtctcctttccccccaaaacaagctgcatatacttgtgtaaacttgttgatttgtaaaacatgtctagtactgcagacaaatgtgtgggatgaaaggaaataaaagccatgaaaacagggccaggtgcagtggctcacgcctgtaaccccaatgctttgggaggctgaggtgggaggatcacttgaggccaaggagttcaagaccagcctgggcaacatagtgaaactctgtctctgcaaaaaataattttaaaaaattagccaggcgtggcttggcacggtggctcatgcctgtaatcccagcactttgggaggccgaggcaggtggatcacctaatgtcaggagtttgaaaccagcctggccaacatggtgaaacccccgtctctactaaaaatacaaacattagctgcgcgtggtggcaggtgcctgtagtcccagctactcgggaggccgagacagggagaatcgcttgaacctgggaggcagaggttgcagtgagccaaaacgtgccattgcacttgaatctgggcaacagagcgagactccacctcaaaaaaaaaaaaaaaaaaattagccagatgtgatggtgcacatctgtagttttagctacttgagaggctgaggcaggaggatcactggggcccaggaggttgagcctacaatgagttatgatcatgccactgcactccagcctgagtaacaaagtgagaccttgtgtcttaaaaaaacaaaaaccactaaaatagcaacaagagcagtttacttggcttggaggtcaaagctgcatttgataaattcccagagtggtcagggggagaacagatattcaggaacactggggtttgggagtttttttcgcttctttcttacacccataaagccacctatccattcattcattttattctcttgcctatagcaaaactgaaagggccattaaactccagtttaaattttattcccaagatcctctaaatagcagcagctctcaaatcccagctccagcttagtggcttgctagcagtgacactgtgaaaaaaaatctagctggcagaacctcggtttctccatttgtgaaatgaaagtactggatgataatcctggctctgccaatttcctgggctttcacctgcttcttgcacttgaagatggtctctgatatcgtcccagttgggctggaatgtcctgggttttgcgttaggtttttggcatgtccagcatttgcggaaaaagaagatgtcctaactatcttcagaaggcacaaaactaggggtttttcttgtttttggtttcgagacggagtctcactctgtcgcccaggctggagtgcagtgacgcaatctcggctcactgcaacctctgcctcctgggttcaagcgattctcctgcctcagcctcccgagtagctgacttcaggtgatccgcccacctcagcctcccaaagtggcgtgagccactgcacccagcccaaactaggttttgaaggtggaataagttctcctagctcagaaggatctcaacctcttgcaagttacttttcacttttaagggcccttaaagaagcatttgcttagctctgtatccaggccatctctccctccccgaagagcaacagaccagcaactgacattaaggtcacatgggtgggtggggagtagaattgcgggggtgacagttccagccaatccagacaacgaatcattgtttggaggaaccagagcctcaaagggtgagtgcactgactagggctggctctccatctgttcacacacttgttgagtgcctactctatgccaaagcactgtgttttggtgccctggggaacacaaaattgggatagctcctgccctcagggcttaataaagtagctctcagtcaagggttagagcaagggttg

SEQ ID NO: 1440 - DNA, 2293 bp, Homo sapiens; identical to SEQ ID NO: 1439

SEQ ID NO: 1441 - DNA, 2293 bp, Homo sapiens; identical to SEQ ID NO: 1439

SEQ ID NO: 1442 - DNA, 2293 bp, Homo sapiens; identical to SEQ ID NO: 1439

SEQ ID NO: 1443 - DNA, 24636 bp, Homo sapiens
gtatgtatggaatacccatttgctttctatagtcttcaaggtccttttcccttacgtaaaacaccaagcctaaatcttacattcagctttttagaaggcagaacaagcagccattgagctcttgctgtgggactgaccccgccttctgcctgatgtcagtggggatactgcttaccttccttcctgcaaggaaatccacacactcttatttcatccggcctggggaggaggggaaagaggaagtcacctgtgaaattgtctttgcgctttggactcaagcccccagatgcctttggataatttctgcttgctaaagaggcggggccttagtcctcatcggccgatggtttggagactgaatcaactatctatgaagacgctgaggttaagaaacaagtgactgctatgagatcataaagaaaatgcataagtggtggaaacaattagaaaataggtgttttgattttaagttgcaagtgctctccattccacaaagatattggaaatggcttgaaggagggtccatggagtatcttctctaaattctccacagcactttatacagctccaaatgcataatgaaacttaaataaatcttactgaattaaaaagaaggaaaaaacatgagaggaagtcatcgagaatggagagagggagagaaatagaaatagagggaagattataaagatgaaaaggacaagaagaacagtccatatttataaaatattttagaagaaaaataaaatttccttctacgtgctgtcaggacatgctttttaatttgtggaagtcacacactgcagatgttgccttccgggttgctggtaggatcaccatgacaaaggcgctgcctcatctataaatagacggtcagattgatttcacatcctgccctggttcttccgactgcttgatgggcgtgacaacacaatcgatgagtgatcccatccactctgcctgcacaggcctcgcctgcactgtcttctggaagatgacaatcaggctcattaaatccagcacaaagaagcttcaaagacgtttgtcctatcagagaaattgagcctgagtcctttgccattgcatcaaaaggaattgagatttaatcagccatcccgtccaaacctattgctagtaagacagtttggatctttcctttgcctgtttggatcgatgttaactggaacttcaatggccagagctgatgtccgttccagcccaggtataaaaaagctattcaactggacattgataggtttccattagtacttctcagaagtgaatgtcaacttcctgatgtttatactcaaggagaatgaggtttggagatctgagtagtttactgaaggcactcacattgaaagattttatgaagctgaaattcaaatctagatgtgccccatccaaagaccaccctctttatacagcaacatgctgcttcccctggatcaagaaacacaaggagccttcatctaccacataagaattgcagcaaaccctgcagctatcctgaagctgccatgctgaaaaggccaattgggagaccacatagagaccgagagagacttccaaggactccagccaatcctgggccccagcagtttgaatctcccagcaatgccaccatacaggagagggagcaaatactcagaagattcaagtgccagctgcatgggttgatacctacataaaaggcattggcattattcacaagagccaagatatggaaataacctgtgtccattgacagacgaatagatgagggaaacgtggcatatacacacagtggaatattattcggaattaaaaaaagaaggaaatcctgaatcctgctatttctgacaacatgagactgcaggacgttatgaaaatggccacatcatgctcttctagaactttctcatccctcagtcaagaggtggagcctatttacccttgaccttgaaattgatcaggactttgtcactgccttgctcttaacatcaccatgctggagaaatagcatggcaaggccagctggtgatagagaaagatgcctaaggagctccagctgctattttccctggatttttgagtcttcccagtccagccagacatatgactgggcaaaaccctcaggtaactacagccttatccactgtctgactatcacaaaatgagagaccttgggtgaggaccacctacctgagcccagtcatcctgcagagatgcgagaaaaataagaatgtcattattgttattttaaaatcactgagtttgggttaatttgtatgcagcaatagataactgggacacaaagatagactgtaaaaaaataaagagggaatggttaagctaaaaacattgtgatcaaatcaatgtttagtaagtaagcaagaaagatggctatccagggaagagagattgcacaacaaaatgaaaatgaaacaagcaaagaaacaaagcatggattataacttgtaagagagaaaaccatattaaggggagttatttgaatattttgtatgaaaatacagaaatcagatataagtgagctgacactgactttggaggcaggaggaaaactgatggggaattctgggaaaacagaatgatacaaagcagaatcctcaatgtccctacccaaaacctaatgaaataaacagaaatcagcaacattattttaaaaattaattctccaagaacaatacaaaagtaaatggagcaaaaattattattcattttgaaaaagataatctagaaacagagagacagaggaatctagaaaatagtacacaaattcttgtctgagaagtgtctgagaagacatctataggcaaaactgcataaaattctctccagtttggaaggccatcctgggtaattttataaaatgtctctttcataatagaagcctcttcccaacatcatagatgaaaaatttttcaacgaagggaaaatctgttagtgctcatcaatcttcccctacacctcaaggatgagggagtagaggcatagattgagcacaactaattatttccagtaataaacaacatcaagataagacaaagtcttgaggcaatttggttgtcccttgacaaagggaataatgtgaaaggaggtaaaaaaaaaaaaaaaaaaaagagctctatatggcctttcttcctatagcaccttgtttaaataataaatttcactcattttccccacctctggcttggtcagaagagggataacagcatagaatagctcaggaggatggcaatgtgaaactgtagtagctataaagtgatgtctacatagcagaaaatccaatataaacataatatctctactcacctaagaaagatacaccttggagtactcataataaactctataataataataaaattacatgaaattgagcagaaaacaacaaatcaaaatagtcacaactgcatctgaggccccttaagaaaacagacacctgcaaacagacatcagcagtaaccaagtcacaagctgaacctctagtgggataaacaaataagcctccactaagataggcgggtaagcaagaataatttgtatatgctatatatgcacaaagaaagtgcccacatagaggggctaatatcaaagatgagcaaaatgaaaaaaagagtcatggcactcttaacaattatgaaggaaaagaaaaaaggagaaggaggaggagaagaaagcaagctagcatataaaatagaaaagaagaatttattctagaagaaggtatacaccaagtaatagaataaatattctgataaaacactttctgagaagaacttataaaaacaccaaaactacaatgaaaataatgaacagattgatataaataaaaatatagatataaaatataacaccaccgaattaatttgcaaaagtagtgaaagtatttgaagatcaagcaacagcactgcagattaataaacatgctttagagggtaaggaaaagagaagatgccagttgaaaatcaatactgtgttatggaagagagaattgaaataatcatgaagattgtcattagaaagcatggcaggatgacaacaatttcaatgaagatggcagatacggaagttatgcatcaaaggagcagcatgtgagcatctgtgtccttgagatggagaagagaaaataatggaacagataaagaacactcagagatacagaaaaatatttcctgaaatgaaacatttgccaaaccttcaaacatgagaagcttttacatccacgtatgtaaatggagtaaaagagatcccttgatctgacatgaatcttagctccattctttagtagctgtgactctgggcaggtttgtcaggctgattttttaatctgcaaagtgtgactattaaaaatcccagcttcatggtttgttgtgaatgggaatgaaatgaggtaatatatgtcatgtacttcggtgagttactggtacagaggatattcttttcaagtatcagctattgtttgtatcttggtaaagttcctgaacattatcgggggaagaaagaatcctgtacgaggaaaaaaaaacaaaagttgcattgcattcaaacttctacactgcatcagttagtgccagaagacaatgcagaaattccagcggaggcttgtggggtggaaatatgtatgatctgtgaatgttatagacagactgatagtcattcaggtataaaggaaatcgagaggcatcctaaaaattgctaggatgcagaaactgaaacctttttgaaaaagctcaccgatgaaaacaagaaatttccatagcaaaaaaattgaactaatggaatagaaagaccttctatgaaaggactggcagtaagtactaaatccatttaaatataaaaccaaagtgaaataattgaggaaattatggttacgtaaaatatatattttaaaacagaaaaaaagatttttttcattatgaataaaaacaactatataactctgatggaccctggaaaaatgttttaaaacaaataggaagtagggagggaaaagagaatgtgtaagtttcgtatttccctatgttcacagtggtaggtcaaaaaatggcaggtttattggaaaagttcatttttataaaaaggtaaatcctaaaaaaccaatgatgcaaaatctttctaaattttgaaaaaggaaatgcaaattaaaacaaaacagaaacaaatgttccctacaaaccttgacctttttgaatgagatgaaatgcacatgtctctgtgcataggctaagatctggaggagtgacatgaacagtgactgctccttgggcagtatgaatgagtggaggtggtagaataggaatgggcttttcatgtccttctttctggttatttactttgcttgtttttgttgagaaaaaaaatcacaaatacagattagtatgaagaataaggtgagaaactgctaggtatctattaccctgaattgacagtttcacattgtgttatatttatttcaagacatttttaaagaaagaaagaaaacataacagattaatcacattctccatctgccttccccctttcactcttctctgagacagacactgtgaagaacttgtgtatatctgttgaaccaaattataaattaacatacatatgtccatgaacaacatatctattcatacttgagaaatatatttgaaaccattagatcttttaacaattacagaaatagtatcatgctatgttatattgctaaatgcattatcaaacatgctttttcattaccttttttttgagaacatgtggagggattattttaaggtaaatgaaatagtttggttaaagagaaagcacatacaatattgccaattcctgccaagtggtagcatcactaaattcagtgtaaaataagtttgtgaacacacaaaatggatgaatttccaggaaaatatcaaggacagaaatgcatttcaaaaatgatctcatcaactcaaacaaacaaatgccacagttttttaaataagggagtatgggacaattcccctgcctcatacacacccatactcacacatcacagcacatgctaagaaggtgttgcacaggaaaattacttttacatttttgaatactatgtcacttcagcgtgtttaaattcttccagccaagagaagaaaaattttcagattctttttaccaagccagcatgaggttaaaccccaaatctgaaaatgaccgcaatgagaaaatgactgatgaatgccacatatgaacatctacataaaaatccaaataaaattcaaaactctaattctatagtgtattatattttaaaatgatatatattcaaatatataagacacatgcatacacatatgcatagaaatgtatatatacttatgtatatctacagatatgaatatgtacatacaagcaaattatatatatttacaaatatactacataaaatatatattaaatacacatgaatatatatctatacatatatgtaggtgtgtgtaatatatgtgtgcagcaaagtgaattttagcttagaaatatcagaaaaattcaaaaaaaaattactaattttagaaatactaattaaagagttaattccttttcttgctaagaagtaaatcaaaggtcaacattataattgaaaactaactactttctaaattctgctacatttcaggatgcgaacaatcaatatttactggctttatttaaaaataactaagataaaagcatagtcatatgcatctgtccaccattcagcattaacaagtattaaaatatgttatatgcttttcaggtctgtttttgtttttcaggaaacagaaagaccaaaaataaaattgaaactaatttttgcatataaacacttcctaagtgtgttgctgattcttgaagcatgcatatatgggacaaaatacagctgaattgcaaaaggcagaattttctatttgagttcaatcaagggaaacctgcttgattccaaccaagttaaatctgcttaaaagataatccacactcttcagagaaatgtaagagaatccagcctgcaacccaatccaacaccgctccctagcacatgatttaaatatgcagaatgtgttctgcgtatcttgttatatgggtatcaagtgccttgggttgtaatccagaagtacttggcgtaaaaagaatgaggaaaatgtgatcaattcttaagagaaaagacaactgatagagacaatctgacaggtgaaccagtttggtgcactcagaaagttagacatagagctaccatatgacaaacaattccactcctaggtgtatgcccaaggtacttgaaaacgtacattcatagaaactcataacaaatgttcatagcagcatcattcgtaatagccccaaagtgtaaacaaccaaatgcctatcaggtgactaaatggataaataaaatgtgatacatatacctagtggaatattacccggtgatagaaagtaacagagtatggacatatgctacagcagaatttgaaaagtatgatgtgaagtgaaagaagccaggcacaaaaaaccatgtatcttgtgattccattatatgaaatgtgaagaataggcaaatccataaaggcataaagtaaataagaagttgtcaggctccaggggtgggtagaatggactgggactgctaatgggtacagggtttcttttaggggtatgaaaatattttaaaattaaatagtagtaatgattgcacaagtctgtgaatatgccaaaggaatactgagtgttataaatcaaaagcgtgaattttataacatataaattatactccaataacactattattttttgaatttccaataatcattttgtataacctgatacatcgatcccaaaaggcatacatagaatagccaagaacagtcatttatatttgaatgaaaatatagtggaagcacttgccctagccaaaagaaaaaaaaaaatcaagatttactataataattttaaaagtgtggtgtagtattagtttagaaatagaaaaatggagttatgattcaaggtatagaatcctcattttgggaggctgaggcgggcaggtcacgaggtcaggagatcgagaccattctgggtattacggtgaaacctcgtctctactaaaaatacaaaaaattagccgagcatggtggcaggcgcctgtagtcccagctacttgggaagctgaggcaggagaatcgcttgaacccaggaggtggaggctgcagtgagctgagattgtgccaccacgccaatgcactccagcctgggcaacagagtgagactccgtctcaaaaaaaaaaaaaagaatccaaagtcagattggcacatgtatggaaacttgtaatatggtaagtatcatttaaaccagatggggaaaggattatacaatacttggtgctgcaaaatctgctatctacacagggagaaacgatgcctctaccccaaactgcgtaagataaatatccttctcagttgattaaaacctaaaaagcaacggacttttaaatcacctgaaaaaacagactgtaagttaacattataacattataatgttataaagttataacatttaaccttgggcttggcaatgaagaatttcttaaataaaacacaatgaacataactcttaatgaaaaacattgataaaatcaaccaccttaaaatagaaaattttgtacaacaaaagacaatgcagctttttttttttttaatgaaaaaagctacaggatgtcagaaggtatttgccatttatatcaccaacatataattgacggttattggatatgcaaaaaaatactagaaacagcctacttgttcattatcacaaaaatgatgaaggataaataaagtatacaataatccaattgcaaagaatactacacctcagctaaaatgaaaagggaactatgtattaatgtagataagtttattagtataaaagttattttacttattgatctataatcctcttactgattttaggatctataagacctatatttccttacaatccaattaaagactataggatatcttttattctgatattgaaaatttatattttcttttttccatctttaagaattttttaggaatgtattaattttattaatctccacaaaaaaatccatttagattttttctcttttctagtttgttctgctttctatttcattaaattctttttttaatttattttttattttttattttttgagatggagtctcgctctgtcccccaggctggagtgcagtggcgcaatctctgctcactgcaagctccacctcctgggttcatgccattctcccacctcagcctcctgagtagctgggactacaggcacgtgctaccatgcccagctaattttttgtatctttagtagagacggggtttcactgtgttagccaggatggtctctgtcaggcctctgaacccaagccaagccattgcatcccctgtgacttgcacgtatacgcccagatggcctgaagtaactgaagaatcacaaaagaagtgaaaaggccctgccccgccttaaccgatgacattccaccattgtgatttgttcctgccccaccttaactgagtgattaaccctgtgaatttccttctcctggctcagaagctcccccactgagcaccttgtgacccctgcccctgcccagcagagaacaaccccctttgactataattttccattaccttcccaaatcttataaaacggccccccctatctcccttcgctgactcttttcagactcagcccacctgcacccaggtgaaataaacagccatgttgcccacacaaagcctgtttggtggtctcttcacacggacgctcatggaatttggtgccgtgactcagatcgggggacctcccttgggagatcaatcccccttcctcctgccctttgctctgtgaaaaagatccacctatgacctcaggttctctgactgaccagcccaagaaacatctcaccaatttcaaatccggtaagcggcctctttttactctcttctccaacctccctcactatccctcaacctctttctcctttcaatcttggcgccacacttcaatctctcccttctcttaatttcaattcctttcattttctggtagagacaaaggagacacgttttatccgtggacccaaaactccggcgccggtcacggactgggaaggcagccttcccttggtgtttaatcattgaaaggacacctctctgattattcacccacgtttcaaaggtgtcagaccacgcagggacgcctgcctcggtccttcacccttagcggcaagtcccgcttttctggggaaggggcaagtaccccacccccttctctccttgtctctaccccttctctgcttttctgggggaggtgaaagtacccctcaaccgcttctccttcacccttagtggcaagtcccgcttttctgggggaggggcaagtacccctcaaccccttctccttcacccttagtggcaagtcctgcttttctggggaaggggcaagtaccccagccccttctctccgtgtctctaccccttctctgcttttctgggggaggggcaagtaccccaacctcatatctctgtgccccaatcccttatttccacaccccaacctcttatctctgtgccccactcccttatttccgtgtcccgaccccccttcccacttttctggagggtaagaacccccaaaccccttccctccgtgtctctacactctcttttctctgggtttgccgccttcactatgggcaaccttccaccctccattcctccttcttctcccttagcctgtgttctcaagaacttaaaacctcttcaactcacacctgacctaaaacctaaacaccttattttcttttgcaatgccgcttgaccccaatacaaactcaacagtagttccaaatagccagaaaatggcactttgaatttttccatcctgcaagatctaaataattcttgtcgtaaaataggcaaacggtctgaggtgcctgatgtccaggcattcttttacacatcagtcccttcctagtctctgtgcccagtgcaactcgtcccaaatcttccttctttccctccttcctgtcccctcagtcccaaccccaagcatcgctgagtctttctaatcttccttttctacagacccatctgacttctcccctccttgccaggccgagctaggtcccaattcttcctcagcctctgctcctccaccctataatctttttatcgcctcccctcctcacacctggtccggcttacagtttcgttctgtgactagccctcccccacctgcccagcaatttactcttaaaaaggtggctggagtcaaaggcgtagtcaaggttaatgctcctttttctttatcccaaatcagaagcgtttaggctctttttcatcaaatataaaaacccagcccagttcatggctcgttcggcagcaaccctgagataatttacagccctagaccctaaaaggtcaaaagccatcttattctcaatatacattttattacccaatttgctcctgacattaaataaaactccaaaaattagaatctggccctcaaaccccacaacaggacttaattaacctcaccttcaaggtgtacaagaatagaaaaaagttgcaattccttgcctccactgtgagacaaaccccagccacatctccagcacacaagaacttccaaacgcctgaaccgcagcggccaggctttactccagaacctcatcccccaggagcttgctacaagtgccagaaatctgaccaacaggccaaggaatgcctgcagcccaggattcctcctaagctgtgtcccatctgtgcgggaccccactggaaatcagactgttcaactcacctggaagccactcccagagcccctggaactctggcccaaggctctctgactgactcctttccagatcttctcagcttagcggctgaagactgatgctgcccgatcgcctcggaagccccgtagaccatcacggacgccgagctttaggtaactctcacagtgaagggtaagtccgtccccttcttaatcaacacggaggctacccactccaacattaccttcttttcaagggcctgtttcccttgcctccataactgttgtgggaatgacagccaggcttctacacctctaaaactccccaactgtggtgccaacttagacaatactcttatgcactcttttttagttatccccacctgcccaattcccttattaggctgagacactttaactaaattatcttccctgactattcctggactatagcagcatctcattgctgcccttcttcccaatccaaagccttctttgcatcctcctcttgtattcccccaccttaacccacaagtataagatacctctactccctccttggctaccgatcatgcaccccttaccatctcattaaaacctaatcaccctttccccgttcaatgccaatatcccatcccacagcatgctttgaaaggattaaagcctgttatcacttgcctgctacagcatgggcttctaagacctataaactctccttaaccattcccccattttacctgtcctaaaaccagacaagccttacaagttagttcaggatctgcgccttatcaaccaaattgttttacctatccaccctgtggtgccaaacccatatactctcctatcctcaatacctgcctctacaacccattattctgttctagatctcaaacatgctttctttactattcctttgcacccttcatcccagcctctcttcgctttcacttggactgaccctgacacccatcaagctcagcaaattacctaggctgtactgccgcaaagcttcacagacagcccccattacttcaatcaagcccaaatttcttcctcatctgttacctatcttggcataattctcataaaaacacacgtgctctccctgccagtcatgtccgactaatctcccaaaccccagcaccttctacaaaacaactcctttccttcctaggcatggttagtgcggtcagaatttttacacaagagccaggaccacaccgtgtagcctttctgtccaaacaacttgaccttactgttttagcctagccctcatgtctgcgtgcagtggctgccactgctttaatacttttagaggccctcaaaatcacaaactatgctcaactcactctctacatttctcataacttccaaaatctattttcttcctcatacctgacacgtatactttctgctccctggctccttcagctgtactctcttcgttaagtcccacaattaccattgttcctggcccggacttcaatcccgcctcccacattattccagataccacacctgaccgtcatgactgtatctctctgatccacctgatgttcatcccatttccccacatttccttcttccctgtttctcaccctgatcacgcttgatttattgatggcagttccaccgggcctaatcaccacacaccagcaaaggcaggctatgctatagtacaaaccactagcccgcctcttagaacctctcatttcctttacatcatggaaatctatcctcaaggaaataacttctcagtgttccatctgctattctatctgctattctactactcctcaaggattattcaggccccctcccttccctacacatcaagctcgaggatttgcccccgcccaggactggcaaattagctttactcaacatgccctgagtcacaaaaactaaaatacctcttagtctaagtagacactttcactagataggtagaggcctttcctacagggtctgagaaggccaccgcagtcatttcttcccttctgtcagacataattcctcagtttagccttcccacctctatacagtctgataacagaccagcctttattagtcaaatcagccaagcattttatcaggctcttagttttcagtgacagactaaaggtcttttaaaaacacacctcaccaagctcagccaccaacttaaaaaggactggacaatacttttaccactttcccttctgagaagtgagacctgtcctcagaatgctaccaggtacagcccatttaagctcctgcatagatgctcctttttattaggccccagtctcattccagacgccagaccaacttagactgtgccccaaaaaacttgtcatccctactatcttctgtctagtcatactcctattcaccgttctcaactactcatacatgccctactcttgtttacactgctggtttacactgtttctccaagccatcacagctgatatctcctggtgctatccccaaacttctactcttgaagtaaataaataatctttgctggcaggactatgctgaatctcctaagcactctctaatcagatgtcctaggtcctcccaattcttaaaccatttatacctgtttttctccttctcttattccatttagtttttcagttcatacaaaaccgtatccaggccatcaccaatctttctgtatgacaaatgtttcttctaacaaccccctcaatgtcaccccttaccacaagacctcccttcagcttaatctctcccactctaggttcccacgccgcccctaatcccgcttgaagcagcactgagaaacatcgcccattctctctccgcaccacccccaaaaattttcgccaccccaacacttcaacactattttatttttcttattaatataagaaggcaggaatgtcaggcctctgagcccaagccaagccatcgcatcccctgtgacttgcacgtatatgcccagatggcctgaagtaactgaagaatcacaaaagaagtgaaaaggccctgccctgccttaactgatgacattccaccattgtgatttgttcctgccccaccttaactgagtgattaaccctgtgaatttccttctcctggctcagaagctcccccactgagcaccttgtgacccccgcccctgcccaccagagaacaaccccctttggctgtaattttccattaccttcccaaatctgataaaacagccccaccccatctcccttcgctgactttcttttcggactcagcccacctgcacccaggtgaaataaacagccacgttgctcacacaaagcctgtttggtgatctcttcacacgggcgcacatgaaagtctcgatctcctaacatcacgatctgctcacctcggtcttccaaagtgctgggattacaggtgtgagccaccgtgcccagcctatttcattaaattcttatcttacttttgttacttttccttctacttgttttgattttagttgtacttaatgagaaaaatagaaaaaaatatatgtttattcctttaaaaaaatgagcaaaagccatgaacaggtgttttacagaaaaaaattcaagggactaataatcataaaaaaatctgctcaatatcacaaatcttcaaaaaccactaactgaaacaattagacactgctatctgaaatgtcaaattaaaaaaagaaaaaagacaaaaacaaatgacaaacctatcaagaccagtggtggcgggaatgtggaataactctgtgttgctggtaggaatgtgaatttgcacaggtaatttagaaaactggccaggcatggtggctcatgcctgtaatcccagcactttgggaggctgaggcgggctgatcatgagcttaagagatggagaccaccctggccaacgtggtgaaaccccgtctctactaaaaatacaaaaattagctgggcgtggtggtgcatgcctgtagtcccagctacaagggaggctgaggcaggaggatcgtttgaacctgggaggcagaagttgcagtgagcagagatcaagccattgtactccagcctggtgacagagggagactccgtctcaaaacacaaacaaacaaacaaacaacaactacaacaacaaaaaaccttgtggtactatctactgaagctaaacataggcatacctgatgtttgagcaatttcccttttagaaatttgccccaaggaaatgcatacacatgtacaccaaaaaaagtggcacaaggacactcttagaaacatttttcataatagcttcaaattggaaacaacacacataacctcccaggatacaatacattcgttgttgtaaaatcacacaaagtaatactatggtgtaacaaccaagttttaactattgctatgtgagccatcaagaataaaactaacagagtgttgagtaaaagagtactactaactcaagtgagtacatagagtacaacttcatttacatgaagtttcagaaatggccaaagctaactaactataataatttaagtaagaatccaggttattttaggaaagctggcataataactggaatggggagagaggatacccctgggtcctggtaatgttgcagcttctaatctctgttgcagctttcaccggtttgctcctttcgtaaaatttatagagcaaaatactcatcatttttgcaccttaccatattgttgtattttgattaatttgacacatcctctttaggtatgtgctcttgggtgattcccctaatcatagtggaaagatgggagctgagactctaagactgtaagtaacttggccaagacttatggcttgatacggatcttctaactcaaaatcgtgtgttcttctcactacccaattattgcttcacacttcatcattttgcagatgactgtgtgttgatgagaggctgccataatttgaagtcattagaacaatgaaatagtatctgcacatatgcacagtcctcggatgcgatgggcattccctcaagctgcagtccagcaggaaattttcagtgctagaagagttaaactataagctgacttgagatgtagtagttcaaaacccttgccaataactctttattatgtgcagcattttcaaagcaaaattacaacatgttagaaagtgaatgaggcaaattactggtgatgtcatcaaagtaataactgctaatgacccttttactcctgggcattgcctgaggccacactgacaggaagagcagatctgctttctgtgaatccatttggattatctagaaggcatcctgaaagttatgaaaacataatgtgagaaaatgatagatcaaagtgtgaatacaatgcagggacaacagaaaggaaaatgtactctctgttgtgtaatgggtattttggccagagtttgaagagctttattaaggagtgacaacaaacatatatttaaatgatgacatttcctccaaaataaaataaacaaataaatatgtagaatttaaaacttttttgtttccatgaaagagtttggaatacccttccaaactctcctcattcattgagacgatggatctcttgttattaaccgagacactgaattttgaggtgacatcctgttctggaggcagaaacattgccagcacttctccttcagcagttgatttattatgtgacagtcggtgatgagcttatcctcatgaagatgctccctcccacggacagccgtatcatacttgaggcctccctgccacttacccaggccactgcaatagcccctttgttgtcatctggttaagaactaaggttcttccttaaccagtccattcccctgacttccacagagaaaccattctataaactgctcatctgtcagctgttcaccagctcaaaaaccattcagaatcccacaccttctcccactgtccacagaatattgtcagtactccttctaagagaattcaaagcaacatgacatcatcctatatttctagccttacctaataaatattcataccgactacctactgctttctatacagggaaacatttcaaggcctccgaggtctgcttggaattctcccatccaccatcatttctgctgcctattaatattccacctataatttattcaccaaatattccttgaatgagtgccaggtgtcagatacctcagttccaaggtcctttcttttgtgaagcttttcttggaagctcccctgtctgagctcacactctaattgggacattatttaattatagtctgtattgaacaatattcgtgtcaaatgcatttttgtctgtttctcctactggatttggagcatatatcttggaatcactgccacctgccatagtatctagcacattatagacaataatttttattgactgaatcattttgaagttattcctctatgttctagagaattaatactttagtttctgtattccctacttagagatacttttaaggtgcattgataataatcctggatttattagaatctttagggagcatctcagaatgagattataattctttctcgatagcagggataagactggtgctgtagaagataaaaaggaatcctaatttcttgctcacatcttgctttggcagagtcaggacataggacccataatccttatctcctatgaagagaaaatcttgcccccgtcttctcaccagcccttggcagagctgttaggaggcagattccagctgccagcccttccagtgatttttctcagctgcagcaagccaccttgcccaaggtcatgcccttccacgtgtgacccacatccatgactgatggatgcaggagctataaaggcccagccactgcagcccaatgcaggggaattggggccatcttagttccagagttctccatgaaaccggctgaggctatgcctgcataatagttcaggttttccttttgtccaatcccactttctatgcctccctttcatggagactgattacaagagcactctgataaacactttgaacattatacttcgtctcagagtctgcatcctggtgaatctaaatggtatcatcaatgcaagtggctctaagatgggattttggagctggatgactcaccaaccagccagtgattaagatgctgtcacttgtggttggtggagcacaactagtcctggtgcaaggtgggtactgcttggtaaaactttcatgaaggtgagctgggaagctacaccagtggaaaggaatgcactcactggtgcaatgcatgcttttcagtgcatttgaaaattatgggaggggtaggtactataagggcaaagaggttgtatgactatggttaacctttaagctctagaaaaaaacaaaaataaggttaagtgtgaaagccaaagccaaaagccaaagcttttatatagtaccctataaaaagcctctcatctcctttaacagcagggaagaaagttggagaaaagctccacaacttaattgtcatggtagctgaactagaaagaataatgtactcataacaaagccatttgtatccaggtgaagaccctgactgggatgaacgggaccctgaaacacggaaaagagacttggttgatgacctgaaaaattcggaattcctagattctcccaaatctctgagcctatagaagcagactttccctccattttaacccattcagaggtcactcccctgaaagagagcaggtactccactcaggatctttccccaccttgcttcctagccattaggctaataactcaggtaaattgcatcataatccagccttgagtgtgctgggcctggtaagaaaggaaaggaattacatcccaaaggagctaaaataaaacctgctaacatagaccagcaggtatgctctggcagagcaggtatgggtctgatcaaggaggctggagcctaagagtgaataagggatgttatctactagtggtttagtgaatttgggagcactctcccaaggtacaggatttaaaacttagcaaaaaccctaggagatgatgcaaactgggtcttaggagcatgcaaactagttcctaggagcatggaaaaagtgatggccagagtaagggaggtctacatgttgggatcactgtgtctgatggtggagaatgggataaaaaactagggagtgagcattctagggaggatatacaacatacaaaaagcccaccacgtggttatatttcatgggaaatccccagagaaaagaagaggtgttctggtgagacgggaaccagcatcaccaagaagttcattggtggctgtcctttgtaggtggaattgaccataggagagggcattattacagagctagggtcactgatagtgataaggataataagatccctactgaagcccggcagtggcacttcattgtcaaaatccaggtagacaggtaactcaggtaactttatacttggagaataggaaaactcaaactggcagtgataccagaaactccaaaagtcactatggcctcagttttggggtggagctaactaaacagagttaactaactagagttcaaggccaatatctaatcaactgtaagtctgcaatatctgctgttttctcaggcccttctgaaactgctctccccctcaatccaagacagtaaattaaaaataatattgcattccagggcatgtaaaaaatgagtttcgttcataactatctaaatgatgcattgatagtggtccctaccaaatacccaatcaattcatcagtccagcccctgcagaagccagatgagccttagaggaggggaatgtactaccaccaactataccaaatataactccaatcacaatcgcagtctctgttccagatcaagtatatttgatagagaagattaacatggtttcagtgcatggtttgaggccatgtattgtggtcattttttctatctctatctgaaagaagataaaaagttgttaatatttacattgaatggacaaaactacacgttcataattgtgcctcaaggcactatggattccctccctcccctactttgtcaataatacagtctgaagatgtactggactgtctgacatccacagagcatcacattgatcatctgcatttatacgtcatgctaattggattggaggaaccaaaggtggcaacctttttgggagccttagtaagacacacacagctgagggtggaatatgaaacctacaaagctatatggcctgccacactagcaaaatatttaggaagtcagtgttcagggcaaaccaggatcccacctgtagtagttgcctgtaactgccataacaaattatttaaaaatgggtggcttaaaataacagacatttattctcttacagtttggggggccagaagtccaaaattcaggtgttgacagatccacacatcctcaaaatgctcacagaaaaattccattccttaccttgtcctgctctgggtggcttccagcactccttgggcagtgtaccccccgggaatactgctttggctcatgtataggtgacatgagatgctgccagccttgagtggggcccagaacaggaaagtgcactgtaaaaggttcaggctgtagttcaagcggccattacccttgggccatatgacccagcagatcctaagatattaaaggtattagtggtgggataaagagaccatggagagccaatgacaatctcaagggagagcatcacagagcaagcttcttggactctggaccaagaatgccagtggatactttgccatgcatatgcagtggagaatcaccttttgaaaaacaactgctgccatgccaccaaccccaataaaagtggaatatctatgcatgagacttttttgaccctgaatgatgaactgcccacaatgacgtagattctgtcggaacacaccgtgttataaaattagacgcaactggcaacaatagtgagaaaatgaagtgtagcataggcaggaccaggggcagagccaactgcatgcaaagggaacacagaccccatgccacccaccgctgatgccccagcaccctccctcatcatgcaccagtgccacatggtgtgatcccgcttggttcgcagatgggttggctctgaatgtggcccaagtcagaaataacagcctttcttggaggcagccttgaaagacagtgatgaggggaaatgcactttgggaagagcacctagttgtgcagttgtggaaagaggtgtcctaacatgagactgtacagattcataggcagcagcaaatagcctggcaagtctgaaaaaataaataaacaaattttgcaatgagaaggacaaggaggggtgggatagaggcatttggaatgtgaatggtgtatgaagatcttggagtcacgtgttaacacccaccacagagcgtccaccagagaagaggtactcaatatccaagtagacagaatgtcagccagattttgtcatagaccagtgttagcacagggacgtatggccaaagcagtggcagtgatggagagcctccacacggaccccacagcaggatctctcactgaccaaggctagtgttgccactgagtgtcaacatcaaatgtagaggcccacactgagtttgaagaccaaactggtcacttggtaacaattgaccaagtgggccccttccacattgcagatgccaccaagtcactgagagaaattggtagatatttcaggtatggattttacttacctgagggtgtcagacagccccagtgtccgaagccttacagagtgttggctgcttggcacaggattccacaaacaactgtcaaaaactagtgaggccacctaacagaaatgcaggtgagggagtgggccagtaactacaggaatgaccttaacaaatattacaccagctaaaagctgcaggcctgaaagaacactggaacagtgaaaacacagctgaagcaacggctcagagctagagaatggagttcacatctctaggaagcagtgtatgcacaaagcaggttcgatatatgatgctgtgttcccagtaggaggaaaataggagtcccaggcacaatgaagtagaagcaaaagtggcaactcctcgaaaattctgaaagagaatcctttccaatcagtgttccatagcacctagatcatccattatgcatgcctatggaatagtcatttttagatgttcgcagacccaaaaaattatctgccatatgcacttttctagatagctattcaaggaggaaacttacaaaaaaaaaaaggaagacactaaaaaacatgagattcattaaactaggaattcaacacaaaagagctggggggtctccacaggacggtgaggggagatgttaggcagccatgctccaggctgagtgaggtaccagtctcaatggatagaagcctctgggaaggacgtcttcaagcagatgaaactttcctaagattggatacactccactgtattataaagagattttatttctggggaagaatttggggaagaattagtaataattaatagaaaaaaagaaagataaattagacaactttaagaaaaacaaatttgtgtaagaaaattcattcaagtgtcctgtgtcaatcgtgcctagcatttacatggccataataaaataagcactacattttgtacccaactaaaatgaaaatatgggtaggttggaaggatgacaggccaggaagtatgcacgaatatggcagggagaggggtatgaaaggggggttaattcccttcttcaagagcctaatttttatttaagtgcaatttggtggaaggttatcagcctacacactggagcattatcagaaagaagtctattgcatttgctttggagatgttactaaacattcgtttctttgtatggtcatgtcactcgtatgatcaattataaggtaaatttttctctggtcattttaccaagtaaagttatatttcccttgagaaaaacgtgcttttttttttttgttatagacactatgaatcatacacaaatcagttttcactcttttgttttgaattttaatgaatatagaggtggctttgcattatgtttttatcatacatatagaatgttctggcattcatcttgcatactaacttcactgctgatttattatattttctgaccttcattttcctttctccatgctttcttcaattacaaattcttataatggctatatttcttcaaataaaagaaattattttgttttggaatgaggcaaggttagaagcaaacatataaataaatgcgactttgaacaattaatcaattttggatgcactttttgtaattgctttgcctgtttgtactgtgcagtcaccatatcttcccactggagcataaatttacaaacttcatgcaaatgcattatttgtaataaaactgactcatgagcattaaaagccaattatttctatacatctgctggctatggctggcaataattgtgcgtcattcagatttgtggctgtgtgtttgccttagtaagattttaatcactcattaatttatggtttacaatatgcatcatgggcgcctgtattccccaaactacctcagacttacaaatcgagaagctgcagaacttggaattgtgacaacagaggcctcttttaagttgtgtcttcatgccaatgtctactagaggatcatagatgaaataagacaacccccccacccacctcaaaacacactgagtacaattgatcttccattccattgatgaattactttttcattttttttataataccatactatgcatttttatgttacttttttatttgccagttaatgacttcttggtggcctaacctttgtggagacagg

SEQ ID NO: 1444 - DNA, 24396 bp, Homo sapiens
gtatgtatggaatacccatttgctttctatagtcttcaaggtccttttcccttacgtaaaacaccaagcctaaatcttacattcagctttttagaaggcagaacaagcagccattgagctcttgctgtgggactgaccccgccttctgcctgatgtcagtggggatactgcttaccttccttcctgcaaggaaatccacacactcttatttcatccggcctggggaggaggggaaagaggaagtcacctgtgaaattgtctttgcgctttggactcaagcccccagatgcctttggataatttctgcttgctaaagaggcggggccttagtcctcatcggccgatggtttggagactgaatcaactatctatgaagacgctgaggttaagaaacaagtgactgctatgagatcataaagaaaatgcataagtggtggaaacaattagaaaataggtgttttgattttaagttgcaagtgctctccattccacaaagatattggaaatggcttgaaggagggtccatggagtatcttctctaaattctccacagcactttatacagctccaaatgcataatgaaacttaaataaatcttactgaattaaaaagaaggaaaaaacatgagaggaagtcatcgagaatggagagagggagagaaatagaaatagagggaagattataaagatgaaaaggacaagaagaacagtccatatttataaaatattttagaagaaaaataaaatttccttctacgtgctgtcaggacatgctttttaatttgtggaagtcacacactgcagatgttgccttccgggttgctggtaggatcaccatgacaaaggcgctgcctcatctataaatagacggtcagattgatttcacatcctgccctggttcttccgactgcttgatgggcgtgacaacacaatcgatgagtgatcccatccactctgcctgcacaggcctcgcctgcactgtcttctggaagatgacaatcaggctcattaaatccagcacaaagaagcttcaaagacgtttgtcctatcagagaaattgagcctgagtcctttgccattgcatcaaaaggaattgagatttaatcagccatcccgtccaaacctattgctagtaagacagtttggatctttcctttgcctgtttggatcgatgttaactggaacttcaatggccagagctgatgtccgttccagcccaggagccttcatctaccacataagaattgcagcaaaccctgcagctatcctgaagctgccatgctgaaaaggccaattgggagaccacatagagaccgagagagacttccaaggactccagccaatcctgggccccagcagtttgaatctcccagcaatgccaccatacaggagagggagcaaatactcagaagattcaagtgccagctgcatgggttgatacctacataaaaggcattggcattattcacaagagccaagatatggaaataacctgtgtccattgacagacgaatagatgagggaaacgtggcatatacacacagtggaatattattcggaattaaaaaaagaaggaaatcctgaatcctgctatttctgacaacatgagactgcaggacgttatgaaaatggccacatcatgctcttctagaactttctcatccctcagtcaagaggtggagcctatttacccttgaccttgaaattgatcaggactttgtcactgccttgctcttaacatcaccatgctggagaaatagcatggcaaggccagctggtgatagagaaagatgcctaaggagctccagctgctattttccctggatttttgagtcttcccagtccagccagacatatgactgggcaaaaccctcaggtaactacagccttatccactgtctgactatcacaaaatgagagaccttgggtgaggaccacctacctgagcccagtcatcctgcagagatgcgagaaaaataagaatgtcattattgttattttaaaatcactgagtttgggttaatttgtatgcagcaatagataactgggacacaaagatagactgtaaaaaaataaagagggaatggttaagctaaaaacattgtgatcaaatcaatgtttagtaagtaagcaagaaagatggctatccagggaagagagattgcacaacaaaatgaaaatgaaacaagcaaagaaacaaagcatggattataacttgtaagagagaaaaccatattaaggggagttatttgaatattttgtatgaaaatacagaaatcagatataagtgagctgacactgactttggaggcaggaggaaaactgatggggaattctgggaaaacagaatgatacaaagcagaatcctcaatgtccctacccaaaacctaatgaaataaacagaaatcagcaacattattttaaaaattaattctccaagaacaatacaaaagtaaatggagcaaaaattattattcattttgaaaaagataatctagaaacagagagacagaggaatctagaaaatagtacacaaattcttgtctgagaagtgtctgagaagacatctataggcaaaactgcataaaattctctccagtttggaaggccatcctgggtaattttataaaatgtctctttcataatagaagcctcttcccaacatcatagatgaaaaatttttcaacgaagggaaaatctgttagtgctcatcaatcttcccctacacctcaaggatgagggagtagaggcatagattgagcacaactaattatttccagtaataaacaacatcaagataagacaaagtcttgaggcaatttggttgtcccttgacaaagggaataatgtgaaaggaggtaaaaaaaaaaaaaaaaaaaagagctctatatggcctttcttcctatagcaccttgtttaaataataaatttcactcattttccccacctctggcttggtcagaagagggataacagcatagaatagctcaggaggatggcaatgtgaaactgtagtagctataaagtgatgtctacatagcagaaaatccaatataaacataatatctctactcacctaagaaagatacaccttggagtactcataataaactctataataataataaaattacatgaaattgagcagaaaacaacaaatcaaaatagtcacaactgcatctgaggccccttaagaaaacagacacctgcaaacagacatcagcagtaaccaagtcacaagctgaacctctagtgggataaacaaataagcctccactaagataggcgggtaagcaagaataatttgtatatgctatatatgcacaaagaaagtgcccacatagaggggctaatatcaaagatgagcaaaatgaaaaaaagagtcatggcactcttaacaattatgaaggaaaagaaaaaaggagaaggaggaggagaagaaagcaagctagcatataaaatagaaaagaagaatttattctagaagaaggtatacaccaagtaatagaataaatattctgataaaacactttctgagaagaacttataaaaacaccaaaactacaatgaaaataatgaacagattgatataaataaaaatatagatataaaatataacaccaccgaattaatttgcaaaagtagtgaaagtatttgaagatcaagcaacagcactgcagattaataaacatgctttagagggtaaggaaaagagaagatgccagttgaaaatcaatactgtgttatggaagagagaattgaaataatcatgaagattgtcattagaaagcatggcaggatgacaacaatttcaatgaagatggcagatacggaagttatgcatcaaaggagcagcatgtgagcatctgtgtccttgagatggagaagagaaaataatggaacagataaagaacactcagagatacagaaaaatatttcctgaaatgaaacatttgccaaaccttcaaacatgagaagcttttacatccacgtatgtaaatggagtaaaagagatcccttgatctgacatgaatcttagctccattctttagtagctgtgactctgggcaggtttgtcaggctgattttttaatctgcaaagtgtgactattaaaaatcccagcttcatggtttgttgtgaatgggaatgaaatgaggtaatatatgtcatgtacttcggtgagttactggtacagaggatattcttttcaagtatcagctattgtttgtatcttggtaaagttcctgaacattatcgggggaagaaagaatcctgtacgaggaaaaaaaaacaaaagttgcattgcattcaaacttctacactgcatcagttagtgccagaagacaatgcagaaattccagcggaggcttgtggggtggaaatatgtatgatctgtgaatgttatagacagactgatagtcattcaggtataaaggaaatcgagaggcatcctaaaaattgctaggatgcagaaactgaaacctttttgaaaaagctcaccgatgaaaacaagaaatttccatagcaaaaaaattgaactaatggaatagaaagaccttctatgaaaggactggcagtaagtactaaatccatttaaatataaaaccaaagtgaaataattgaggaaattatggttacgtaaaatatatattttaaaacagaaaaaaagatttttttcattatgaataaaaacaactatataactctgatggaccctggaaaaatgttttaaaacaaataggaagtagggagggaaaagagaatgtgtaagtttcgtatttccctatgttcacagtggtaggtcaaaaaatggcaggtttattggaaaagttcatttttataaaaaggtaaatcctaaaaaaccaatgatgcaaaatctttctaaattttgaaaaaggaaatgcaaattaaaacaaaacagaaacaaatgttccctacaaaccttgacctttttgaatgagatgaaatgcacatgtctctgtgcataggctaagatctggaggagtgacatgaacagtgactgctccttgggcagtatgaatgagtggaggtggtagaataggaatgggcttttcatgtccttctttctggttatttactttgcttgtttttgttgagaaaaaaaatcacaaatacagattagtatgaagaataaggtgagaaactgctaggtatctattaccctgaattgacagtttcacattgtgttatatttatttcaagacatttttaaagaaagaaagaaaacataacagattaatcacattctccatctgccttccccctttcactcttctctgagacagacactgtgaagaacttgtgtatatctgttgaaccaaattataaattaacatacatatgtccatgaacaacatatctattcatacttgagaaatatatttgaaaccattagatcttttaacaattacagaaatagtatcatgctatgttatattgctaaatgcattatcaaacatgctttttcattaccttttttttgagaacatgtggagggattattttaaggtaaatgaaatagtttggttaaagagaaagcacatacaatattgccaattcctgccaagtggtagcatcactaaattcagtgtaaaataagtttgtgaacacacaaaatggatgaatttccaggaaaatatcaaggacagaaatgcatttcaaaaatgatctcatcaactcaaacaaacaaatgccacagttttttaaataagggagtatgggacaattcccctgcctcatacacacccatactcacacatcacagcacatgctaagaaggtgttgcacaggaaaattacttttacatttttgaatactatgtcacttcagcgtgtttaaattcttccagccaagagaagaaaaattttcagattctttttaccaagccagcatgaggttaaaccccaaatctgaaaatgaccgcaatgagaaaatgactgatgaatgccacatatgaacatctacataaaaatccaaataaaattcaaaactctaattctatagtgtattatattttaaaatgatatatattcaaatatataagacacatgcatacacatatgcatagaaatgtatatatacttatgtatatctacagatatgaatatgtacatacaagcaaattatatatatttacaaatatactacataaaatatatattaaatacacatgaatatatatctatacatatatgtaggtgtgtgtaatatatgtgtgcagcaaagtgaattttagcttagaaatatcagaaaaattcaaaaaaaaattactaattttagaaatactaattaaagagttaattccttttcttgctaagaagtaaatcaaaggtcaacattataattgaaaactaactactttctaaattctgctacatttcaggatgcgaacaatcaatatttactggctttatttaaaaataactaagataaaagcatagtcatatgcatctgtccaccattcagcattaacaagtattaaaatatgttatatgcttttcaggtctgtttttgtttttcaggaaacagaaagaccaaaaataaaattgaaactaatttttgcatataaacacttcctaagtgtgttgctgattcttgaagcatgcatatatgggacaaaatacagctgaattgcaaaaggcagaattttctatttgagttcaatcaagggaaacctgcttgattccaaccaagttaaatctgcttaaaagataatccacactcttcagagaaatgtaagagaatccagcctgcaacccaatccaacaccgctccctagcacatgatttaaatatgcagaatgtgttctgcgtatcttgttatatgggtatcaagtgccttgggttgtaatccagaagtacttggcgtaaaaagaatgaggaaaatgtgatcaattcttaagagaaaagacaactgatagagacaatctgacaggtgaaccagtttggtgcactcagaaagttagacatagagctaccatatgacaaacaattccactcctaggtgtatgcccaaggtacttgaaaacgtacattcatagaaactcataacaaatgttcatagcagcatcattcgtaatagccccaaagtgtaaacaaccaaatgcctatcaggtgactaaatggataaataaaatgtgatacatatacctagtggaatattacccggtgatagaaagtaacagagtatggacatatgctacagcagaatttgaaaagtatgatgtgaagtgaaagaagccaggcacaaaaaaccatgtatcttgtgattccattatatgaaatgtgaagaataggcaaatccataaaggcataaagtaaataagaagttgtcaggctccaggggtgggtagaatggactgggactgctaatgggtacagggtttcttttaggggtatgaaaatattttaaaattaaatagtagtaatgattgcacaagtctgtgaatatgccaaaggaatactgagtgttataaatcaaaagcgtgaattttataacatataaattatactccaataacactattattttttgaatttccaataatcattttgtataacctgatacatcgatcccaaaaggcatacatagaatagccaagaacagtcatttatatttgaatgaaaatatagtggaagcacttgccctagccaaaagaaaaaaaaaaatcaagatttactataataattttaaaagtgtggtgtagtattagtttagaaatagaaaaatggagttatgattcaaggtatagaatcctcattttgggaggctgaggcgggcaggtcacgaggtcaggagatcgagaccattctgggtattacggtgaaacctcgtctctactaaaaatacaaaaaattagccgagcatggtggcaggcgcctgtagtcccagctacttgggaagctgaggcaggagaatcgcttgaacccaggaggtggaggctgcagtgagctgagattgtgccaccacgccaatgcactccagcctgggcaacagagtgagactccgtctcaaaaaaaaaaaaaagaatccaaagtcagattggcacatgtatggaaacttgtaatatggtaagtatcatttaaaccagatggggaaaggattatacaatacttggtgctgcaaaatctgctatctacacagggagaaacgatgcctctaccccaaactgcgtaagataaatatccttctcagttgattaaaacctaaaaagcaacggacttttaaatcacctgaaaaaacagactgtaagttaacattataacattataatgttataaagttataacatttaaccttgggcttggcaatgaagaatttcttaaataaaacacaatgaacataactcttaatgaaaaacattgataaaatcaaccaccttaaaatagaaaattttgtacaacaaaagacaatgcagctttttttttttttaatgaaaaaagctacaggatgtcagaaggtatttgccatttatatcaccaacatataattgacggttattggatatgcaaaaaaatactagaaacagcctacttgttcattatcacaaaaatgatgaaggataaataaagtatacaataatccaattgcaaagaatactacacctcagctaaaatgaaaagggaactatgtattaatgtagataagtttattagtataaaagttattttacttattgatctataatcctcttactgattttaggatctataagacctatatttccttacaatccaattaaagactataggatatcttttattctgatattgaaaatttatattttcttttttccatctttaagaattttttaggaatgtattaattttattaatctccacaaaaaaatccatttagattttttctcttttctagtttgttctgctttctatttcattaaattctttttttaatttattttttattttttattttttgagatggagtctcgctctgtcccccaggctggagtgcagtggcgcaatctctgctcactgcaagctccacctcctgggttcatgccattctcccacctcagcctcctgagtagctgggactacaggcacgtgctaccatgcccagctaattttttgtatctttagtagagacggggtttcactgtgttagccaggatggtctctgtcaggcctctgaacccaagccaagccattgcatcccctgtgacttgcacgtatacgcccagatggcctgaagtaactgaagaatcacaaaagaagtgaaaaggccctgccccgccttaaccgatgacattccaccattgtgatttgttcctgccccaccttaactgagtgattaaccctgtgaatttccttctcctggctcagaagctcccccactgagcaccttgtgacccctgcccctgcccagcagagaacaaccccctttgactataattttccattaccttcccaaatcttataaaacggccccccctatctcccttcgctgactcttttcagactcagcccacctgcacccaggtgaaataaacagccatgttgcccacacaaagcctgtttggtggtctcttcacacggacgctcatggaatttggtgccgtgactcagatcgggggacctcccttgggagatcaatcccccttcctcctgccctttgctctgtgaaaaagatccacctatgacctcaggttctctgactgaccagcccaagaaacatctcaccaatttcaaatccggtaagcggcctctttttactctcttctccaacctccctcactatccctcaacctctttctcctttcaatcttggcgccacacttcaatctctcccttctcttaatttcaattcctttcattttctggtagagacaaaggagacacgttttatccgtggacccaaaactccggcgccggtcacggactgggaaggcagccttcccttggtgtttaatcattgaaaggacacctctctgattattcacccacgtttcaaaggtgtcagaccacgcagggacgcctgcctcggtccttcacccttagcggcaagtcccgcttttctggggaaggggcaagtaccccacccccttctctccttgtctctaccccttctctgcttttctgggggaggtgaaagtacccctcaaccgcttctccttcacccttagtggcaagtcccgcttttctgggggaggggcaagtacccctcaaccccttctccttcacccttagtggcaagtcctgcttttctggggaaggggcaagtaccccagccccttctctccgtgtctctaccccttctctgcttttctgggggaggggcaagtaccccaacctcatatctctgtgccccaatcccttatttccacaccccaacctcttatctctgtgccccactcccttatttccgtgtcccgaccccccttcccacttttctggagggtaagaacccccaaaccccttccctccgtgtctctacactctcttttctctgggtttgccgccttcactatgggcaaccttccaccctccattcctccttcttctcccttagcctgtgttctcaagaacttaaaacctcttcaactcacacctgacctaaaacctaaacaccttattttcttttgcaatgccgcttgaccccaatacaaactcaacagtagttccaaatagccagaaaatggcactttgaatttttccatcctgcaagatctaaataattcttgtcgtaaaataggcaaacggtctgaggtgcctgatgtccaggcattcttttacacatcagtcccttcctagtctctgtgcccagtgcaactcgtcccaaatcttccttctttccctccttcctgtcccctcagtcccaaccccaagcatcgctgagtctttctaatcttccttttctacagacccatctgacttctcccctccttgccaggccgagctaggtcccaattcttcctcagcctctgctcctccaccctataatctttttatcgcctcccctcctcacacctggtccggcttacagtttcgttctgtgactagccctcccccacctgcccagcaatttactcttaaaaaggtggctggagtcaaaggcgtagtcaaggttaatgctcctttttctttatcccaaatcagaagcgtttaggctctttttcatcaaatataaaaacccagcccagttcatggctcgttcggcagcaaccctgagataatttacagccctagaccctaaaaggtcaaaagccatcttattctcaatatacattttattacccaatttgctcctgacattaaataaaactccaaaaattagaatctggccctcaaaccccacaacaggacttaattaacctcaccttcaaggtgtacaagaatagaaaaaagttgcaattccttgcctccactgtgagacaaaccccagccacatctccagcacacaagaacttccaaacgcctgaaccgcagcggccaggctttactccagaacctcatcccccaggagcttgctacaagtgccagaaatctgaccaacaggccaaggaatgcctgcagcccaggattcctcctaagctgtgtcccatctgtgcgggaccccactggaaatcagactgttcaactcacctggaagccactcccagagcccctggaactctggcccaaggctctctgactgactcctttccagatcttctcagcttagcggctgaagactgatgctgcccgatcgcctcggaagccccgtagaccatcacggacgccgagctttaggtaactctcacagtgaagggtaagtccgtccccttcttaatcaacacggaggctacccactccaacattaccttcttttcaagggcctgtttcccttgcctccataactgttgtgggaatgacagccaggcttctacacctctaaaactccccaactgtggtgccaacttagacaatactcttatgcactcttttttagttatccccacctgcccaattcccttattaggctgagacactttaactaaattatcttccctgactattcctggactatagcagcatctcattgctgcccttcttcccaatccaaagccttctttgcatcctcctcttgtattcccccaccttaacccacaagtataagatacctctactccctccttggctaccgatcatgcaccccttaccatctcattaaaacctaatcaccctttccccgttcaatgccaatatcccatcccacagcatgctttgaaaggattaaagcctgttatcacttgcctgctacagcatgggcttctaagacctataaactctccttaaccattcccccattttacctgtcctaaaaccagacaagccttacaagttagttcaggatctgcgccttatcaaccaaattgttttacctatccaccctgtggtgccaaacccatatactctcctatcctcaatacctgcctctacaacccattattctgttctagatctcaaacatgctttctttactattcctttgcacccttcatcccagcctctcttcgctttcacttggactgaccctgacacccatcaagctcagcaaattacctaggctgtactgccgcaaagcttcacagacagcccccattacttcaatcaagcccaaatttcttcctcatctgttacctatcttggcataattctcataaaaacacacgtgctctccctgccagtcatgtccgactaatctcccaaaccccagcaccttctacaaaacaactcctttccttcctaggcatggttagtgcggtcagaatttttacacaagagccaggaccacaccgtgtagcctttctgtccaaacaacttgaccttactgttttagcctagccctcatgtctgcgtgcagtggctgccactgctttaatacttttagaggccctcaaaatcacaaactatgctcaactcactctctacatttctcataacttccaaaatctattttcttcctcatacctgacacgtatactttctgctccctggctccttcagctgtactctcttcgttaagtcccacaattaccattgttcctggcccggacttcaatcccgcctcccacattattccagataccacacctgaccgtcatgactgtatctctctgatccacctgatgttcatcccatttccccacatttccttcttccctgtttctcaccctgatcacgcttgatttattgatggcagttccaccgggcctaatcaccacacaccagcaaaggcaggctatgctatagtacaaaccactagcccgcctcttagaacctctcatttcctttacatcatggaaatctatcctcaaggaaataacttctcagtgttccatctgctattctatctgctattctactactcctcaaggattattcaggccccctcccttccctacacatcaagctcgaggatttgcccccgcccaggactggcaaattagctttactcaacatgccctgagtcacaaaaactaaaatacctcttagtctaagtagacactttcactagataggtagaggcctttcctacagggtctgagaaggccaccgcagtcatttcttcccttctgtcagacataattcctcagtttagccttcccacctctatacagtctgataacagaccagcctttattagtcaaatcagccaagcattttatcaggctcttagttttcagtgacagactaaaggtcttttaaaaacacacctcaccaagctcagccaccaacttaaaaaggactggacaatacttttaccactttcccttctgagaagtgagacctgtcctcagaatgctaccaggtacagcccatttaagctcctgcatagatgctcctttttattaggccccagtctcattccagacgccagaccaacttagactgtgccccaaaaaacttgtcatccctactatcttctgtctagtcatactcctattcaccgttctcaactactcatacatgccctactcttgtttacactgctggtttacactgtttctccaagccatcacagctgatatctcctggtgctatccccaaacttctactcttgaagtaaataaataatctttgctggcaggactatgctgaatctcctaagcactctctaatcagatgtcctaggtcctcccaattcttaaaccatttatacctgtttttctccttctcttattccatttagtttttcagttcatacaaaaccgtatccaggccatcaccaatctttctgtatgacaaatgtttcttctaacaaccccctcaatgtcaccccttaccacaagacctcccttcagcttaatctctcccactctaggttcccacgccgcccctaatcccgcttgaagcagcactgagaaacatcgcccattctctctccgcaccacccccaaaaattttcgccaccccaacacttcaacactattttatttttcttattaatataagaaggcaggaatgtcaggcctctgagcccaagccaagccatcgcatcccctgtgacttgcacgtatatgcccagatggcctgaagtaactgaagaatcacaaaagaagtgaaaaggccctgccctgccttaactgatgacattccaccattgtgatttgttcctgccccaccttaactgagtgattaaccctgtgaatttccttctcctggctcagaagctcccccactgagcaccttgtgacccccgcccctgcccaccagagaacaaccccctttggctgtaattttccattaccttcccaaatctgataaaacagccccaccccatctcccttcgctgactttcttttcggactcagcccacctgcacccaggtgaaataaacagccacgttgctcacacaaagcctgtttggtgatctcttcacacgggcgcacatgaaagtctcgatctcctaacatcacgatctgctcacctcggtcttccaaagtgctgggattacaggtgtgagccaccgtgcccagcctatttcattaaattcttatcttacttttgttacttttccttctacttgttttgattttagttgtacttaatgagaaaaatagaaaaaaatatatgtttattcctttaaaaaaatgagcaaaagccatgaacaggtgttttacagaaaaaaattcaagggactaataatcataaaaaaatctgctcaatatcacaaatcttcaaaaaccactaactgaaacaattagacactgctatctgaaatgtcaaattaaaaaaagaaaaaagacaaaaacaaatgacaaacctatcaagaccagtggtggcgggaatgtggaataactctgtgttgctggtaggaatgtgaatttgcacaggtaatttagaaaactggccaggcatggtggctcatgcctgtaatcccagcactttgggaggctgaggcgggctgatcatgagcttaagagatggagaccaccctggccaacgtggtgaaaccccgtctctactaaaaatacaaaaattagctgggcgtggtggtgcatgcctgtagtcccagctacaagggaggctgaggcaggaggatcgtttgaacctgggaggcagaagttgcagtgagcagagatcaagccattgtactccagcctggtgacagagggagactccgtctcaaaacacaaacaaacaaacaaacaacaactacaacaacaaaaaaccttgtggtactatctactgaagctaaacataggcatacctgatgtttgagcaatttcccttttagaaatttgccccaaggaaatgcatacacatgtacaccaaaaaaagtggcacaaggacactcttagaaacatttttcataatagcttcaaattggaaacaacacacataacctcccaggatacaatacattcgttgttgtaaaatcacacaaagtaatactatggtgtaacaaccaagttttaactattgctatgtgagccatcaagaataaaactaacagagtgttgagtaaaagagtactactaactcaagtgagtacatagagtacaacttcatttacatgaagtttcagaaatggccaaagctaactaactataataatttaagtaagaatccaggttattttaggaaagctggcataataactggaatggggagagaggatacccctgggtcctggtaatgttgcagcttctaatctctgttgcagctttcaccggtttgctcctttcgtaaaatttatagagcaaaatactcatcatttttgcaccttaccatattgttgtattttgattaatttgacacatcctctttaggtatgtgctcttgggtgattcccctaatcatagtggaaagatgggagctgagactctaagactgtaagtaacttggccaagacttatggcttgatacggatcttctaactcaaaatcgtgtgttcttctcactacccaattattgcttcacacttcatcattttgcagatgactgtgtgttgatgagaggctgccataatttgaagtcattagaacaatgaaatagtatctgcacatatgcacagtcctcggatgcgatgggcattccctcaagctgcagtccagcaggaaattttcagtgctagaagagttaaactataagctgacttgagatgtagtagttcaaaacccttgccaataactctttattatgtgcagcattttcaaagcaaaattacaacatgttagaaagtgaatgaggcaaattactggtgatgtcatcaaagtaataactgctaatgacccttttactcctgggcattgcctgaggccacactgacaggaagagcagatctgctttctgtgaatccatttggattatctagaaggcatcctgaaagttatgaaaacataatgtgagaaaatgatagatcaaagtgtgaatacaatgcagggacaacagaaaggaaaatgtactctctgttgtgtaatgggtattttggccagagtttgaagagctttattaaggagtgacaacaaacatatatttaaatgatgacatttcctccaaaataaaataaacaaataaatatgtagaatttaaaacttttttgtttccatgaaagagtttggaatacccttccaaactctcctcattcattgagacgatggatctcttgttattaaccgagacactgaattttgaggtgacatcctgttctggaggcagaaacattgccagcacttctccttcagcagttgatttattatgtgacagtcggtgatgagcttatcctcatgaagatgctccctcccacggacagccgtatcatacttgaggcctccctgccacttacccaggccactgcaatagcccctttgttgtcatctggttaagaactaaggttcttccttaaccagtccattcccctgacttccacagagaaaccattctataaactgctcatctgtcagctgttcaccagctcaaaaaccattcagaatcccacaccttctcccactgtccacagaatattgtcagtactccttctaagagaattcaaagcaacatgacatcatcctatatttctagccttacctaataaatattcataccgactacctactgctttctatacagggaaacatttcaaggcctccgaggtctgcttggaattctcccatccaccatcatttctgctgcctattaatattccacctataatttattcaccaaatattccttgaatgagtgccaggtgtcagatacctcagttccaaggtcctttcttttgtgaagcttttcttggaagctcccctgtctgagctcacactctaattgggacattatttaattatagtctgtattgaacaatattcgtgtcaaatgcatttttgtctgtttctcctactggatttggagcatatatcttggaatcactgccacctgccatagtatctagcacattatagacaataatttttattgactgaatcattttgaagttattcctctatgttctagagaattaatactttagtttctgtattccctacttagagatacttttaaggtgcattgataataatcctggatttattagaatctttagggagcatctcagaatgagattataattctttctcgatagcagggataagactggtgctgtagaagataaaaaggaatcctaatttcttgctcacatcttgctttggcagagtcaggacataggacccataatccttatctcctatgaagagaaaatcttgcccccgtcttctcaccagcccttggcagagctgttaggaggcagattccagctgccagcccttccagtgatttttctcagctgcagcaagccaccttgcccaaggtcatgcccttccacgtgtgacccacatccatgactgatggatgcaggagctataaaggcccagccactgcagcccaatgcaggggaattggggccatcttagttccagagttctccatgaaaccggctgaggctatgcctgcataatagttcaggttttccttttgtccaatcccactttctatgcctccctttcatggagactgattacaagagcactctgataaacactttgaacattatacttcgtctcagagtctgcatcctggtgaatctaaatggtatcatcaatgcaagtggctctaagatgggattttggagctggatgactcaccaaccagccagtgattaagatgctgtcacttgtggttggtggagcacaactagtcctggtgcaaggtgggtactgcttggtaaaactttcatgaaggtgagctgggaagctacaccagtggaaaggaatgcactcactggtgcaatgcatgcttttcagtgcatttgaaaattatgggaggggtaggtactataagggcaaagaggttgtatgactatggttaacctttaagctctagaaaaaaacaaaaataaggttaagtgtgaaagccaaagccaaaagccaaagcttttatatagtaccctataaaaagcctctcatctcctttaacagcagggaagaaagttggagaaaagctccacaacttaattgtcatggtagctgaactagaaagaataatgtactcataacaaagccatttgtatccaggtgaagaccctgactgggatgaacgggaccctgaaacacggaaaagagacttggttgatgacctgaaaaattcggaattcctagattctcccaaatctctgagcctatagaagcagactttccctccattttaacccattcagaggtcactcccctgaaagagagcaggtactccactcaggatctttccccaccttgcttcctagccattaggctaataactcaggtaaattgcatcataatccagccttgagtgtgctgggcctggtaagaaaggaaaggaattacatcccaaaggagctaaaataaaacctgctaacatagaccagcaggtatgctctggcagagcaggtatgggtctgatcaaggaggctggagcctaagagtgaataagggatgttatctactagtggtttagtgaatttgggagcactctcccaaggtacaggatttaaaacttagcaaaaaccctaggagatgatgcaaactgggtcttaggagcatgcaaactagttcctaggagcatggaaaaagtgatggccagagtaagggaggtctacatgttgggatcactgtgtctgatggtggagaatgggataaaaaactagggagtgagcattctagggaggatatacaacatacaaaaagcccaccacgtggttatatttcatgggaaatccccagagaaaagaagaggtgttctggtgagacgggaaccagcatcaccaagaagttcattggtggctgtcctttgtaggtggaattgaccataggagagggcattattacagagctagggtcactgatagtgataaggataataagatccctactgaagcccggcagtggcacttcattgtcaaaatccaggtagacaggtaactcaggtaactttatacttggagaataggaaaactcaaactggcagtgataccagaaactccaaaagtcactatggcctcagttttggggtggagctaactaaacagagttaactaactagagttcaaggccaatatctaatcaactgtaagtctgcaatatctgctgttttctcaggcccttctgaaactgctctccccctcaatccaagacagtaaattaaaaataatattgcattccagggcatgtaaaaaatgagtttcgttcataactatctaaatgatgcattgatagtggtccctaccaaatacccaatcaattcatcagtccagcccctgcagaagccagatgagccttagaggaggggaatgtactaccaccaactataccaaatataactccaatcacaatcgcagtctctgttccagatcaagtatatttgatagagaagattaacatggtttcagtgcatggtttgaggccatgtattgtggtcattttttctatctctatctgaaagaagataaaaagttgttaatatttacattgaatggacaaaactacacgttcataattgtgcctcaaggcactatggattccctccctcccctactttgtcaataatacagtctgaagatgtactggactgtctgacatccacagagcatcacattgatcatctgcatttatacgtcatgctaattggattggaggaaccaaaggtggcaacctttttgggagccttagtaagacacacacagctgagggtggaatatgaaacctacaaagctatatggcctgccacactagcaaaatatttaggaagtcagtgttcagggcaaaccaggatcccacctgtagtagttgcctgtaactgccataacaaattatttaaaaatgggtggcttaaaataacagacatttattctcttacagtttggggggccagaagtccaaaattcaggtgttgacagatccacacatcctcaaaatgctcacagaaaaattccattccttaccttgtcctgctctgggtggcttccagcactccttgggcagtgtaccccccgggaatactgctttggctcatgtataggtgacatgagatgctgccagccttgagtggggcccagaacaggaaagtgcactgtaaaaggttcaggctgtagttcaagcggccattacccttgggccatatgacccagcagatcctaagatattaaaggtattagtggtgggataaagagaccatggagagccaatgacaatctcaagggagagcatcacagagcaagcttcttggactctggaccaagaatgccagtggatactttgccatgcatatgcagtggagaatcaccttttgaaaaacaactgctgccatgccaccaaccccaataaaagtggaatatctatgcatgagacttttttgaccctgaatgatgaactgcccacaatgacgtagattctgtcggaacacaccgtgttataaaattagacgcaactggcaacaatagtgagaaaatgaagtgtagcataggcaggaccaggggcagagccaactgcatgcaaagggaacacagaccccatgccacccaccgctgatgccccagcaccctccctcatcatgcaccagtgccacatggtgtgatcccgcttggttcgcagatgggttggctctgaatgtggcccaagtcagaaataacagcctttcttggaggcagccttgaaagacagtgatgaggggaaatgcactttgggaagagcacctagttgtgcagttgtggaaagaggtgtcctaacatgagactgtacagattcataggcagcagcaaatagcctggcaagtctgaaaaaataaataaacaaattttgcaatgagaaggacaaggaggggtgggatagaggcatttggaatgtgaatggtgtatgaagatcttggagtcacgtgttaacacccaccacagagcgtccaccagagaagaggtactcaatatccaagtagacagaatgtcagccagattttgtcatagaccagtgttagcacagggacgtatggccaaagcagtggcagtgatggagagcctccacacggaccccacagcaggatctctcactgaccaaggctagtgttgccactgagtgtcaacatcaaatgtagaggcccacactgagtttgaagaccaaactggtcacttggtaacaattgaccaagtgggccccttccacattgcagatgccaccaagtcactgagagaaattggtagatatttcaggtatggattttacttacctgagggtgtcagacagccccagtgtccgaagccttacagagtgttggctgcttggcacaggattccacaaacaactgtcaaaaactagtgaggccacctaacagaaatgcaggtgagggagtgggccagtaactacaggaatgaccttaacaaatattacaccagctaaaagctgcaggcctgaaagaacactggaacagtgaaaacacagctgaagcaacggctcagagctagagaatggagttcacatctctaggaagcagtgtatgcacaaagcaggttcgatatatgatgctgtgttcccagtaggaggaaaataggagtcccaggcacaatgaagtagaagcaaaagtggcaactcctcgaaaattctgaaagagaatcctttccaatcagtgttccatagcacctagatcatccattatgcatgcctatggaatagtcatttttagatgttcgcagacccaaaaaattatctgccatatgcacttttctagatagctattcaaggaggaaacttacaaaaaaaaaaaggaagacactaaaaaacatgagattcattaaactaggaattcaacacaaaagagctggggggtctccacaggacggtgaggggagatgttaggcagccatgctccaggctgagtgaggtaccagtctcaatggatagaagcctctgggaaggacgtcttcaagcagatgaaactttcctaagattggatacactccactgtattataaagagattttatttctggggaagaatttggggaagaattagtaataattaatagaaaaaaagaaagataaattagacaactttaagaaaaacaaatttgtgtaagaaaattcattcaagtgtcctgtgtcaatcgtgcctagcatttacatggccataataaaataagcactacattttgtacccaactaaaatgaaaatatgggtaggttggaaggatgacaggccaggaagtatgcacgaatatggcagggagaggggtatgaaaggggggttaattcccttcttcaagagcctaatttttatttaagtgcaatttggtggaaggttatcagcctacacactggagcattatcagaaagaagtctattgcatttgctttggagatgttactaaacattcgtttctttgtatggtcatgtcactcgtatgatcaattataaggtaaatttttctctggtcattttaccaagtaaagttatatttcccttgagaaaaacgtgcttttttttttttgttatagacactatgaatcatacacaaatcagttttcactcttttgttttgaattttaatgaatatagaggtggctttgcattatgtttttatcatacatatagaatgttctggcattcatcttgcatactaacttcactgctgatttattatattttctgaccttcattttcctttctccatgctttcttcaattacaaattcttataatggctatatttcttcaaataaaagaaattattttgttttggaatgaggcaaggttagaagcaaacatataaataaatgcgactttgaacaattaatcaattttggatgcactttttgtaattgctttgcctgtttgtactgtgcagtcaccatatcttcccactggagcataaatttacaaacttcatgcaaatgcattatttgtaataaaactgactcatgagcattaaaagccaattatttctatacatctgctggctatggctggcaataattgtgcgtcattcagatttgtggctgtgtgtttgccttagtaagattttaatcactcattaatttatggtttacaatatgcatcatgggcgcctgtattccccaaactacctcagacttacaaatcgagaagctgcagaacttggaattgtgacaacagaggcctcttttaagttgtgtcttcatgccaatgtctactagaggatcatagatgaaataagacaacccccccacccacctcaaaacacactgagtacaattgatcttccattccattgatgaattactttttcattttttttataataccatactatgcatttttatgttacttttttatttgccagttaatgacttcttggtggcctaacctttgtggagacagg

SEQ ID NO: 1445 - DNA, 3312 bp, Homo sapiens
ttacttgttctcagtagagacacaacttgctttctgttttgcgggattccctctaactatatgatttggtgccatagttaagctcctagattctggagccagactccatgggttcataatcctgacttagttactagctgtgtgactctgagcgagttatttgactcttctgtgcctcgatttcttactctgtaaaattggaatgataatgataatacataccatatagggttattgcaaatattacataaactaatacatttataaaggatacacttgacatacgaagttgaatacaagttttaactattacttaacttctgctaatatttactccagttctgctcacattacttgcttattatacatttcagagtggatgaaataattctgcaagccagtgggaacaggaagcttcatgaagaggagaaaggcttagggctcagaaaccgcacagagcaggaggatagatgaatgtaaggaacagagctttgaggacagacacccctggattagacaatagctccaaaacttattaatgatggtgaatgggtgactttctaaaaccctttaaaccttatttgtaaaatgggaccatcaatatctattttgaaatcttgtataaatttgcaataatgtctgtaaagtatctgacaggagctcagaaatgacacaattctttaaatccactcacacccaacttttaaacaaaaagtagcagtatatcctacacacgatttttaaattttactatttaagttaacatcatgctatgaacatatttccatgtcattaaatattctattccatccaatatttaaaagctaatagaagtctgttaaatgcatatgccataatttatttaaccaattcggttgttttaatatttatgttgtttccaatatattatgctattgacaataaaatgatgaacatttatgatgatgaaccttggtattgcctctattatttttatttagtaagaggaattgcgggatatatcatgtgtacatttaattgtcttccaaatggtttataccagttaccctcacagatgcaataaatgagtgtgcccactcgcctgcatcttcaccagcatggacattacttttgtttaccgtctctgcagacttaagtgaaaatgatgtctcattgctttaactcttactacttctttactaatgagtataagtttttgcataattgttgtgtacttctttttgtgaactatcttggcttattattcatctttttcttaatttatgaaagctctgtttatttttaggtatattataatgctatgcattcaaatgctttctgttatcagtctttatcatttgtttgtatttgtttctactgtttttgacatatagaagtttgatattttgtgtgtttattgccatgacctttttattttatgatttcagccttctgtgttaagagtgtctctctttacttctcccctccacccaatgttaaaaatatggattataaattaaaacatagaatgcttgaccattagcacccacatcagggaaggtatgagacctaccttccttccttccttccttccttccttccttccttccttccttccttcctctttctttctcttccttcctcttccttccttcctctttctcttccttcctctttctttctctcttttctttctttttctttctttctttctctctttctttcttcctttctttctttcttttctttctttctttttctttctttctttcttcctttcctttctttcctttcctttcttttcttttttctgatggtctcactacgttgtcaaggctggtctgaactcctggcctcaattgatcccccagtctcagccttgggcttccaaactgctaggactacaggctaaatgtgtgatgtatgaagctatttattaccaatatggaataaaagttgtccaaagccatatagttatttttgtagatggaactggaagctgtgatgattgactttttgtgtcaacttgactgggtcatggggtgtccatatgtttggtcacatattattctgaacgtttctttgagggtgcttttggataagattaacatttaaactgatagacggagtaaggcagattgccctccctaatctgggtgggcctcatctaatcagttgaaggcttgcatagaataagctgaccctgaccctgaccaccaactaagagagaattccttctgcttgactgccttcaaactggaacattgaatttttttcctgcctttggacttggtctaaaatagcagcttttcctggctcttgagcctgctgatgttggactggaactacatcatcagctctcctgggttcccagcttgctgactcaccctgcagatttgggaacttgtcagcctccataatcgtgtaagccagttccttgtaataaagctcttgctctgtatctctatcatctccatctatctctatctctacccctgtcatctccatctatatctttatccctccatctacctctttctcatcatctccatctatctctatctgtagctccatctctatatatctctatttctatctgtctctatatatctctatctctatctccatctatctctatctctatttctatctctgtgtctatctgtccctatatatctctatctccatctctctctctatatatatattttcatctctctatctccatctccatgtccatctctatctctatcttcatctctctatctttatcatctctattctatctatctatgtatctatcatctatctatcatctatctatcatctgtctatctatctatctatctatcatctatctatctatcatctatcatctatctatctatctccaactatctcctattggttttgtttctctggagaaccctaatataggagtcctgaaggtaaacttagccaagcaacaaacataaattgagactgcaatatacctctttaaaacccagttaaggcatggcaaagttgaaggcattggccccgaatgcaaattgtgtctttcgctaagttaagagtattaatatccatcacacaagcttgctgggggctcaaattagatgacatataaaacattgggcaaattgctaaaaaaactttgttattaattataacttttatctgaagcaactcataaatggtgatgaccttagcagaaatatcctaagtgactttgtaataattttaaagtgggagaccattaccccccacaaacacatacaaacacatacacacactatgcacatgctcattacatacaaatacatagacatacac

SEQ ID NO: 1446 - DNA, 3312 bp, Homo sapiens; identical to SEQ ID NO: 1445

SEQ ID NO: 1447 - DNA, 2547 bp, Homo sapiens
ggggattacaggtgtaagccaccgcacctggcgattctttttaaatattttattttttacagctttatagaggtatgattgatatataataaacagcacatactaaactatacgatttgatgtctgacatatgtgaaatccatgaaactatcaccacaattagtattataaaatatccatcattcaaaaattttctttgtgctcctttgcaatttatccctcgctacctcccatcctgccccaaagcaaccactgatctgttgccttttgttactccggattagtttgtaggtgggcttcatttaatcagttgaagtcctgatattaaaaaaaggccctcgttttccattttcaggaagaatttatgtaagattggtaatatttcatctttaaatgtttggtagaattcaccaatgaagtcacctgggcctggagttttcttttgagaccacacatttaacttctttattagatatagagctattcacattgtctattccatttcaatgagctttgataatttgtttctttcaaggaatctgtccattgttgtcaaatttattggcataaacttgtttataattttcttattttcctgcaaatgtctacatgatctggagtgatgtgttctctctcattcccaatatcagtctggctagaggtttatgaattttgctatttttctcaaataaccagttttgggttttattgaatcactgtttgcctgtttattatttttaatgttatctttaaattttccttttccctgattactttgagttttattttatctcctttctctagtttcctatgtacaactatagatcattgatttgagaccttgtttacaatgtagacatttagtgctatacattacactctaagcattgctttagctgtatatcacagatttttaatgggatgtgttccccctttcctttagatcaaaatgctttgtaaagatctttcagttattaaaggcataataatgttttatattataaacaacttaatggcagtaaacccaactgaaatgaaatggataaatttcctgaaagacaccaactaccacaacttgctcaacaagaataggaaactgaaatagtcagtggtcaagcgaaaaaaaatttgaatttttttttttttttttttttttgagacagtcttgctctgttgcccaggctggagtgcagtggcgcaatcttggctcactgcaagctccacctcctggattcacgccatgctcctgcctcagcctcccgagtagctgggactacaggcacctgccaccacacctggctaatttttttttagtagaaacaaggtttcaccacattagccaggatgatctcaatctcttgacctcgtgatccgcccacctcagcctcccaaagtgctgggattacaggcgtaagccaccgcgcccagccaaaaaattggatttgtagctaatatctttcccaggaagaatactccaggcccagatggcttcactagtgaatcctattaaatgtttaaggaagcaataaggccaattttacagaaaatgtccctaaaaatgaaataggaggaaatattttccaactcattctatgaggctagcattacttataccaaaactagacaaaagatattacaagaaaaaaaaactgcagatcaactttcttcattaacacaggtgcaaccaaatgagctaacctcagtaatgaaaaaaagttcattcaatatttaacagttaatgccgttttctatattaacagacacaaaaagaaacaagaaaaaccacatgatcatctcaatagatgtataccaagtatttgacaaaattcaatatctatttattataaaaatctctcaacaacaaagaatagaagggaattttcaacctgatatagcatctaagataattcacagttaacatcacagttaaaatacattttacatcataacatttacatcatacatgtaaatgacctaatgccttttttcctaagattaggactaaagcacaaatatctgctttatctacctttattcaacgaagcatggaaatgatcaatgtatgattcacaatatttatgggttactgctcagtgagggaagagtgctgccatcactatgtggtatataaaaggctctgaagaatagttttactatctcttgctcttaatgttctgtacacaggtgttcatttgttgcccattaacatgtgcatgttcatctgcattaaatctttttatgtatatttttctaaattaaaaaattgcagattccaaggaccaaaaactagacacttctattcaatatcttagtctggcaccaagaaatctacatttttatcaagttcctacagtaattttaataatagtagtctaagggtcacattttgagtatccgtattatttccatagtttgaatattttactcttataacttagcacttcagaaagagctacaatgtgactaaaggaggcagtttataataaataaacatacaaccattctaattccagaaattatcactttactatacaaaaaaacctaaac

SEQ ID NO: 1448 - DNA, 2547 bp, Homo sapiens; identical to SEQ ID NO: 1447

SEQ ID NO: 1449 - DNA, 2221 bp, Homo sapiens
aaaaagttcattcaatatttaacagttaatgccgttttctatattaacagacacaaaaagaaacaagaaaaaccacatgatcatctcaatagatgtataccaagtatttgacaaaattcaatatctatttattataaaaatctctcaacaacaaagaatagaagggaattttcaacctgatatagcatctaagataattcacagttaacatcacagttaaaatacattttacatcataacatttacatcatacatgtaaatgacctaatgccttttttcctaagattaggactaaagcacaaatatctgctttatctacctttattcaacgtattactggaagttctagccagtgaaataaataaaggtaacagaatataagttgaaaagaaagaagtaaaactgtctatattctcagaagatatgatcatctatgtagaaaatcttaaagaatctacgaaaaactactagaactgaagtagggagtttagcaaggttgaagaatacccaatcagtatacaaaattgattgcatattcatatattaggaacaaacaactggaaattgaaatttaaaaaccaatatcatttataaccacatcaaaaacaatgatatacttaaagataaatttagccaagaatgtataagacttgcacactgaaaacagtaagacattggtgaaaaaaaactaaagaagacctaagaagatgaaattatacatatgtgtgttggaagactcaatatttttaagatgataattcttcccaaattaacgtatagattcaatgaatcctaatcaaaaatacttgcaggattttttacagaagttgacaagcagattctaaaattcatatggaaaggcaaaggatctaatctagccaaaaatttttgaagaagtttaaaattggaaatctcacactatctgatttcaaggcttataatataatgctacagtagtcatgatagtgtcatattgtgtatgaagagatatatcaatctatggaacacaaaagaaagttcagaaatagccccacacacactgcctgtagtcccagctactcaggaggctgaggcaggagaattgcttgaacccgggaggcagaggttgcagtgagccaagatcatgccactgcactccagatcatgccactgcactccagcctggtgacagcgcaagactctgtctcaaaaaaaaaaaaaaaaagccccacataaatatggccaatcgattctttgcaaaaatgtcaaggtaattcatgagagaaaaagtcctttcaacaaaatgtgctataatggttgaatacacatatgcaaaaatgactttcaccatggcctcacatcatacacaaaattaatttggattgggtcatagacataaatgtaaaactaaaagtatgatgcctctagaaaaaaatgaatgagaaaatctttgttgccttgggataggcaaagccactgttaaaaaaaaaaatgaaaacgcaagccactgcaattactgaaagaaaacatttgctaaatgtatattccataaagaatttctattcagaatatataagagaactcttagaattcaataagaagacaaacaacctgataaaaatttgggtgatgggttttaatagatgtttccccaaataagatatataaaaatgataaatatatgaaaagatgatcaatctagttattgggaaattaaaactacagtaagataccatgacccaacactagaatggcaaaaatttaaaatacaaatgccaagtgtttatgtagatgtagagtaactgggaccaaaatcctaggtctctctctttctttctctccctctctccatatatatatatatatatatatatatatatattcacatatccacataaatatctgcatttaaatatttataccagacttattaacaatagccaaaaatcataaacaacccaattgtctactgatgactagataaataagctttaccataagcattcagtggtatgctctaacaataaaaaataacaaaccgttgatatacataatgacataaataaacctcaggagagtcaagctaagtgaaggaagacagacataaaagactatatactgtacaatctcatttatataaaattctagaataggcaagagtatagtgacagaaaacagattgatttttgccaagggccagaggaggcggagcttgcagccagccgagatgcgaggtggcgcc

SEQ ID NO: 1450 - DNA, 3651 bp, Homo sapiens
cgcccagccaaaaaattggatttgtagctaatatctttcccaggaagaatactccaggcccagatggcttcactagtgaatcctattaaatgtttaaggaagcaataaggccaattttacagaaaatgtccctaaaaatgaaataggaggaaatattttccaactcattctatgaggctagcattacttataccaaaactagacaaaagatattacaagaaaaaaaaactgcagatcaactttcttcattaacacaggtgcaaccaaatgagctaacctcagtaatgaaaaaaagttcattcaatatttaacagttaatgccgttttctatattaacagacacaaaaagaaacaagaaaaaccacatgatcatctcaatagatgtataccaagtatttgacaaaattcaatatctatttattataaaaatctctcaacaacaaagaatagaagggaattttcaacctgatatagcatctaagataattcacagttaacatcacagttaaaatacattttacatcataacatttacatcatacatgtaaatgacctaatgccttttttcctaagattaggactaaagcacaaatatctgctttatctacctttattcaacgtattactggaagttctagccagtgaaataaataaaggtaacagaatataagttgaaaagaaagaagtaaaactgtctatattctcagaagatatgatcatctatgtagaaaatcttaaagaatctacgaaaaactactagaactgaagtagggagtttagcaaggttgaagaatacccaatcagtatacaaaattgattgcatattcatatattaggaacaaacaactggaaattgaaatttaaaaaccaatatcatttataaccacatcaaaaacaatgatatacttaaagataaatttagccaagaatgtataagacttgcacactgaaaacagtaagacattggtgaaaaaaaactaaagaagacctaagaagatgaaattatacatatgtgtgttggaagactcaatatttttaagatgataattcttcccaaattaacgtatagattcaatgaatcctaatcaaaaatacttgcaggattttttacagaagttgacaagcagattctaaaattcatatggaaaggcaaaggatctaatctagccaaaaatttttgaagaagtttaaaattggaaatctcacactatctgatttcaaggcttataatataatgctacagtagtcatgatagtgtcatattgtgtatgaagagatatatcaatctatggaacacaaaagaaagttcagaaatagccccacacacactgcctgtagtcccagctactcaggaggctgaggcaggagaattgcttgaacccgggaggcagaggttgcagtgagccaagatcatgccactgcactccagatcatgccactgcactccagcctggtgacagcgcaagactctgtctcaaaaaaaaaaaaaaaaagccccacataaatatggccaatcgattctttgcaaaaatgtcaaggtaattcatgagagaaaaagtcctttcaacaaaatgtgctataatggttgaatacacatatgcaaaaatgactttcaccatggcctcacatcatacacaaaattaatttggattgggtcatagacataaatgtaaaactaaaagtatgatgcctctagaaaaaaatgaatgagaaaatctttgttgccttgggataggcaaagccactgttaaaaaaaaaaatgaaaacgcaagccactgcaattactgaaagaaaacatttgctaaatgtatattccataaagaatttctattcagaatatataagagaactcttagaattcaataagaagacaaacaacctgataaaaatttgggtgatgggttttaatagatgtttccccaaataagatatataaaaatgataaatatatgaaaagatgatcaatctagttattgggaaattaaaactacagtaagataccatgacccaacactagaatggcaaaaatttaaaatacaaatgccaagtgtttatgtagatgtagagtaactgggaccaaaatcctaggtctctctctttctttctctccctctctccatatatatatatatatatatatatatatatattcacatatccacataaatatctgcatttaaatatttataccagacttattaacaatagccaaaaatcataaacaacccaattgtctactgatgactagataaataagctttaccataagcattcagtggtatgctctaacaataaaaaataacaaaccgttgatatacataatgacataaataaacctcaggagagtcaagctaagtgaaggaagacagacataaaagactatatactgtacaatctcatttatataaaattctagaataggcaagagtatagtgacagaaaacagattgatttttgccaagggccagaggaggtggtgggtggggagattcactgcagtggagcctgatggaaatcttaaagtgataaaaaaaaagttgcatttcttgattgtggtggtagttaatgaattttattgtatgaaagttataccccaaataaatataattttaaagatactgtgaataatagtataaaaatccaaactccatagaaataaatttttaaaaggaataaggcgtttatgaaattaaaaaaaacatttctgtaagacatcaaagatagtctaaaaataataactatgttcatggattagaagactcaatgctttaaaaatatcagttctattcaaagtgatctatatattcaatataagttgagttaaaaatcctaattttttgttctatatcttaacaaaatgactttaaaatttatatggaagttcaaaaactagaataatcaagagacatttataaaaagaaatatatattaatttatgaatataaatatatatattcatatatataattagcttttcaataaatggtatagggacaattgtttcatacccaccctgcgttgtataaaaaaatccattccaactatacagccataaaaaagaatgagatcatgttctttgcagagatatggatgaagctggaggccattatccttagcaaactaacacagaaaaccaaatgccacatgttctcactcatgagtgggagctaaatgatgagaacacatggacacatacaggggaacacacacactggagccttttggaggaaggagggtgggaagagggagaggatcaagaaaatcagctaatgggtactagggttaatacttgggtaataaaataatctgtacaacacagacccccatgacacaagtttacccatgtaacaaacttaaacttgtaccccttaacttaaaagttaaaaaaaatccattccaagtggagaaaaatgaatgacctataactacacaaatgtattatgaaaaacataactttgagtgaaagaatagttacaaggcaaatgtataattggattgtatttatataaaatgcaaaatctggcaaaactaagtaatgtactacttagggatacatagacaggtataaaacctccaaaggggcgaggcgcggtggctcacacctgtaatcccagcactttgggaggccgaggcgggcggatcacgaggtca

SEQ ID NO: 1451 - DNA, 3651 bp, Homo sapiens; identical to SEQ ID NO: 1450

SEQ ID NO: 1452 - DNA, 1852 bp, Homo sapiens
tccagcaggcgcagcgagcggcggtggcgcgcgcacgaggccgccagcaccgtgtgcgcccgcaactccctcagcgccccgagcaccccgcagcgggtccaagtccgagggcagcacgcggcccgggaagcgctgctcagctagcaggtcacggacgcgcggctgcagcaggcgcgcgcgcagcacggcgcacggaaggcgcaccaggtaccagacgtccagcagcgcaaagacagcgagccccagggccagcaacgccaccagcagccccagcatagcggcggcggcgggcgcggggtcctgcggagtccgtggcgccggtgccggtgtccgcggcgctggttacggtgcccgccaggcctcctgggaactcacgagcgcagcgcgcccggagcgaaccacagcgcgagggcggccgagggggaggggcccggagccccgcccaccgtggcgcgaccttctcagcgccctacgtggtccgtcccgccgtccaggcccgcgccactttcgcgttccctggggcggggcgggcggcgcgctgagcgccacagcggcacctggcggccgtgcgcggcgctgcaggcgcgagggtgcacgcgcgccccggcgtctccgccttcccagcagcgcgagaccctcgccaggctctgaagacgcggcctggccctggccgttcggcccttcgtctgagcgcaaaggctccagcacctccgcggccgaagccgcgggacttttcgtggaaaatgggacccagcccgatcgccagcggcgctgcagcggactctgcgggaacctagcttctgctccaggacctccagggccaccccagctcgcagggcgttcgcagcggctcagggcgaatcacgctcatggtccccgtgcgcattttcagccccagccggtacctccttactcgccctcacgacattcattccaccccctaaaggtcctgccaaccccaggctcttcccgagcattcccgcccttcctcccttttgaaaccggagcaaatcacggccgggcggaagcgggggagcccgggtgagagtcagtgactcagctgcggactccaagtgtcgccggaggccctggggcgcaggcccagcgggctgtcgcacagctcggctgtcctgtgccccttcctgacgaggctggggaggaaaggcggcccagagaaggccggaccagctctccccgtcagccccaggctctcgaatgacagcggatgccagcgaccggggatggggtcccggaattgctgggttaaacaagctccggattcaggcctgggcctgggctggggttccagggttctggaccgccctcaaagaaggagctccctggggcggcacctggctctgcttgatagccccagggacagggagctcactacctatcagggcagctcccccagtgccgagaccagctcggtcctggagaccctaacccagcggtgctagaggaattaaagatacacacagaaatatagaggtgtggagtgggaaatcaggcgtctcacagccttcagagctgagagcctccaacagagatttacccacgtgtttattcacagcaagccagtgataagcacagtttctacagattatagattaaaagtaccccttagggaaacaaagggatgggccaaaataaaggggtgggtttggctagttatctgcagcaggggcatgtccttaagtcacagatggctcatgctattgtttgtggtttaagaacgcctttaagcggttttctgccctgggtgggccaggtgttccttgcccttattccggtaaacccacaacctcccagcgtgggcatcatggccatcatgaacatgttacagtgctgc

SEQ ID NO: 1453 - DNA, 10522 bp, Homo sapiens
ccgggtgccagtgggttgtccccctgcgaggagctctgagagcgacgggccatgttggggccaggggcctggaggggcagggagacacatgactaggggtgggggcactgggaccactcctaccctcgagcatggacacactgtggaaagggccgtcagtgacttgggtaggctggagtttagcccatgcccaggaggccttccagggcaccagccgaaccaggctcacagagagcaacccagaccctaggatgcccctagctgaggggacactggcagagggctggggcacaggtatcccagccctgtctctcctttctctgggaggctgaggcaggaggactgcttgaagccaggagtttgaaaccagcctgggcaacacagcaagaccccatctctacaaaaaattttaaacattaggcaggcatggtggcgtgcacacatagtcccaggcacttgggaagctgagacagaaggattgtttgagcccaggagttggaggctgctgtgaattatgattgtgacactgcactcctgcctgggtgacagagtgagaccacatcactacaaaaaataaaaataaaacgaacccccccccccaaatatttcatgactgttggcttaaagacaaacaatccaggctgcattcatcattataatattcacttttttcttattttaagacattcacggacccctggcactgtgcctactggacaagctggtgccgcccatgctgcccatgtgtccgtctctgactgcctgggagactgtgggtaggtcactgcacctctctggcctacctctactgcacaacacagctgagggtccacatgacaccacgcctagcccaaggtgagcgcagcaaacagggctgtgactaccctcctcctggaatggcaaccttaagccccacacatagtcccgggccacacctcctccccatcctcagggtttcacaattgggctcccacagcccattctatgaccgcccagtcctggaacactgatccctagactccgtccctgtctcccagcaccccctccttcccttggcctacctttgacctctttcttgtcactgtccctctcagataaaacctccctgggccacagccccttggtgcccacagggccctgcagggcctgcactccacatcgcccaaatctggctctccacttgctcagagtcctgtccccaccagcccccatccagggcagcagggacctttccaggtcctgggctcgccaccaccatccatgcttggctgccccacagcccactctgttctccaaagggtccctgcgggggcctggcctctccagaaaggtgtcagatggggagcgcccagggcccacgcacacagggtcactgagctacctgggtacctctccctggaaggagagccctagggactgctcagtccatcccactgctcctcgggttggggagggaggcaggacacctgtccccgcctagcacacaggttcctgaatgttggccctggctaggaaggtgcccagaggagcgtgcccctgggcgctgacaggatggatgccggccagctggactacatgggtgctagccggagccacttggctgagaatgttggggtcaggaggcagccgtcctgcctggtgcccctgggggtgacatggagttgagacatgggaaatacctggtgccactcaacagccctagatgccaaccggcttgggagaagctgtcccaacatttctttgttggggcaccgtcctcatggttgacatatggggctggttagggcacaccgctctggttgtgccaggggcagatcgaggccaaccacatgggggtgaggtgtaggcctgtctggctgggccgaggagcccactcaccattgccagcctgtctgtaggggcggtgtctgaccatacagggcagggggaacaaccctgctgatgttgtttgagggtacttcccgacactggggggacactctagaaaggacccccactgtccctttggatttcagtgtccaggctccaggctgtgtgtaatgggggcagggaccatccagacagtggaagcccccgtggccaggagccctcccagcagacatgcctcgtcctcacagggtgatgcccagacctccaactgcttcattcctcacgtcgtctcctttcatgggtacgtgtctcctgggctatggacggggctgcagccactcccgagcccaagatggagcaccccagtggcctgcatgcccacacatttgcctaccaaacgtctgcccaagggagggagggcgcggaacccacccatgggcaatgactcagcacgaatccactcttctgcttgctgacccctgacctctgactcgaagtcagggccctcagctggccttcaaggaccccatcctctccaccctggcaggaagtggggttcctgagtatctggaaggaggaccccatggaaggatctggagttcctacacaaagtggggtgaacctgtgccaagttccgatgggcgcaggagggcgcggaggctctaggcggcggaaaggtggggtgcggaggacggggctcacagaccggaagtcgctcagtgataacttgcggagtgggcaccccagcccccaacggggtcagtgcaccctacgagctcgcggctgcggccgctgggtgccctatccgcccaccccagcccaggaacgtgggcgcgaggggcagcactcccatcactcgccctgctcgccacgcggggatccaggccgcaccctggccaccccagtccacggcggcccgggcggatgtccccagggaagggtccaggccgtgcccagcacccagactccagctaggccgcgagggcgggagcgagtcgggacggccgggcaggctcgacccggatcccgggccccttccccctcggctcttttcgggccggcgtcgtgcgggggcgctcgcgtccatatccgcacagcggcgccccctgtccgagcagccccgccaccccggccccgcgcacgcggccgcgctccactcccaccgcccctctctgggtcgcgcggccccggcccaggtgtgggcgcaagggtagcccaagtgggaccgcgccaaggggcgcccgccccccgcctcgccccgccccgctcgggccgggggaggggggccctacctggccaggtgcgcggggtctcggcacaggggcagcaggagccgaccgccgcccagcggcctcgcggtccggtcggcccgcacttcaaagaccccgacccccgggagcccaactgttgacccaaggctcaaagttcccagcctgacccctgaccctcgccccggaagtcggggtgactcggaagttccggctcagtcgctaggaaacgagcgagcccgacgccaggggcggagctctggcctcctcgccgagttgggggaggcaggtgcgacaggagaatggacagtaagaaggggagacccaaagctgcagctgggaagtggcagacgctccaccctgggcccaagacaagagctgctgctgggaagcccggggagaaccgcccgccgcagaggaaagcgggctggcaggcgagggagcccgcgtcggctgagagcccacaggcccccacaggtgagagcccgcacgtcccgcgccgctgtgggtgaccgggtgagctgttggcaggggggtgccctggcccgggacacgctcagtgtgggcgcgcgcttgcgtgtcatgtacacatgtgcttgtgcgcgcacgtgtgggagtgcgcgtgtacgcgcacctgtgagcgctcggcgcaggcccgcgacacgcccgagcccctcccgccgcgccccgctctcgcccacctcctggtgctccacctccccgccgcccgggtgcgtggcctctcgggaagaccctaccctgcgccactcgccctcgcgggggtcggggccgcctccatcccgggtccgccgcgtcgtgcccgccccgcgcgcgccgccctcaggtggcaggaaacggggccctgcgcgtcgccttgggcccggatcgccttctcaggctctgcagctccgaccctgcgctgttcccgaccggtgtcggccgctcaaaccttcctccgggcccgataccgccctgaggctcagcagcgcctcccaacgcgaactcgtcgtcggtctccacgcacccgctgcctccctcactgctcattctgtcctcgccgctgcctgccctcctgcttctgcgctggtgccgcgggactgcctcacccacggttccgcctgctcttccctgggctcctctccgcggagccgacggggcctcgcggccacatcaggtctgaccctggtgcgcccctgctgggcatgggccatgctggccgcagcctccagatgcaggcctggcaccggcagccacctgtcctccccagcccaggcccggcaccgcccatcgcctgatcgcctgtgtaccccaccaccccgccccaggtgtcaggataaggagcctgaccctgtcctgaggacgggagtagtggcagttgtttgataagagcctcaggggtgcgggagcacctccgcggaaggccccgtggtatgtcagtggtggagcgtgtccagtagctggggatttggccttggcaagaggcagctatgagaggaagcacggaacacaagcaaggccagactctagggaactctggggaggatgtcccttctgtcactgaaggccagcaccgaggctctgcccgggaccgtctccaatcattcctgtgtctgggtgtcactttttccaggtgcaggctcctggtgggaaaccaagaggccgctcttctgctctcagtgtcagggaaaggcagggacgcccccattttgctttctgtagtttgaggtggactcctagccttcctccaggacagccccgcctcactggctaggcgtctgggggcctcagccgctctgcggggtgtggggcagacaggaccagggagctccatcttgtcgagggaaactcaaactgcaggccacagagccaggagctgcatcctggccacactgaccctcaggccttcccatcaggagcctgtacctggagaaggtgacaccaagacacagggagccccatgacccctgccatggtgcctctttttgctacaaagtgggtttccagctcagaagcagggctgccgggggtgctaggaccgcacaggtggggttggcaggggggattctacacatgtgcctgggagtctatttcaggcagaacagactgtgtcccttgagagcagcaggtgtgaagtgaaactgccctgcctccagacggcgggctcagggcgaggcacttagcgtggagggcgtgctaggctccagcccacagcggtggccacccagctgacatgccttcggaggagtccatgccgctgactcagcgctttctgtgccgcagggacacctggtcgccatcacatggacacgctatttttgcactcgaggctattccaggaagtccatccagacagagcacgccttccccagcctcctcttattggcctgcagccctgctctccccacgtctggtgatctgtaaagagggcttgttctgcgtgggtgggacctgctctagatccatcttggaaaatgagctcatgccgttggtgtaaccaccattcctgcccccatgccactctgccccggggcctgctggctgacgtccatggtgcagtcgtgatgtccacgagcctgtctgtgccctcgctgcggccgactctctctaggagcgtccccacaggatgcagaacctccctttgagctcggtgttccctgctcctcacagagccacccccaagcctttcccagctgtccgcatcaccactgtcccgggctcgttcacttcaggccctggagagccagcccagccctcactggtgtccggagtcagtgatacacagcgctcaagtgactcttcccacccacaggaagtgggtgatgaggtgccccccgggggcttcccttgctgctgcccgccaggatctccctgcttgggactacagcatgcgggggaggtcaggctggagttggtgtgggagcctttcccagcctttcctctgcattggtgccctccccaggaggcatctgagctgcaaaaggggcgaatgcgatgtagacacttgggccccgggactcgcctgtgtcatctgggctgggccccacaaacaccacaaacaccttttccaccacgcaatagatggctgctgggctgcccaggggtgtgatgtggagctgggaaacccagcctgggaaggcagcattccaggagctgctttccaaaagaagaatagcctccaccaggaaggtgtggctgagccccagagccccagaaacctgcgggaagctccaaaggggggcctgccagaggatacacaaccaccctacctcctgcacacgggatcctccaaccagacagtgtggcccaagcagcctggctactttcaccttagccagcagccctgggccacactggggatggtcccaaacatggcctgtgctgctgtcacggtgctaaggggcctggcaagcacggggtctttcttgctggacggaggcacaggtgccagaatctatcttttgccctacagtgtcccggcacagcctagatctatggaccccttcaccgggtgctttatcccccaccccccagaactcctgggaccattgagatgcccaggagatgggggggccctgtgcctgtgtcccgttgctgctatagcagccaccacatctaccagctctgcagggtagccaccgggcacggccttgccaggctgacgtcgaggaaagccagccgtgctgtgggtttccttccctctggctctccacttctgcctccctcttccactgtttttggtttgggtttttgttttgttccgttttgtttttttttgagacagggtcagctgtcttgcccaggctggagttcaggggctattcccaggtgtaaccctagctcactgcaacctccaactgctgggcttaagtgatcctcctgcctcagcctgagtagctgggactacaggtgtgtgctcccacgtctggcaagcctctttcagtataactgtatgggtttttctccatctttttttcgtctttacaatttttgttctcaaggacttgggctgtttgacttgagtcttccagtctggattttgctgataagatggaacacctcgagagtgcatctttgttaacatttagacatgcgtcccctcctcgcttgctcagtggaattacgattgcacttggaaatgtatcgtgttgggtgtgttccttaagctgaacttccgtagatctggcaggacatttaacaccagaacacgaagcctgcttcagaagtgactgaaacggcatctgcctcacagtgcatatttaaaaaatgattttgttgtgtgaataattatgctgccatctacagataagtgagatcagaaacattagtttcatatattgtagtttttagtttctgaatacttattggattctttttcttttttttttgagatggagtttcgctctgttgccaggctggagtgcactggggcttggctcactgctacctccgcctcccaggttcaggcaattctcctgcctcagcctcctgagtagctgggactacaggcacccaccaccacacccagctagtttttgtgtttttagtagagacagggtttcaccatgttggccaggatggtctcgatctcttgaccttgtgatccgcccgtctcagcctcccaaagtgctgggattacaggcgtgagccaccaggcctggctccttttccactttcatggaccctcgtgattgcattggatctccccgggtaatctgggatgttcttcctggcctaaggtcagctgattagcaaccttagttcatctgcagtctccattctctttttgctgaatcacgtcaagtattcacaagttccagggggcaggaggtggacatctttgggggacattattccgcccaccagaaaacccaggagcagccacagccccaagacgaggcagggaaggagtgctgctgtctgccggtgaagatgaactgcttctgaccctcccgagcgaggatattgagaagaaagaatttgccaagatgctagtcacacaccaagtacagaggctatgttggtcggctgcagcaaaaagaccactcgcggcgtggcagctctcactggccctgctgcctcttcaagttgactgcagtccatcacccacggtcattattaatttgtttttgcaaaggccaggcaggtgaatctaatggagatggaaaccaccacacctgcttccctggtctctgatgttggtgttaacctctgcaattcctcaagcaaagcactccttctatcaggctcactgtcttgctggagggaggaagttccacaggctctcacttggttctttctgccgtaacaacccttactcctccggccaaggagccaatgtgagcattcagctggcagctaagaatgtgtatcccaataaacagggcagacctacagacccactggacccactagagatggacttgggccacagtgccttccatgacttcagtaaacagaggggtgtggtgatcttgtcaaagtcctggcgtcaatgtcagtgtccggctacacaccatgttcccgtcctcgaaaagcctctctgtacccctctatgttggtgacacaaccctggcaaatggccacagactcctttggggacagagtaggagcgtaactggtgggagtggttggcatgctttgtattgggagagccgcacgccctagggcttccagcctcctcttcagtttggcagctgtgagtctgaatttcactcaaatctggaaactgggtgagagactgtggcagctgctgtccggctggcagagcctgacgtgtctctgatcatactcactgggtcagcaacaccctactgaccttgtccagaatcccacatcccagttgatatcagggcaatcagtttcctggctgttttccccaatatcaacccgggcttacagaagacagtcaccacagagctcctgccaggagttcactcattcgtgcatttcttccttttttttttctttttgagatggagtctcgctctgtcgcccaggctggagtgcagtggagcgatctcggctcattgcaacctccgcctcctgggttcaagcgattctcttgcctcagcctcccaggtagctgggatagcaggtgtgtgccaccatgcccagctaatttttgtatttttagtagagatggggtttcatcatgttgcccaggctggtctcaaattcctgacctcaggtgatctgccctcagcctcccaaagtgctgggattacaggcttcagccaccacacccagcctcattcatacatttcttattgttgttgtttgagacagggtctttctctgtcacccaggatggagtgcagtgttgtgatcatgcctcagtgcagcgatcatggctcagtgcagcctcaaactcttgggctcaagcagtgctccaacctcagcctcctgagtagctaggactataggcacacagcaccatgccccggctatttttttattttgtagagatggggtctcactatgttgcccaggctagtattgaactcctggcctcaagcaatcctcccacctcggcctcccaaagtgctgggattaaaggcgtgagccaccgtaccttgcccttggtggaatctttagggttttctattcatacatataaaatcatatcattggcaaacagagataattttacttcctcctttccaatttggatgccttagatttcttttccttgcctaactgctctgtctagaactcccagcactatgctgaatagagtggcaagagcaggcatttgccttgttcctaaccttagagaaaaatccttcagccttttaccattgaggatgatgtttgctgttagtttttcataaatgatctatatcaggctgaataaatttctatttctagtttgttgagtgttccttgtttattttggttttggtttctctcactctcttctttttgagcaggggacaggggcacagtctgtcacccaggctggagtgcagtggtgtaatcccagctcactgcagcctcgacctctggagctcaagccatcctcccatctcagcctcccaagtagctgggactacaggtgtgtgccatcatgtctggctaaatttttaattttttgtagagatgggttctcactatgttgtccagactgctcttgaactcctaggctcaggtgatcctcccaccttggtttcccaaagtgttgagatgacaggtgtgagccaccatgcccaggctttgtttggagatgtttgattactgatttaatctccttgctagttatatgtctattcagatttcctatttcttcatgatttagtcttgataagttttgtgtttttaggaatttgtccacttcatctaggtcactcaatttgttggcatataattgttcagagtactctcttatg

SEQ ID NO: 1454 - DNA, 10522 bp, Homo sapiens; identical to SEQ ID NO: 1453

SEQ ID NO: 1455 - DNA, 10522 bp, Homo sapiens; identical to SEQ ID NO: 1453

SEQ ID NO: 1456 - DNA, 10522 bp, Homo sapiens; identical to SEQ ID NO: 1453

SEQ ID NO: 1457 - DNA, 10522 bp, Homo sapiens; identical to SEQ ID NO: 1453

SEQ ID NO: 1458 - DNA, 10522 bp, Homo sapiens; identical to SEQ ID NO: 1453

SEQ ID NO: 1459 - DNA, 10522 bp, Homo sapiens; identical to SEQ ID NO: 1453

SEQ ID NO: 1460 - DNA, 3779 bp, Homo sapiens
ggaaaaggaaaggaaaggaggaagaaacgaagaaacgaaggaagaaaggaagaaagaaagaaaaataaagaaaagagagagaagagggaaggggaggggaggggagcagggaagagaggagaggctgggcccagtggttcacacctgtaagctgaggtgaaggagtttgagaccagcctggccaacatcgtgaaaccccatctctactaaaaatacaaaaattagccagggttggtggcacgtgcctgtaatcacagctactcaggaggctgaggcaggagaatcgcttaaacctggaaggcggaggttgcagtgagctgaaatcgcaccattgcactccagcctgggcgacagggcaagactccgtttcaaaaaaaaaaaaaggagaaagaaacaaagaaagaaagaaaaatgcctccccaaggtgacagacgagctaagccaggcgaaaagtctaaagaaattcaagtgcaaaggccctctggcaaaaaggtcttggcagaaaggtggtcagtgtgcctgctgcactgaaactgctcctgtaaggcagggatcctataaggtaggccttgaatgtcatgatggggagctcggttaggacccccatgataggtaggaaggcagctggaaagagcagttctgccatttttacggatacattcatgagccatgatgggtcgtcctggtggacctctggagcctgacctgggtccacgtttgaggtctccgactttagtgaccctgggaaagttacttgagtttcctcatttgaatagccaagggtttctcgtgtttgatgccaaatgccttgtgcggggattggctccaaacctcagcctcatcagtcaatttatccttacgttcaagagcagccatttacaaaacgagctcagaaaattaaaaaaaaaatacaaactttaaatcgccagaatactgcataaactaaaagtaggccgggcgcagtggctcacgcctgtaatcccagcactttgggaggtcgaagcgggcggatcacctgaggtcaggaattcgagaccagcctgaccaacatggagaaaccccgtctctactaaaaatgcaaaaattagctgggcatggtggtgggcgcctgtactcccagctatttgggaggctgaggcaggagaattgcttgaacccaggagacggaggttgcagtgagctgagatcgcgccactgcactctagcctgggcgacagagcgagactccatctcaaagcaaacaaacaaataaaaacaaagtaaaagtaaattccccaggcaaagctgattatattgctgggataatcgactttgtcactgcagtctcacttggtactttaagaaactccatcttgatcctaggtctgggtcgatctgggcgttcctgctaattttctgttttaaaaacctaaagcaataaaaatgttgatattgacatttatcatttttatcctcgccctctgccttgttttgctgggagatctgttccacttggctgagtttagggagggcggggaagcgggggagaaaccgaggcgcagggtggagaaagggagaagccttgcagactgaacacatgagaaaacctggagaagggattcgctgctgcttatttcagggaagaaaaccgagaagtgaagcacagaggggtcaggttccgggagcggcgggaaggttgtagggggccccagggcaggtcctggagctcaggcagccggcaccgggagcccagctcaggctgcggggtgcaaccgggcaagagcgctcgggctgccgaaacgggaggagatcagaaaaaggagagacatggaaaaaaggagaggaagaggagcaacactcaagagggaaggaagaaggcagacactgaggaacgcccgcaggaacccgcagacaagcagagagccgggctgcgctgggagcggggcccgcggaaggggcggggcgccaggcggctcgaggccaatgggagggcgggccggggcgagggcggggcactaggcgaaacgacgccaatgggagggcgggccggggcgagggcggggaattaggcggtgcgaggccaatgggagggcgggccgggtcctctgggctgaggcggggtgccaggcggcacgaagccagtgggagggtgagttaggggcaggggcggggtcccaagccaatggaagggtgataccgagagggcggggcgccaggcggcgagagagccaatgggaggccgagccgaggaccgcgggcggtgggcctccccccgagaggagggagacccggaaggcggtgggggcggggagtggagctgacaacctgtcaaatccactttgggacgaactaggtcacgcgctccgcgggtcgggcacccccgcccgccaggcacggccgcggctccttcctcttcctgcccgcggtagtgggggtggggcaggcctcgggacacctgcctccgccgccggccgccggccgccgtcctcgcgcggcttcccgggcggctctgccccgaccgtagactcccggcccgctcgccgcggcaggagccgtggttccgcggacctgggcgcgctctctccctggccactgggagaccccccgcggcctcgcggggaaaacctcgggactgccccgcgcccccggccgtctctgcgtcgctccttctcgcccgcgaccgtggactcgtcctcgcgagcctgggttggcggaagctgcgggggccggggtcgcactacttggcgcggaagggccggcggtgggcggagggatccccgtccgcggggtgagccgctgggcggagccgggaggagccgcgaggatccgcagtggggagccgggaggaacctggcgccggcacccacccgccgcgcccacgcgtgccgcggtcgcttgtttcccgcgggagcccggccgcgctcggggggaggcgcgcgcgcagctggggctgcctgggtctaggagctccggagccaccgttttgtgcccgtggagccgcggggaaggcgcacgcgctcgggtcttcccggcgggtcgtcctgcactttctccctctccggtacggaccgcggcgttctgtttccaggcaaaggaaaataagtcaaagactcagaaggcagcctgaatccagggcctgggatgcagggtttgctggaacgccagccggtgcgatcgcgcccctgggattccgcttagcccgcgcgtccatttccctgcatggtggactcagtaaagccggatctgtccaacgcctgcagcgtggatgtggaggcggactaatcaactagtgctctgttattatttctacccatcccttttctccatgctaatttgcttagaactttaacattgaatggacagcaaatgtcatgttctgtttaattatcactccttgaccattatgttaatttctttccctaacaaggtgacgcattgttttaagtaacaatgaccaactcatctactcttcttccaaattgtgtaaattgaagggtaaaatgtgggaaaacgctaaatttgaatgctaaatttgaacatttcacacaacaataatttgaaatgcttctttgcaatattatggcgtttcggaacagataaaaatacttcattttcagacatttggtcaacaaatacttcttggacgtttatatgcaaagcaatgcatgtaacattttcattactttgcaagtgtgcttatcagtaaaagaattttgttttaaattctagccttcgtttaaatgtattttagttaccacattgggaagaaaataaaatattactatgtacggaatgtacag

SEQ ID NO: 1461 - DNA, 13105 bp, Homo sapiens
cattgagagaggaatgtctacagcatccttggtaacacattacagtgtttcacaaccctcctagccaggaagctgttcttaatgtttaaccttaatccctcccgctgaaatttaaggcccttttctcttgttgagtgcaaatggagaacagctgctcacgctcgtcgtctgacatcagctatttctcaggatgaccctgcgagacaggccagggtcattagacccaatttggttctcagcaaatatgtgtttattcctgcatgcgtgggccacaggctggtttcttgggtgcaatgaatagctgcaggtttattagggtgtctttttagatggatgtatgtttcccgatgtctatagaacactccggaccccggagagtgaagactctgcctgtcggacttgctttgagaagatccttctccacctccccatggcagaagttgcttcacagaggggaacagttttatggatgtggctgagaccttaaacttgaggcaacccatctgaggtggcatccagaggagactggctggcccctccttcaccttggatgtagtgctgtttctaggatctcttttcaatcagcaaaacaggggatgttccaagagggtgtggattccctgccatcccacatggtcaagtggaggggacgggaaaaagctatgaagggtttgtgaccacacagactctcctggccccctgtccttttggaaagaagacagggatgaaatataatcaagcaattaaccacccccatcatcaccaagaacaacagtatcaacaagaagaacagggacaacaaaacccacggatgaaacattcctttctcagctcagatcttatctggtgcgttctctctctgctctgtcttggtgtgtggtttagagaaacatggacaacgctgtttggaagaacagggtcgagctgttcctgatgtttatcggagactgggatcaaagctatccaggtcataaatctctctctgtggctgttgggccccagggcagctgaagagggttgacagccctttggacctcaaaggaaaaaatgtgctctactccacccactcccagctctgccaagaagctgtcctctgagaagccatggctgggccgttccattctggggagctgctgaaaagagctgggaggccgagaagaacttgcgtgtgctgggggagaggaagcctggccttgagggaggggtgcaggtgtggctcctctgtgtgtgggggctgggggaccttgtgtgccttttccttgtggctgtgaaatgctttatgagtacttccataggaggatggacagggagtcggggagataaactcagccacaaggccccagggcctcaggaaacttgcacccaaccctctcattttacagaagaaaactgtgcctggaaggttgaagggtttgttcccagtcacacaaccagggatccttaggacagccagaccaggaaaccatttccaaactgccaagccatggcagagtatcaagacctcaggaaccatcgagacaccatggaagcattgggaaaagcctccttagcttttgaagctcctcattgttcttgagtgtgcatggagcccatgactgcggggttttgtagacacctcagggattacatgactggtacccctgacaaagtcaaggctgctggacaaaatgagtccgaggatttcaggggcagctgggcgcaggagctggtgggctgttgggagtgcccctttactgggcaggcttccttcctcctggtgatggggggttcctcagcacaaaagtgaaggggtggaggggctggaggagcaggaatctctcttgttgataggtatgaggccttgaagtccttttctttgtcccaggattcatggacgcttcggggctgatctttgagttttcaagcatggggtgcagagacgtttaggtaaactcttaccgtcctctctcttcgtcagggcttcccaggaatcaacaatgcccaagaaggaagggattgtagaaatagcttaaccctttcatttaccaacgtggaaattgaagcccagggaagggaagggaccggtcgtggaagggagagccatcagcagaaagagaccctgagatcttcgcctgggattcccaggaagtccagcccgagctgattcacagaacaaatgcatgcaaaccttgctatcaataaattacacatgcacttacgtaaaacacataaaaatatatggccttggttttggaacaataccccacagataaaagtagctttaaatcctccataaaatgataaagtctagtcctaaactcctagcagttctgcgggtgatcacaggcggcaggagccgctcaaactttaatggcttggtatctccacatgtagacaggaggcagaaaaccatcggggatgaagtcgtgggctctagaattgcaaagacgtgggttccaggccaggcttggcccttgctaactgttgaccttgagcaaattacccaacctgttccttatttgtttctgcctcataggtagttgtgcagatgaaatgatatcagttctcagaacagtgctggggacagagtacactctatgctcaatacatattcacttttagagatatcttgggattctcagtctaagtgacattcaaaagtacctcactgggaggcaagaccaaggtggagcctcctcttggatgggatgtgggcctattttattttacttctttatttttgtaggtgcatgccaccacacttgctaattaattttttttttttttttttgtagagatggggtctcactatgttgctcaggctggtcttaaactcctggcctcaagcaatcctcctgcctcagcctcccacagtgctgggattacaggcatgaaccactgagcccggcacctctattttaaatctattttatcttttgagatatagtcttgctctgtcacccaggctggagtgcagtggcgcgatctcagctccctgtaacctctgcctctcgggttcaagcaattcttctgcctcaacctcccaagtagctgggactacaggcgcccgccaccacgcctgtctaattttttgtatttttagtagagacagggtttcaccatgttagccaggatggtcttgaactcctgacctcgtgatctgcctgcctcggcctcccaaagtgctgggattacaggcgtaagccactgcacccggctattttaaatctacagacaaatcacccatgaagtgcagtgggggaatagagggctgggctcagttaattcagaagaagatttatcccaggatcaggaaatgagagtttcagatgttgccagtagcttaagtggcttttagggccttttttctgtctggccagggctcatcctgggctgagctttaaggcctgttaggggctgaattctgtccccctcaaagtttatatgttgaactcataaccccagtaccttagactgtgactgtatttggagatagggtctctaaagaggtaattaggttaaaatgaggtcactagggtgggccctagtccaatagaaatgtgtccttgttggataaggggcaacgtggacacagacacgtgcagaggggagcccctgtgaagaagcggggagaagacagtcacctgcaagccacagacggggcctgtgaaggaaccaatcctgtcaataccttggtcttggtcttggccttccagcctccaaaacccagaggccatcaatttctggtgaggcagccctagccgcctttctaagcgttcatactcctggtttggcagaggggaagggaccacggccagcgcttcttaaaccttcgtgtgtgtgaaactcacttcctggggagctggatcaagatgcagattctatgaccatctagtttcccctttctcatcccttatctaatttgctcctctgtggaactgtgtgaagtagacagggcaagaattttcatccccattttccagattaagaaactgagtctcagatggaagaatcacagcaagtgagaggcagtcaagcctccaactcaggtcaagtgaggcgtcctcacatcccatgccccccgtaatttcccgatccctagcaggggcacctggggagactccctggtgatgctgtgtcaggactcccttctttattttgagacagagtttcactcttgtcacccaggctggagtgcagtggtgtgatctcagctcattgcaacctccacctcccaggttcaagcaattctcctgcctcagcctcccaagtagctgggattataggtgcctgccaccatgcctggctaatttttgtatttttagttgagacggggtttcaccatgttggccaggctggtcttgaactcctgacctcaggtgatccacctgcctcgacttcccaaaatgcagggattacaggtgtgagccaccgtgcctggcagggctccctttttgacagacactgtcttagacctcaggctccctcaggccttcgctcttgggggttggagctgaggggaggatggaaagtgtccctccccatcacagcgcagctagctggtgagaggggctgggagctcccggatctgtctggacatgcagccactcctggcagtccccacccctccttccacccagcccctctgccttccagcaagtgaatgaagtcaggcaggccctgggccatcccgggtgaaggagggagtgggcatggcttggcactccaagggctcgccattgggaggggcgtggagacggtgtgaactccttggtgtcttgctcttgtcatcttccagcatgacatatgcacaaaggtaccttttataggtgggaaattataggtgctgccacttcaaaggccttggcaaccagagctcctctttgatagatgacagtattattaatggtgatttattgctggggccattttgacaacagaaataaccagtttccccaccttttcggctctcttctcccacaccttcctggggatttttttttattttggctggccctgtgtgtttttctggctgcaggggttacctccctgcacgaggaggcatgggaggtaacccatggagcatctgcttaaggcacatagtgaggcatctggcttattaacttgtcatcatgtgtcataaagtttagtgaaatgctggcagattgtaatcctaaacagggcaattaccctcttattaaagcagtactttttctgtctgtctgtctgtctctctcttatttttctctctctccctgcctccaccccctttcctgggattgttgttacctctgccctacttgcacaattagtcatgagcggaggtcacctgcttcataatgatcccagagtaggcctggccttggcggggcagagctgaaggggaaggggcaaaggagagctaaccatggtgaggcttgctgcagcaagctggcctcacggggcatggggacaaggcgctgtcccaggcgggaggctgcagtaagaaggttgtggtctgaggtttctggctgcaggcagcgagaaggagagaggagagagagctgacaggagcgactgagcctctgtggacttcgccgctcacccagattttccggcagagatgcctccctctgcctttttctccctcactttcgtatctcgaaacacaggtggaaaataagaaaggaagtggcagtgggtgatgggggcctgggacatgaggactcctcacttgatctgaattggaggcttggctgccactcacttgctatgattcttccatctgagactcaatttctaaatctgtgaaatgggggtgaaacatcttgccctgtctgcttcccacagttttagggaagatcaaattagaaaagggataggaaaggggatggctcatggtaactcactccacaaatctgagggatgattgtaatttcatatgtgtgaccacagggtcttatgtcatgtctaacggagctctacccccgtgattccaaaggatcgttgactatattgaaatttggtcttctgtctctttctgtattcctcagggttttgatgaccttggtttctaaatctgcctgggaggcattgtttgactctggtctgaacaacaggagttttcggcacaggtgtgatcatgttacctgcacagtgcgaggttaagaagacaaatgggggtaggctagaggcaacagccaaatcacaatttgccagatctgaaaagaccttagagattacctagctgaattgtcccctgctgtagatttgtaaatcgaggctcgaagaggtagaataactttcctaaaaatcatcagataaatgacaggcagagtggagactagatctcccatcgccagacttggcccagtgctctgtccaccaaagcatgttgactgcatcaactctgggtgcaccttctcctcctttatcatcagtcagcgttcaggaaagcactgctagcagtcatttacaccttagcatgaatttaagccaacatttagttctcccaggtgcatttgctttttttttttttgagatggagttttgctcttgtcgcccaggctagagtataatggtgtgatctcagctcattgcaacctccacctcccgggttcaagcgattctcctgcctcagcctcctgagtagctgggattacaggcacctgccaccacgcctggctaatttttgtatttttagtagagacggggttttgccatgttggtcaggctggtgtcaaactcctgaccttaggtgatctgcccacctcggcctcccaaagtgctgggattacaggcgtgagccactgtgcccagccgcatttgcttttgaggtctcatcccattgtatagattgttccctgtcaatggcatttccagcactggtgagaagagaggcaaggcagggcttgtgattctcatccccaagaccctgccacttgcctactcgctcgggcaatgagggcgggcactgcttccagagttaaactgcactggacccagatctatgtgtccataagtcagagcaagtttgtcagaagctgtcagggagtaaggctgagtagacggatggagtcagactcatttaaaaatggaataccagcagataggtttaaaaatggaatgcggccggctagagtgaaggtggtccctaaaccaaacacctgtcccttctgtgtgttttctggtttctttccccattgctcgagaatgctagaagccagactagtattaagaactctaaattcctagcctggcatggtggtttacacctgtaatcccagcaacttgggagatcaaggcaggaggggatcacttgagcccaggaatttgagaccaacctgggcaacgtgttgaaaccccatctctacaaaaaatacaaaaattagtcaggcatgtggtgcatgcctgtagtctcagctacttgggaggttgaggtgggaggattgcttaagcccaggaggtcgaggctgcagtgagccatgatcgcgccactgcactctagcctgggtgacagagcgagaccttgtctcaagacaaacaaacaaacaaacaaacaaaaaactcttaagttctaagtgcctggagcagggagtgtttctgaggcctcatgtttaccagggcactgtgctatgtgcagggtagtgagggggagagacaccattccaacatcttggagcccaagtctagagtcagggccacagaggcgggagaggaagagaatcccactgcaaatgggctgggcctccctgcctttgcccattgagtgagcaacagtgctgtttctataggtctctttgagccttaagcatggaatgtgatgagactgaacagtgataaaatgtattgatggaacttctgttcattgaaatgcaaaggggaagaaagaatttagaaatgatctgaggtttccagcttggggagagagaaagtgagaggaagtgggggcctaaggggaatggaatgaacagccccgacttcaggcttgtagactgcaatggggcaaggcagctacatgcaaatgtccttcctggagcctggaaacaaggtcaaagcagagatggacaagtaggagcgcagcctagaggagataggtgatgcctgaagccatgagaaggggtgttatctctgcaggaagaagaattgcaacactcctcccagctgagcaaacagtctgggctgggatgtgagtggtatcacactctgcactcacttcctccttcagtggtcatttgagagttcactggggctgacctaccccattggtcctggaggacagaaaggaatggagaataaagaaggtctaaggtgcagtttttccccctcctccaaagccatgaagggacctatggatttgaaagctgtgtgtggtcactgtggacagagtgactcctaccccactggggggctttgccagccaaggcacaaatcaagccttctctttgccctctgaagtcaaagggagaagaccggggttgtccatctttataggcagcctcagatgatccaacctaatatacgtcattaacaaattgtgtgatcttgaacaagtcagtttatctcattgtgactcaagtgaacataagggtatagagcatttgccctgctgacctcactggatcattgtgaaataatagctaatgagatggtgcatagcaggtgttttgtaaacttaacagtgataggcaaagcttagttcccatgagaatgactctctgactattatctatggcattggaatactgacctcccttctctgagaaagctccagcggcaaaatgcttctgatctcaaactttaggaccaattttctggtttacagggcaggacgagccccttctcttaaggatcaaggggatgaaggagaattccctgcttttggtggggggttacttctgaaagccatgccctgctcccatctgaggaggtcacccagtcctagttttgtctggaagcaccctgcccagccccaggggccagccccatcccagccaggcctcagagatgtcagacctgaaaggcagctgctgcctctccttctgacaggtgtctccgccagagctgggagatgaggagataggcgagctgagcacctttcctccttgaattgataactgctttgcaatgcagctctgtacttgctaaatgaaacctcctgccccaccatgatggatttatggctgaaacatcttatctcaactgagaatattttatgagtgtgcatgggtgtgtgtgggataggaggagggaaaaggcagttttgcaaacatttctagaggtgctccataatctgccctaccctgaagtattatctagaagctctttctagatctgccaggcttaagcatctataagtcttctccagatgctagcacaatgtagatgcctcatgaaacatttgctgatgatgatgatgacgatgatgacgatgaaggctgtggtctggaaggggactctgtttttgataagtttaattcaatccagcaaatattgaacaaatgctcatttttgttcagggctaggaaagctactattattatttttttggtggggtggagaaaggggagagttggagaatataaaaataaatgacacaaactcttttctctacatccttggtctatactgaggggccaggacatgcacattcggagtggatgtggagcagaaggggttggagtggcaagaactaatggcccagagtgtagcttcaggagctggacacacctggtgggatctttaggtagtttcttgtcttttgagctcctcagttttctcccctctaacagggggacaacactattccctagctctaaggttggtgtgaaggtcataggatttgcgtaggggttacttggtaccatgtggggtcagcagctcagtagcatcaccaacacgaggatgaagatgaaggaccgactcactgacgagggtgggctggagatgactgggagccaggaaccatcacaaactcagggctctgtgtgcactggttatcccattcttttgcaaccttgtaaaattaatttaataggtagtacatccaagtggtttaaaaagcaaaaggtataaagaaatatgcagtgaagatgaaaattgctctcagttctgacccctcactattgtgctcctccttctcagaggcagctgttgtcattggtttctggggcattctttccaagggcgttgtacacccagcatctaatgatgctacctcttcttcctctttcttgttttaacccaaaaggaggaattgggagttgatgatagccatagagtggaaggcagcagctggagggaggaagctggatgtatctgagcatctactacgtgccaggcccagatgaaatcttatcagttctagcgaaatttggagaaagattcactgtcttagaatttgaaaacatcagtgctggaggggaaggtggaagccatctggctaatcttcatttactgatatggaagtgactagtccaaagtcccagagctttctgatttttgcttcttcttgctaggaaagcaattatcctataataatccttctttacaggtaaaaatattttatggtgcacctgcctcccttgccagtggaatgacagtctccatagacctgtgggccatctgggccctgggccagcctccttgtctcacactagcttgttggggacctgcccttgctggcacccatcattccagctccctcctgttgtaactcctgccccaaatcccaggacttgtcgctgccagctttttcccctgttgttccttgtcttcccacccttctcaggactcaggtcaccaggataggtggacatccaattcctgctggagtgccagcaggagagatttggggaactcttccaggtaaagggggttttacctgctaagggttgacttgtgtctcccccacaaattcaaatagtgaagtcctaaacctgccagtacttcagaatgtaattatctttgtagatagggtctttaatggggtaattaaattaaagtgaggtcactagggtggggcctaatccaatatgactggtgtccttataagaagaggaaattaggacacagacaggcacagagcgatgaccatgtgaagacacagggaagagatggccacctaccaccaagccatggtcacctaccatccaagccatggtcacctatcaccaagccacagtcatctaccatccaagccaccgtcacctaccatccaagccatggccacctacctgccaagccatggccacctacccgccaagccatggtcacctacccaccaagtcatggtcgcctaccatccaaggagcgaggcctggaacagatccttccccagagccctcagtaggagccaaccctgctgacaccttgatctcagacttcaagcctccagaactgtgggacaatccttcactgtcatttaatccacccagcatgtggtctcttgtcacagttgcattagccagtgaacctacccgggcccttctgcagtcacctggctcaggagtggttctggtcaggaagttctgaggccaggcaggatcgggacactccctggaaagacccgagggagatatttgggaaacaagagggctggtgtggcttctcaacatgcccaccataaatcctgcgccatcccagggccgatgggacctgctgtgtgtgcggtaaactgaatgccaggaagccaggctctgtcgatccctggttctgactgttgtgggatcttgagcaaatcccctcgcctctctgggtctcagtttcctgatttgtgggatggagaaaaggattaactgtcccacttaccttgaggctgtggtgtggattaaatgattaaaatgcataagtgcaattgcaaaaatatagaaccagcccatcaatcaatgagtgtataaagaaactgttgtgtatataatatatataatggaatactactcagtcataaaaaggaatgaattaatggcattcgcagcaaccacgatgagattgaagactactattctctttttttgctttgtttttgagatggagtcttcctctgtcacccaggctggagtgcagtggcacgatcttggctcactccaacctccgcctcccaggttcaagtgatttaagattggagactattattctaagtgaagtaactcaggaatggaaaagcaaacatcatatgttctcactcataagtggagctaagctgtgaggatgtaaaggcataagaatgatacaatggactttggggactcagggggaaagggtgggaaaagggtgagggataaaaagctacaaattgggttcagcgtacactgcttgggtgatgggtgcaccaaaatctcacaaatccccactaaagaacttactcatgtaaccaaataccacctgttccccccaaatctatggaaattaaaaaaaattaaataaagtgtgcaagtgctggcgaggccccgaaggagccccacattggtgatggcaacgcaggtgacagcactttctctccccagtggggctggtggtgcccattcctggctgccccactctgagtctgaggaggaaccaaggctttcctggaaatgcaggggctgccatcggcctgtgggcttagggtcccaaacagggagagcccattgtttgtcatttctcctcagtaagcagaaagctctaagccctgaagcctccggtaaacgtcagaacatttggacatctgagtccattgtctccaggtctcataattttcctacattaaaaatccaataatgcattttgtggaaaatttagaaagtacagataaacaagagaataaaaaacatgaattttaccactgtcaaagctgaaggtctatccttctagcctcttctttaaatgtgtgtattttcagaaaaatgaaaccctgttgcacataatactttataagttttttttttttgacaaggtctcattctgttgtccaggctagaatacagtgttatgatcatagctcacggcagcttcaaactcctggcctcaagtgatcccacctcagcctcccaaattgctgggattccagagctccagggtggtggcctgagggagggagctgtctgcttcccttgaggccgatgacctgtgccattcttgaccatcccctcaccaagaggaactgagactg

SEQ ID NO: 1462 - DNA, 1916 bp, Homo sapiens
cggaaggccacctaaggcagcaagttacgtcactgcctgaacctccaatctctgcctcttcctcctttaaccttacagaggaggcgggtcttccgggcttggaggcgggcttcccaactctgatgatgcagagctggaagaaacctcaggaatgctttcgattttgcagatgaggacagaagcccaggacttgccaaaggaacctcatgggagagtctggattagttcagagacctcacctttccatttaacttctgagtcttggttttcttatctgtaaatagggttattaaagttataccttctttgtaggatggttgcaaggattcagtttcactcatgtgatgctgtcagtacagtgctaggcttactccataaatgcttgagttagtgattattgttggctgcaggcgtaagaatctactacttttgaaataccaagaggacccagacacaaaccacaaacacagggctgtgatgtgaggtaagcccagtaagaaagcagttacacagggacttttttaaaaaagagatggtctcactctcttgcccaggctggcgtgcagtggcacagtcacagttctctgcatccttggtgtcttgggctcaagggatactcacactgggagacttgtacaccccaattttaatcctggctccagcatcagctgtgttgtatgacttggtgaaaattttcacacagaaatacatcttccaccattatacatttcttctggaaggaactatacaggcatgtggctaagcagacaaccacatcgctgttgggaaaggactggagagctcacagtaggagagagggatgagggcagacacgggctctggcctggagccaggattatctggaggcagctcagcatgactggcttgtgctgcctggcttctcccagggccccatcatgccataggagttaagggtcaaagcatagttagaaaaaaagcacaagccttttcctgttaaggctgagaaggaagctggacgtgaacactctgctttactcttaaccttaatcatgtaagttatctgacaggaggaggtcagtgacaccaggagttttaccttgttaacaaaccaaaatgcagatacctctgccagatcagaggtaggcagaagaccaattccaacttcaaaatgaacatgcatggtgtcccagtcttctagatctttatactttcgtcttcctaagtgtcagggaagaaaaccagaggcactaaaactgccaggttgctggagggagggagtgctgggaaccttgggcgaagccatagacacaaatcccagcggcagcctgtgcagtgctcaggaagccatgcatggtggggctgcttcctgcccaactatggcatctacatgagatgctcacttatttaagctcaactggaactaagtgggtgaccccttgattgtgctactacccattatgtacccacccatacccaccactccaaggctgaacagaaagggttgtctgacacccaggttttattgtttccactttattgctcaagcatggaacttgaggcaagcctggaccttcagcaacgtgcagagaagaggctgaggggattttgggacacaacctggccgagaggggaaactgacaggggaaataccagaacagggaacagggggtggtcaccatgacaccagaagacatcatcagccacaccgtcgggggtgaggaagggaacagagagaagaaatggcatagcagtggtttttcccatgtccctagcacccacatggaggccacatttggaaatggactgggagagggaaaggatgaggaaaacggctgcccaggagtctccctctccaccctgggttcttatcagacctcatccctaccacttgcctcttctacccttagaaaatggacctaacagagggagcaaaa

SEQ ID NO: 1463 - DNA, 1916 bp, Homo sapiens; identical to SEQ ID NO: 1462

SEQ ID NO: 1464 - DNA, 1916 bp, Homo sapiens; identical to SEQ ID NO: 1462

SEQ ID NO: 1465 - DNA, 1916 bp, Homo sapiens; identical to SEQ ID NO: 1462

SEQ ID NO: 1466 - DNA, 1259 bp, Homo sapiens
gtaagccagctggaactccctgggggagttggggcctcatgggtaggggcctgcagcatgtgtgtgttggagaccaggctgggttcagtgtgtggatgtgtatagtatctgtacccgctccccatggagctgtagtagattaggtgacattggaccccctaatctgcaggccatagagggaacatgggacatctccaggccaactccttttcttagtgatgagcagtgacttgcttgagccctgttttctttagacgctgactcctgctgtctgccagatcctcgtggtacaatgactggtgtagactggcttgttgaagtcactctctggatctgagcaacgctggctgagccgtgatgaagtattcctatccatccactatgcttcacagtgggaatctctcactgttcatcaccgctgccctagcagccgcagggattcttcacccatggttgcttaggtttataagcaaggaagctgaatgaagtccctttcctctctggatgagcccctgggtttctggaagagtcttaaaatcacccctaaatggcttccaagcactgaagcccgagatgttagctggcctgtgtgaggccttgagacagaatgccacagccacaccccaaggatgctgaaggggatttccctcctctgtggtttttctcctttcttcccgcagcactcctcctacgtgctaacatcttctagtcaaacaactctccttttcaaagggaccaggcacagtttctgcttatccctgagtagcagtgttcagtttcctgccagcctgtggagtttttcaaacaagccaatcacctcctcctgtgggaactgagaagcaccccaccctctcgatactacaaagcccctgcttgttccctagtgcaactcccatgtggtcctgtggagcatatggtatcttcctcttctgggcagtgagcatatgtgactaataaactatctatctcatctgttcagtgccaggtgtcatttgttctgccatcccatgacctagggtggggattccttccacaccaacagggtgaatgcaaggtgattaaaacaagaagcctcttcaggatctatatcctagggaaaaaattaaacaacaacaacaaaacaagaagcttcaactctgaccctgtattccagatgtgttacaggggcctgtctccccagagccactctccaggtcagagcttacctccccttgctcagggttaggagctctgggcaggaaaaggacatcatgttaaaa

SEQ ID NO: 1467 - DNA, 1579 bp, Homo sapiens
tgtctgacatattacacacagttgaagtgacacatcactctctcgcccagagcatcagtggggaaggtgatggaaaacagtagatggatccagtgattatttgtaatttcacattctgactccatctgcggcctcattaaggtgatagaaacatactaggaataaggcaccaaaaacaaaggtacaaaggcccagaagccatcagaatggaaacttgtaacagtgacatagaattcgtgaagtaaagaaatgtaagctccaaagaaatcatatgtagtaatccactttttaaaatatctttgaaaaggtagtaaaaatcaaagttcaatctggcataattaacttggttcctgagtttaaagccaaataaaaccctgtatcaaaaaatggttttattcatgctgtcttacatgaatatagtagaaagctgctggtttttaaaaggtatcaaaatggtaactcttagaacatatataaaaaaattcacagatccttcatcagtcacaatatttaatagtggtctctaaactattcgataaaatagctattgtttagaaacagataaatagccaactctagtgaccaaaccaggaaaaggaaatcctgaagcaggatcctaaaacctgtcactgtgcattttcatattctcagcagttgatgtatggaaatggtaaaagtgtggtgtgggttgcttttgaagcagctagcacccagactgcgtcagttctgattggctgcaaagtacagagtgttaatggcataaagccagctttttagtcactttcagtcatagaattgttttgttgttgttgttgttgttttttgagacagagtcttgctctgttatctaggctggagtgcagtggcactatctcggcttattgcaacctccaccttccaggttcaagagattctcctgcctcagcctcccaagtagctgggattacaggcgcccaccgccacacccacctaatttttgtattcttagtagagacagggtctcaccatgttggccaggctggtctcgaactcctgacctcaggtgatccacccgcctcagcctcccaaagtgctgggattacaggcgtgagccaccacgcccggccttcagtcaaagaattgtgatgaggatcggaatgcattgggtagctcagcagttagatttgatagattccaaggctggtctggtgagttacctgatttggtctatagcccttctagaactgtccagtggaaacctaagttcctgaggctcccagggttggtccgggctccctgagaacattagaaccagggaaggtatgggctgagtctgtgtgcccattcatcaggcttgccctctgttccagttacctgttgctgtggaacaaataagccccaaacttagggacttaagatagcaatgtggttttctggatttatggggcagttctcacttgggatgtatcatgcggtatcagtcatatgttagtggagtccagaatcacctgaaggcttcttctctctcatgtttggtgactgggcttggatggcttgaaagctggggctggtcaggataggcagacttttaaatggcgtc

SEQ ID NO: 1468 - DNA, 1579 bp, Homo sapiens; identical to SEQ ID NO: 1467

SEQ ID NO: 1469 - DNA, 3421 bp, Homo sapiens
taggatcttgctatgttgccctggctgggatgcagcggctattcacaggtgcaatcatagtgcactacagcctcaaactcctagcctcaagcaatcctcatgcctcagcctccagagtagctgggcctacaggtacttaacacctcatctggcatcccccagtcagatatttggatgagacccctgccttggctaacaccttgatgaaaacctgtggaaggttctaaggcaggagcaatagcaaaaattgggaatgggaagaaacaggtaccagccaggacacctgaacgaacttggagctcaggaacccaggaggggattggagagagtggggagactccatggtccacaatgaatgctccttccccatccgaaaaaatcccctagcccagtttttgggcagatgccagacttttattctgaagcgtgggccacaacctatgaggtaatctttggagcttcattctgaggcggaatcccattggccagttggggaagcccctcccaggattcctggcgctccgccttccctgaagcctataaaagcgcaggtccccgcctcggcagccacgggacacctgcatctgccaacaagactggaagcagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagcctcccaaagtgctaggattacaggcgtgagtcactgcgcctggcccaagtccggaattttcaacaggacatgggtgttactgtgcccatgtgacatttggggaacccaaggccctgagaaaggcagaaaaataacccacgcagggactctcagcccacaagtgaagctcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacacttaagggccggccagccaactcacagccccaagagagagagccaggctcatttaattagcaattacaaggcactgattcctcattagctctggcaaccctcgtctccctcctcagccccagacaaatgaaatctttctctctctcccaggagtactgcctcagtgggtccattaacaagcagagaaaatgagattagaagacacctaaatgccagaggcactttatgaatgggctgagcagagggaggttcaatgtctgggttaggtctaattgtgggaggtttcctggtctatttagaattgccccctgggaatgcaaggtctttcagaaaggaaaaggcacacagatattgccttctggggtcctcaatggaggaggacattctgctatgggtgtctcccagtcaccccaaattaatcatttcaaagtgaacactcaatctgcccagcccctagcttcctcccctgacatgcccatgaatatgacagtccctctacatgcccaagatcctcccctcctcatccactccccatgatccccaagatgagtcactgtgctcaaatccatcctctctcctccagccctctgcctccatgacctccctccagccctctgcctccatgacctccgcctccctgcatgtccggatctcctcactgtctcccctctgagcatacacacacatacagcctgttcattctctacatgcagcgaggggactttccagaacacacatctgaccaagttccactcctgcctgtcacccttccaagagccccactgactgcagaataacgttcaaatatccggttgggcgtggtggctcatgcctgcagtcccagcactttgggaggccaaggtgggtggatcacttgcacaggaccacaggcgtgtgccaccacacccagctaatttttatatttttggtagagacggagtttcaccatgttggccaggctgacctcaagtgatccacccgcctcaacctcccaaagtgctgggattacaggcatgagtcactgcaccggtctaattttttcagagtctcactcttgcccaggctggagtgcagtagcatgatctcggttcactgcaacctctgcctcctggtttcaagcgattctcttggctcagcctcctgagcagctgggattacaggcacgtgccaccacacttagctaatttttgtatttttagtagagatgggggtctcaccatgctggcacagttggtcttgaactcctgacctcaagtgatccacccacctcggcttcccaaagtgctgggattacagacgtgagccaccgcgcccggccagcctttattgattctttttaaagccacactaaccttttattttcccccaaagacccctgggagccctcagtttttcctggcagtttcatctttgtacccctgacctccccacacacacgcctagctcagtgctggcatccaatattcactttgggtataaatgcttgtgcctgagcctatcaccttcatcacacagaaaatcctggaggccacacacccctgtaaagacgagccattacccacagaggtccaaccaacttaccaccctctcccagccacccccaaggacccagcttgcagctgcctgctcaatggctttagaaactaaaaaaggtgaatgagtttccatcactgccctcctgggctttgccgttatggctggttaacttgacagaagaacacattatacttcattttttgctgttgtcttgttggaaaaaaaagtgacagctgggtgcagtggtgcacactgtagtcacagctactcaggagaattgcttgagcacaggaattggaggctacactgagcaatgatcgcctcactgcactccagcctgaacgacagagcaagaccctcttaaaaaatacgtgagagagggtgcgtatgatggctcatgcctgtaatcccagcagtttg

SEQ ID NO: 1470 - DNA, 3252 bp, Homo sapiens
taggatcttgctatgttgccctggctgggatgcagcggctattcacaggtgcaatcatagtgcactacagcctcaaactcctagcctcaagcaatcctcatgcctcagcctccagagtagctgggcctacaggtacttaacacctcatctggcatcccccagtcagatatttggatgagacccctgccttggctaacaccttgatgaaaacctgtggaaggttctaaggcaggagcaatagcaaaaattgggaatgggaagaaacaggtaccagccaggacacctgaacgaacttggagctcaggaacccaggaggggattggagagagtggggagactccatggtccacaatgaatgctccttccccatccgaaaaaatcccctagcccagtttttgggcagatgccagacttttattctgaagcgtgggccacaacctatgaggtaatctttggagcttcattctgaggcggaatcccattggccagttggggaagcccctcccaggattcctggcgctccgccttccctgaagcctataaaagcgcaggtccccgcctcggcagccacgggacacctgcatctgccaacaagactggaagcagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacacttaagggccggccagccaactcacagccccaagagagagagccaggctcatttaattagcaattacaaggcactgattcctcattagctctggcaaccctcgtctccctcctcagccccagacaaatgaaatctttctctctctcccaggagtactgcctcagtgggtccattaacaagcagagaaaatgagattagaagacacctaaatgccagaggcactttatgaatgggctgagcagagggaggttcaatgtctgggttaggtctaattgtgggaggtttcctggtctatttagaattgccccctgggaatgcaaggtctttcagaaaggaaaaggcacacagatattgccttctggggtcctcaatggaggaggacattctgctatgggtgtctcccagtcaccccaaattaatcatttcaaagtgaacactcaatctgcccagcccctagcttcctcccctgacatgcccatgaatatgacagtccctctacatgcccaagatcctcccctcctcatccactccccatgatccccaagatgagtcactgtgctcaaatccatcctctctcctccagccctctgcctccatgacctccctccagccctctgcctccatgacctccgcctccctgcatgtccggatctcctcactgtctcccctctgagcatacacacacatacagcctgttcattctctacatgcagcgaggggactttccagaacacacatctgaccaagttccactcctgcctgtcacccttccaagagccccactgactgcagaataacgttcaaatatccggttgggcgtggtggctcatgcctgcagtcccagcactttgggaggccaaggtgggtggatcacttgcacaggaccacaggcgtgtgccaccacacccagctaatttttatatttttggtagagacggagtttcaccatgttggccaggctgacctcaagtgatccacccgcctcaacctcccaaagtgctgggattacaggcatgagtcactgcaccggtctaattttttcagagtctcactcttgcccaggctggagtgcagtagcatgatctcggttcactgcaacctctgcctcctggtttcaagcgattctcttggctcagcctcctgagcagctgggattacaggcacgtgccaccacacttagctaatttttgtatttttagtagagatgggggtctcaccatgctggcacagttggtcttgaactcctgacctcaagtgatccacccacctcggcttcccaaagtgctgggattacagacgtgagccaccgcgcccggccagcctttattgattctttttaaagccacactaaccttttattttcccccaaagacccctgggagccctcagtttttcctggcagtttcatctttgtacccctgacctccccacacacacgcctagctcagtgctggcatccaatattcactttgggtataaatgcttgtgcctgagcctatcaccttcatcacacagaaaatcctggaggccacacacccctgtaaagacgagccattacccacagaggtccaaccaacttaccaccctctcccagccacccccaaggacccagcttgcagctgcctgctcaatggctttagaaactaaaaaaggtgaatgagtttccatcactgccctcctgggctttgccgttatggctggttaacttgacagaagaacacattatacttcattttttgctgttgtcttgttggaaaaaaaagtgacagctgggtgcagtggtgcacactgtagtcacagctactcaggagaattgcttgagcacaggaattggaggctacactgagcaatgatcgcctcactgcactccagcctgaacgacagagcaagaccctcttaaaaaatacgtgagagagggtgcgtatgatggctcatgcctgtaatcccagcagtttg

SEQ ID NO: 1471 - DNA, 3304 bp, Homo sapiens
taggatcttgctatgttgccctggctgggatgcagcggctattcacaggtgcaatcatagtgcactacagcctcaaactcctagcctcaagcaatcctcatgcctcagcctccagagtagctgggcctacaggtacttaacacctcatctggcatcccccagtcagatatttggatgagacccctgccttggctaacaccttgatgaaaacctgtggaaggttctaaggcaggagcaatagcaaaaattgggaatgggaagaaacaggtaccagccaggacacctgaacgaacttggagctcaggaacccaggaggggattggagagagtggggagactccatggtccacaatgaatgctccttccccatccgaaaaaatcccctagcccagtttttgggcagatgccagacttttattctgaagcgtgggccacaacctatgaggtaatctttggagcttcattctgaggcggaatcccattggccagttggggaagcccctcccaggattcctggcgctccgccttccctgaagcctataaaagcgcaggtccccgcctcggcagccacgggacacctgcatctgccaacaagactggaagcagaaagggacagagacggcgaagtttgacggtctggaaagcagagaccagcagggctgactgcttgggagcacgagggacagctctccaccgaccgaaggaggagaatgctatttatttcagcaccaaatatccggacagcgcctctcgggaggtccgagaagagaaccgcgatctgtttcagcaccggggctcaggacagttcccagcgggctccgtttcgtctccagaaccctggacagctcctccagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacacttaagggccggccagccaactcacagccccaagagagagagccaggctcatttaattagcaattacaaggcactgattcctcattagctctggcaaccctcgtctccctcctcagccccagacaaatgaaatctttctctctctcccaggagtactgcctcagtgggtccattaacaagcagagaaaatgagattagaagacacctaaatgccagaggcactttatgaatgggctgagcagagggaggttcaatgtctgggttaggtctaattgtgggaggtttcctggtctatttagaattgccccctgggaatgcaaggtctttcagaaaggaaaaggcacacagatattgccttctggggtcctcaatggaggaggacattctgctatgggtgtctcccagtcaccccaaattaatcatttcaaagtgaacactcaatctgcccagcccctagcttcctcccctgacatgcccatgaatatgacagtccctctacatgcccaagatcctcccctcctcatccactccccatgatccccaagatgagtcactgtgctcaaatccatcctctctcctccagccctctgcctccatgacctccctccagccctctgcctccatgacctccgcctccctgcatgtccggatctcctcactgtctcccctctgagcatacacacacatacagcctgttcattctctacatgcagcgaggggactttccagaacacacatctgaccaagttccactcctgcctgtcacccttccaagagccccactgactgcagaataacgttcaaatatccggttgggcgtggtggctcatgcctgcagtcccagcactttgggaggccaaggtgggtggatcacttgcacaggaccacaggcgtgtgccaccacacccagctaatttttatatttttggtagagacggagtttcaccatgttggccaggctgacctcaagtgatccacccgcctcaacctcccaaagtgctgggattacaggcatgagtcactgcaccggtctaattttttcagagtctcactcttgcccaggctggagtgcagtagcatgatctcggttcactgcaacctctgcctcctggtttcaagcgattctcttggctcagcctcctgagcagctgggattacaggcacgtgccaccacacttagctaatttttgtatttttagtagagatgggggtctcaccatgctggcacagttggtcttgaactcctgacctcaagtgatccacccacctcggcttcccaaagtgctgggattacagacgtgagccaccgcgcccggccagcctttattgattctttttaaagccacactaaccttttattttcccccaaagacccctgggagccctcagtttttcctggcagtttcatctttgtacccctgacctccccacacacacgcctagctcagtgctggcatccaatattcactttgggtataaatgcttgtgcctgagcctatcaccttcatcacacagaaaatcctggaggccacacacccctgtaaagacgagccattacccacagaggtccaaccaacttaccaccctctcccagccacccccaaggacccagcttgcagctgcctgctcaatggctttagaaactaaaaaaggtgaatgagtttccatcactgccctcctgggctttgccgttatggctggttaacttgacagaagaacacattatacttcattttttgctgttgtcttgttggaaaaaaaagtgacagctgggtgcagtggtgcacactgtagtcacagctactcaggagaattgcttgagcacaggaattggaggctacactgagcaatgatcgcctcactgcactccagcctgaacgacagagcaagaccctcttaaaaaatacgtgagagagggtgcgtatgatggctcatgcctgtaatcccagcagtttg

SEQ ID NO: 1472 - DNA, 3560 bp, Homo sapiens
taggatcttgctatgttgccctggctgggatgcagcggctattcacaggtgcaatcatagtgcactacagcctcaaactcctagcctcaagcaatcctcatgcctcagcctccagagtagctgggcctacaggtacttaacacctcatctggcatcccccagtcagatatttggatgagacccctgccttggctaacaccttgatgaaaacctgtggaaggttctaaggcaggagcaatagcaaaaattgggaatgggaagaaacaggtaccagccaggacacctgaacgaacttggagctcaggaacccaggaggggattggagagagtggggagactccatggtccacaatgaatgctccttccccatccgaaaaaatcccctagcccagtttttgggcagatgccagacttttattctgaagcgtgggccacaacctatgaggtaatctttggagcttcattctgaggcggaatcccattggccagttggggaagcccctcccaggattcctggcgctccgccttccctgaagcctataaaagcgcaggtccccgcctcggcagccacgggacacctgcatctgccaacaagactggaagcagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagtagagacggggtttcaccatgttggccaggctggtctcaaactcttgacctcttcatccgtccacctcagcctcccaaagtgctaggattacaggcgtgagtcactgcgcctggcccaagtccggaattttcaacaggacatgggtgttactgtgcccatgtgacatttggggaacccaaggccctgagaaaggcagaaaaataacccacgcagggactctcagcccacaagtgaagctgagaaccgggaatggaaaacagggaggcagcacagaggcaggaaactcaggtgtcatagcttggctcagcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacacttaagggccggccagccaactcacagccccaagagagagagccaggctcatttaattagcaattacaaggcactgattcctcattagctctggcaaccctcgtctccctcctcagccccagacaaatgaaatctttctctctctcccaggagtactgcctcagtgggtccattaacaagcagagaaaatgagattagaagacacctaaatgccagaggcactttatgaatgggctgagcagagggaggttcaatgtctgggttaggtctaattgtgggaggtttcctggtctatttagaattgccccctgggaatgcaaggtctttcagaaaggaaaaggcacacagatattgccttctggggtcctcaatggaggaggacattctgctatgggtgtctcccagtcaccccaaattaatcatttcaaagtgaacactcaatctgcccagcccctagcttcctcccctgacatgcccatgaatatgacagtccctctacatgcccaagatcctcccctcctcatccactccccatgatccccaagatgagtcactgtgctcaaatccatcctctctcctccagccctctgcctccatgacctccctccagccctctgcctccatgacctccgcctccctgcatgtccggatctcctcactgtctcccctctgagcatacacacacatacagcctgttcattctctacatgcagcgaggggactttccagaacacacatctgaccaagttccactcctgcctgtcacccttccaagagccccactgactgcagaataacgttcaaatatccggttgggcgtggtggctcatgcctgcagtcccagcactttgggaggccaaggtgggtggatcacttgcacaggaccacaggcgtgtgccaccacacccagctaatttttatatttttggtagagacggagtttcaccatgttggccaggctgacctcaagtgatccacccgcctcaacctcccaaagtgctgggattacaggcatgagtcactgcaccggtctaattttttcagagtctcactcttgcccaggctggagtgcagtagcatgatctcggttcactgcaacctctgcctcctggtttcaagcgattctcttggctcagcctcctgagcagctgggattacaggcacgtgccaccacacttagctaatttttgtatttttagtagagatgggggtctcaccatgctggcacagttggtcttgaactcctgacctcaagtgatccacccacctcggcttcccaaagtgctgggattacagacgtgagccaccgcgcccggccagcctttattgattctttttaaagccacactaaccttttattttcccccaaagacccctgggagccctcagtttttcctggcagtttcatctttgtacccctgacctccccacacacacgcctagctcagtgctggcatccaatattcactttgggtataaatgcttgtgcctgagcctatcaccttcatcacacagaaaatcctggaggccacacacccctgtaaagacgagccattacccacagaggtccaaccaacttaccaccctctcccagccacccccaaggacccagcttgcagctgcctgctcaatggctttagaaactaaaaaaggtgaatgagtttccatcactgccctcctgggctttgccgttatggctggttaacttgacagaagaacacattatacttcattttttgctgttgtcttgttggaaaaaaaagtgacagctgggtgcagtggtgcacactgtagtcacagctactcaggagaattgcttgagcacaggaattggaggctacactgagcaatgatcgcctcactgcactccagcctgaacgacagagcaagaccctcttaaaaaatacgtgagagagggtgcgtatgatggctcatgcctgtaatcccagcagtttg

SEQ ID NO: 1473 - DNA, 3491 bp, Homo sapiens
taggatcttgctatgttgccctggctgggatgcagcggctattcacaggtgcaatcatagtgcactacagcctcaaactcctagcctcaagcaatcctcatgcctcagcctccagagtagctgggcctacaggtacttaacacctcatctggcatcccccagtcagatatttggatgagacccctgccttggctaacaccttgatgaaaacctgtggaaggttctaaggcaggagcaatagcaaaaattgggaatgggaagaaacaggtaccagccaggacacctgaacgaacttggagctcaggaacccaggaggggattggagagagtggggagactccatggtccacaatgaatgctccttccccatccgaaaaaatcccctagcccagtttttgggcagatgccagacttttattctgaagcgtgggccacaacctatgaggtaatctttggagcttcattctgaggcggaatcccattggccagttggggaagcccctcccaggattcctggcgctccgccttccctgaagcctataaaagcgcaggtccccgcctcggcagccacgggacacctgcatctgccaacaagactggaagcagaaagggacagagacggcgaagtttgacggtctggaaagcagagaccagcagggctgactgcttgggagcaccaaatatccggacagcgcctctcgggaggtccgagaagagaaccgcgatctgtttcagcaccggggctcaggacagttcccagcgggctccgtttcgtctccagaaccctggacagctcctccagtagagacggggtttcaccatgttggccaggctggtctcaaactcttgacctcttcatccgtccacctcagcctcccaaagtgctaggattacaggcgtgagtcactgcgcctggcccaagtccggaattttcaacaggacatgggtgttactgtgcccatgtgacatttggggaacccaaggccctgagaaaggcagaaaaataacccacgcagggactctcagcccacaagtgaagctcttggaatgcactccctccacctccaaccagagctccccacaactgaccctgccttcttctgcaagctccatttcatcaagggaaacgatccttattgcctcaccatttcccacgtgaagtctgtattgacattctcatagacctgggatattgtgtctgcagcacatagtccaattattttcatgttatctactgacaggtctatttgtctccctgttacactgtgagctccgtgagggcagaaacaatgttagtattttcactgctgtgtccccagcgcctggtccggggcccggcacacagcaggcatataataagcatgtgttgaatcaataaaggcatcaaagaataaaccaatacatcaatcaataaatgaatgaatggcctcagcacacacaggaagatccttcttctaggtctcccccagagagatactggagggcaatggttgctggaggtgtttattggggaagcataattgaatttgtggacacttaagggccggccagccaactcacagccccaagagagagagccaggctcatttaattagcaattacaaggcactgattcctcattagctctggcaaccctcgtctccctcctcagccccagacaaatgaaatctttctctctctcccaggagtactgcctcagtgggtccattaacaagcagagaaaatgagattagaagacacctaaatgccagaggcactttatgaatgggctgagcagagggaggttcaatgtctgggttaggtctaattgtgggaggtttcctggtctatttagaattgccccctgggaatgcaaggtctttcagaaaggaaaaggcacacagatattgccttctggggtcctcaatggaggaggacattctgctatgggtgtctcccagtcaccccaaattaatcatttcaaagtgaacactcaatctgcccagcccctagcttcctcccctgacatgcccatgaatatgacagtccctctacatgcccaagatcctcccctcctcatccactccccatgatccccaagatgagtcactgtgctcaaatccatcctctctcctccagccctctgcctccatgacctccctccagccctctgcctccatgacctccgcctccctgcatgtccggatctcctcactgtctcccctctgagcatacacacacatacagcctgttcattctctacatgcagcgaggggactttccagaacacacatctgaccaagttccactcctgcctgtcacccttccaagagccccactgactgcagaataacgttcaaatatccggttgggcgtggtggctcatgcctgcagtcccagcactttgggaggccaaggtgggtggatcacttgcacaggaccacaggcgtgtgccaccacacccagctaatttttatatttttggtagagacggagtttcaccatgttggccaggctgacctcaagtgatccacccgcctcaacctcccaaagtgctgggattacaggcatgagtcactgcaccggtctaattttttcagagtctcactcttgcccaggctggagtgcagtagcatgatctcggttcactgcaacctctgcctcctggtttcaagcgattctcttggctcagcctcctgagcagctgggattacaggcacgtgccaccacacttagctaatttttgtatttttagtagagatgggggtctcaccatgctggcacagttggtcttgaactcctgacctcaagtgatccacccacctcggcttcccaaagtgctgggattacagacgtgagccaccgcgcccggccagcctttattgattctttttaaagccacactaaccttttattttcccccaaagacccctgggagccctcagtttttcctggcagtttcatctttgtacccctgacctccccacacacacgcctagctcagtgctggcatccaatattcactttgggtataaatgcttgtgcctgagcctatcaccttcatcacacagaaaatcctggaggccacacacccctgtaaagacgagccattacccacagaggtccaaccaacttaccaccctctcccagccacccccaaggacccagcttgcagctgcctgctcaatggctttagaaactaaaaaaggtgaatgagtttccatcactgccctcctgggctttgccgttatggctggttaacttgacagaagaacacattatacttcattttttgctgttgtcttgttggaaaaaaaagtgacagctgggtgcagtggtgcacactgtagtcacagctactcaggagaattgcttgagcacaggaattggaggctacactgagcaatgatcgcctcactgcactccagcctgaacgacagagcaagaccctcttaaaaaatacgtgagagagggtgcgtatgatggctcatgcctgtaatcccagcagtttg

SEQ ID NO: 1474 - DNA, 3310 bp, Homo sapiens
gtaagcggcctctttttactctcttctccaacctccctcactatccctcaacctctttctcctttcaatcttggcgccacacttcaatctctcccttctcttaatttcaattcctttcatcttctggtagagacaaaggagacatgttttatccgtggacccaaaactcccacgcccgtcatggactgggaaggcagccttcccttggtgtttaatccttgcagggatgcctttctgattattcacccatgtttcaaaggtgtcagaccacgcagggacgcctgcctttgtccttcacccttagcggcaagtcccacttttctggggaaggcgcaagtaccccaaccccttctctccctgtctctaccccttctctgcttttctggggaaggggcaagtacccctcaaccccttctctttcaccctgagtggcaagtcccgcttttctacggggcaagaacccccaatcccttatttccacgccccaacctcttatctctgtgccccaatcccttatttccgtgtcccaacctcttatctctgcaccccaatcccttatttccacgccccaaccttgtatctctgtgccccaatcccttatttccacgccccaacctcttatatctctgcaccccaatcccttatttccatgccctgacctcttatttctgcgccccatcccttatttctgcaccctgacctcttatctctgcgccccaacccctttcccacttttctggaaggtaagaacccctgaaccccttccctccatttctctactctttcttttctctaggcttgcttccttcactatgggcaatcttccaccctccattcctccttctactcccttggcctgtgttctcaaaaacttaaaacctcttcaattcacacctgacctaaaacctaaatgccttattttcttctgcaatgccgcttgaccccaatacaaactcgacagtagttccaaatagccagaaaatggcactttgaatttttccatcctgcaagatctaaataattcttgtcgtaaaataggcaaacagtcttaggtgcctgacgtccaggcattcttttacatatcagtcccttcctagtctctgtgcccagtgcaactcgtcccaaatcttccttctttccctcccacctgtcccctcagtaccaacgccaagcgttgctgagtctttctaatcttccttttctatagacccatatgacctctcccttcctccccaggctgctcctcgccaggccgagctagttcccaattcttcctcagcctctcctcctccaccctataatctttttatcacctcccctcctcacacctggtccggcttacagtttcgttccgtgactagccctccccctcctgcccagcaacttactcttaaaaatgtggctggagccaaaggcatagtcaaggttaatgctcctttttctttatcccaaatcggatagcgtttaggctctttttcatcaaatataaaaatccagcccagttcatgacttgtttggcagcaaccctgagacgctttacagccctagaccctaaaaggtcaaaaggccgtcttattctcaaaatacattttattacccaatctgctcccgatattaaataaaactccaaaaattaaattccggccctcaaaccctacaacaggatttaattaacctcgccttcaaggtgtacaataatagaaaaaagttgcaattccttgccttcactgtgagacaaaccccagccatgtctccagcacacaagaacttccaaacgcctgaaccgcagcggccaggcgttcctccagaacctcctcccccaggagcttgctacacttgccggaaatctggccactgggccaaggaatgcccgcagcccgggattcctcctaagccacgtcctatctgtgtgggaccccactgaaaatcagactgttcaactcacctggcagccactcccagagcccctggaactctggcccaaggctctctgactgactccttcccagatcttctcggcttagcggctgaagactgacactgctcaatcaccttggaagccccctagaccatcacggacgccgagcttcaggggagagggaaaatcatttggggacagccaacttcttccttgagcggtgcagttataatcatgcattgtgccctctgtgagtgcttctttctcctttgaaattcttcagtgggttcttcagcatcgcccactctgttgctggagaccacccattgtgcccttggatggcgtgcccaatatccttggccagctggctgcattccccactcagctactgattgttgattgttgtgcttcacgaacttcccgctgagcgtcctctcatcctggggtggagagcaggcccatcacggggctcccacctgcctgcctgccatactgtccatgccagtgcctgagaaacaccgcctctgctccactttcagtgggaaccagcgttttgcacccccctccatagccttttctcttcactctaccacctgaagcaattcccactgggccgcttcttcacctttaagttttccagcaggagaagacaaggagatggagagactgtcaacctagaaccagtaatgaccagttccaacttaattacagaaagggagaaaagatcaatcatttaagttgcttcatcgtctaaataaaagtgttttggctgttgaaacatgaacctagactcctgcctcaacatatttaaaatgagaacaaagtggcagtatcatggtggtgggcgtttagatgcttacattgttttcatctacaaaacaggctttcctttcacaccctagctctttgctgggctggtggagctgattgacagatatagcccgctccaaaggaacagccctttctcaaggaatgaatgatttgctctaagtatttaaatcctctgctcaaaatcaaacataaattgaagtatcaaaataaacaaaaatatggtttgtggttttgaaagcatttctttgtgatttttgctaaaaagagaaatgccaaaaaaatttttttaaagattttgagacaattatctggcgcagtggctcacgcctgtaatcccagcactttgggaggctgaggcaggcagatcatgaggtcaggagatcaagaccatcctggccaacatgttgaaaccccatctctactaaaaatataaaaattagctgggcatgatgggcgcctgtaatcccagctactcaggaggcagaggcaagataatcacttgaatccaggaggtgggggttgcaatgagccaagatcatgccactgcactccaacctgggc

SEQ ID NO: 1475 - DNA, 12934 bp, Homo sapiens
aaaagaaggaaaaattagtttgaatctcaaaaaaaaactgtcaggcctctgagcccaagccaagccatcgcatcccctgtgacttgcacgtatacgcccagatggcctgaagtaactgaagaatcacaaaagaagtgaatatgccctgccccaccttaactgatgacattccaccacaaaagaagtgtaaatggccggtccttgccttaactgatgacattaccttgtgaaagtccttttcctggcccatcctggctcaaaaagcacccccactgagcaccttgcgacccccactcctgcctgccagagaacaaacccctttgactgtaattttcctttacctacccaaatcctataaaacggccccacccttatctcccttcactgacacttttcggactcagcctgcctgcacccaggtgattaaaagctttattgctcacacaaagcctgtttggtggtctcttcacatggatgcgcatgaaatttggtgcggtgactcggatcgggggacctcccttgggagatcaatcccctgtcctcctgttctttgctccgtgagaaagagccacctacgacctcaggtcctcagaccaaccaggccaagaaacatctcaccaatttcaaatccggtaagcggcctctttttactctcttctccaacctccctcactatccctcaacctctttctcctttcaatcttggcgccacacttcaatctctcccttctcttaatttcaattcctttcatcttctggtagagacaaaggagacatgttttatccgtggacccaaaactcccacgcccgtcatggactgggaaggcagccttcccttggtgtttaatccttgcagggatgcctttctgattattcacccatgtttcaaaggtgtcagaccacgcagggacgcctgcctttgtccttcacccttagcggcaagtcccacttttctggggaaggcgcaagtaccccaaccccttctctccctgtctctaccccttctctgcttttctggggaaggggcaagtacccctcaaccccttctctttcaccctgagtggcaagtcccgcttttctacggggcaagaacccccaatcccttatttccacgccccaacctcttatctctgtgccccaatcccttatttccgtgtcccaacctcttatctctgcaccccaatcccttatttccacgccccaaccttgtatctctgtgccccaatcccttatttccacgccccaacctcttatatctctgcaccccaatcccttatttccatgccctgacctcttatttctgcgccccatcccttatttctgcaccctgacctcttatctctgcgccccaacccctttcccacttttctggaaggtaagaacccctgaaccccttccctccatttctctactctttcttttctctaggcttgcttccttcactatgggcaatcttccaccctccattcctccttctactcccttggcctgtgttctcaaaaacttaaaacctcttcaattcacacctgacctaaaacctaaatgccttattttcttctgcaatgccgcttgaccccaatacaaactcgacagtagttccaaatagccagaaaatggcactttgaatttttccatcctgcaagatctaaataattcttgtcgtaaaataggcaaacagtcttaggtgcctgacgtccaggcattcttttacatatcagtcccttcctagtctctgtgcccagtgcaactcgtcccaaatcttccttctttccctcccacctgtcccctcagtaccaacgccaagcgttgctgagtctttctaatcttccttttctatagacccatatgacctctcccttcctccccaggctgctcctcgccaggccgagctagttcccaattcttcctcagcctctcctcctccaccctataatctttttatcacctcccctcctcacacctggtccggcttacagtttcgttccgtgactagccctccccctcctgcccagcaacttactcttaaaaatgtggctggagccaaaggcatagtcaaggttaatgctcctttttctttatcccaaatcggatagcgtttaggctctttttcatcaaatataaaaatccagcccagttcatgacttgtttggcagcaaccctgagacgctttacagccctagaccctaaaaggtcaaaaggccgtcttattctcaaaatacattttattacccaatctgctcccgatattaaataaaactccaaaaattaaattccggccctcaaaccctacaacaggatttaattaacctcgccttcaaggtgtacaataatagaaaaaagttgcaattccttgccttcactgtgagacaaaccccagccatgtctccagcacacaagaacttccaaacgcctgaaccgcagcggccaggcgttcctccagaacctcctcccccaggagcttgctacacttgccggaaatctggccactgggccaaggaatgcccgcagcccgggattcctcctaagccacgtcctatctgtgtgggaccccactgaaaatcagactgttcaactcacctggcagccactcccagagcccctggaactctggcccaaggctctctgactgactccttcccagatcttctcggcttagcggctgaagactgacactgctcaatcaccttggaagccccctagaccatcacggacgccgagcttcaggtaactctcacagtggaaagtaagcccatccccttcttaatcaatacagaggctccccactccacattaccttcttttcaagggcctgtttcccttgcctccataactgttgtaggtattgacgaccaggcttctaaacctcttaaaactccccaactctggtgccaacttagacaatactcttttaagcactcctttttagttatccccacctgcccagttcccttattaggctgagacactttaactaaattatctgcttccctgattattcctggactacagctatatctcattgccgcccttcttcccaatccaaagcctcctttgcgtcctcctcttgtatccccccaccttaacccacaagtataagatacctctactccctccttggcgacccatcatgcaccccttaccatctcattaaaacctaatcacccttaccccactcaatgccaatatcccatcccacagcacactttaaaaagattaaagcctgttatcactcacctgctacagcatggccttttaaagcctataaactctccttacaattcccccattttacctgtcctaaaaccagacaagccttacaagttagttcaggatctgcgccttatcaaccaaattgttttgcctatccaccccgtggtgccaaacccatatactctcctatcctcaatacctgcctctacaacccattattctgttctagatctcaaacatgctttctttactattcctttgcacccttaatcccagcctctcttcactttcacttggcctgaccctgacacccatcaagctcagcaaattacctaggctgtactgccgcaaagcttcacagacagcccccattacttcaatcaagcccaaatttcttcctcatctgttacctatctcggcataattctcataaaaaaacacgtgctctccctgccaatcgtgtccgactgatctctcaaaccccaacaccttctacaaaacaactcctttccttcctaggcatggttagtgcggtcagaattcttacagaagagccaggaccgcaccctgtagcctttctgtccaaacaacttgaccttactgttttagcctagccctcatgtctgcgtgcagcagctgccgctgctttaatacttttagaggccctcaaaatcacaaagtatgctcaactcactctctacagttctcataacttccaaaatctatcttcttcctcatacctgacgcatatactttctgcttcccggctccttcagctatactcactctttattgagtctcccacaattaccgttgttcctggcctggacttcaatccggcctcccacattattcctgataccacacctgacccccatgactgtatctctctgatccacctgacattcacaccatttccccaaatttccttctttcctgttcctcaccctgatcacgctggatttattgatggcctaatcgccacaaaccagcaaaggcaggttatgctatagtacaagccactagcccgcctcttagaacctctcatttcctttccatcgtggaattctatcctcaaggaaataacttctcagtgttccatctgctattctactcctcagggattattcaggccccctcccttccctacacatcaagcttgaggatttgccccacccaggactggcaaattagctttactcaacatgccctgagtcagataactaaaatacctcttagtctaggtagatactttcactggataggtagaggcctttcctacagggtctgagaaggccaccgcagtcatttcttcccttctgtcagacataattcctcagtttagccttcccacctcaatacagtctgataacagacgagcctttattagtcaaatgagccaagcagtttttcaggctcttggtattcagtgaaacctttatatcccttacggtcctccgtcttcaagaaaagtagaatggactaaaggtcttttaaaaacacacctcaccaagctcagccaccaacttaaaaaggactggacaatacttttaccactttcccttctcagaatccaggcctgtcctcggaatgctacagggtacagcccatttaagctcctgtatagacactcctttttattaggccccagtctcattccagacaccagaccaacttagactgtgcccccaaaaaacttgtcatccctgctatcttctgtctagtcatactcctattcaccgttctcaactactcatacatgccctgctcttgtttacactgccggtttacactgtttttccaagccatcacagctgatatctcctggtgttatccccaaactgccactcttaactcttgaaataaataaataatctttgctggcaggactatgccgaatctccttaggcactctctaatcagatatcctgagtcgtcccaattcttagaccttttatacctgtttttctccttctgttattccatttagtttcccaattcatccaaaaccgtatccaggccatcaccaatcattctatatgacaaatgtttcttataacatccccacaatatcaccccttaccacaatacctcccttcaccttaatctctcccactctaggttcccacgccgcccctaatcccgcttgaagcagccctgagaaacatcgcccattctctctccataccacccccccaaaaatttttgccgccccaacacttcaatgctattttgttttatttttcttattaatataagaaggcaggaatgtcaggcctctgagcccaagccaagccatcgcatcccctgtgacttgcacgtatacgtccagatggcctgaagtaattgaagaatcacaaaagaagtgaatatgccctgccccaccttaactgatgacattccaccacaaaagaagtgtaaatggctggtccttgccttaagtgatgacattaccttgtgaaagtccttttcctggctcatcctggctcaaaaagcacccccactgagcaccttgcgaccgccactcctgcccgccagagaacaaacccccattgactataattttcctttacctacccaaatcctataaaatggccccacccttatctcccttcgctgactctcttttcggactcagcctgcctgcacccaggtgattaacagctttattgctcacacaaagcctgtttggtggtctcttcacacggacgcgcattaaaaaaacatccttacataatatgttaaaggatgctatacaatatggggaaaatgatataagtatatgacccaagaggatgaaaaaattcacttattggcagaaaggacaacatcatttgtatgtagaaaatcacctctcaaaatagtaagttgctgaaaggggagtggttgcgctagaatcagcaccaatgactcttttatcctatttctcagttttaggggaaaagactctacaaaactacaggtgttttgctgacagtagaaaaaaaccttcccttgttaacatgttagtcaagctttggaaaagacatcacatgtcaaatcctatcacaggatgctttatagagattatctattttaaattttattggaatttcgatgacatcaagttgttattgcttggaccacagtggtggtggttatctgaagatttctgcaaaagtgccatgcctcctcaaataaggcaagtcatctaaaaaatatcccttatatatatttttcatttctttcatcatgttacagagaatttcagtggtattctaagactcagcctccccaaggaaccaaatcaagcttttatgcatcagtggaaaccagaaattactaacagtatacacagtggcaatggccagagattactctttcatctggttcaacccctagagacacaaggtctcatcctgttcacacccaaatccccctccttccccaaacacacagcctccacatgcattctctgacaagcctgagtaatatttcatcagttctccctagccactcagtccaggttttaatatagctggaatatcttgggtagctttatcaagatgtaaaccttataatcaaggcttagttcaaaatttaagtttttccagctgtcaactgacatacaactgtataaaatctgaaactttccctatcaaagttctcaatgttaaaatctccccctagtggattttcagagcatgtgttttcacaagtaaaactgaatagaattttcaaaaaaaaaaaaaaaatgctaaaaatttcatatgtgtgaaaaataagacctattaatctcaaagttcagaggggaaaaaatgcaatttcatttaaaagcttgccatcaaaaaaattctaaaactaaagtagaatagttttggtttactctagtcttatgtgcaagtgtgaatattgagttttacaagtttttcttgtgtgtcattatcctctattaagttaaggcattttaatggactaaacatggtaatttcttacttaattgtttagtgaagagaggcataatgtttcaattaggaaagaatgatcccccacatgagtgaatctgccatctgtgtattctcatctgttaaaactgttagtcaaatcaacaaaagtccaagtgcaaagtccctaaaccagttgaaatgggcacacacttgctctagggaaggggaaattttattttaattgattttgttccagcagcaatccctcttcctttcctgggaatacattttggctgggattttgtggcatcaatacaaatcacttcaaagcagctattgctcatttatcctctacctagcggctctgctgacccaccacttggatatccattttcctgaggtggggcaaagatgaggcatgacaagaccacaggaatggtgtaggaaaaaactacagagaaatactcatacagaagacagcacaaagctgcctgcagtactgatcgtcacatgtttagaactgggaaatggtggtcagttgttaacagaaaatgcattttctttggtaccaaaataccaatggctcatcaatcttaatacttttataataacattttttaaggttaaattctttcaaaacatgtcactccaaatttctgatgaggtctagttacttttaaataattaggcaacatgaatagaggagaagactgaggcaattattggattcattgaggaatgcataaaacataaaaatgacttaaatttgctatttatgtaatttcgtggtctcaaaaccacactttaattgaatcgagtttagtaagagataagaccacagcagtgtggcatgatgtttaagaacacaggccttagggtagattgttagagtcaaattcgagctctgactgtgtgactttgagccagttatttaacctctctgtgccttggtttcttcatctgcaaaatgagagtagtaaatagaagcttcctcatagtgtagttggaagggttaaatatgctgaaaccgtaaatggaaagtacttagtacacacagatcccacagctttttttgttcactttcagacattaacagtcttattttcagacattattttaaaaatcctttttaaattgaaactttcatttctcattgaacttaaatctctttgtccctataccagctccagcatgacctatgcttggatcctgtagtagggaagagggaagcggttaattctttatcatgtctttgcagtatttttttactctacctccctcacccctttctctgtctttggttcctgcaggggagagggaaaatcatttggggacagccaacttcttccttgagcggtgcagttataatcatgcattgtgccctctgtgagtgcttctttctcctttgaaattcttcagtgggttcttcagcatcgcccactctgttgctggagaccacccattgtgcccttggatggcgtgcccaatatccttggccagctggctgcattccccactcagctactgattgttgattgttgtgcttcacgaacttcccgctgagcgtcctctcatcctggggtggagagcaggcccatcacggggctcccacctgcctgcctgccatactgtccatgccagtgcctgagaaacaccgcctctgctccactttcagtgggaaccagcgttttgcacccccctccatagccttttctcttcactctaccacctgaagcaattcccactgggccgcttcttcacctttaagttttccaggtaagaatcagacatcagtctctgtgtcttgtcaaatgttcagggatactaccaagctctttaagtggtcttatagaagcctccacagtttacagatggggtaagcacccactttccatcttttgtgggaagaaaaatgcacagcactctgagaactgtctctaaggaattaatcactatcaacttcctttctactctcatatatggaggtaggcaatgggctaagggggtggactagcacctctctttagaaagtggatacatttcccaattgcagtcatcaggttgggagcctggggcctcactggaaattgagacaaaataaaagttaagttcaacttagactgtgcatatgtaacattcaaacatttgggttatttgagtcagtgagttcagtgattagtatgaatccttaccatgtggtagactagattgacttcagtatgacgtagataggtgtgattaataacttagagttattttagctgagggtgtgtcatgtaccaaaaactggtgaatggaacatagttcacagtgttggaattatgggactcaactggataggcaggaggaaaaagaaagggtaagtatcatacacatagaaactgtcagtattttttagactgcagaagtgaatgtcagacctactgtattaagctcttaagcaagggacaaaactggatttttcaagtctggggctaattcaaaaacagtgttacattgtaacccatacctcagaaattattttataatagctaaatatttacatagtgcttactatatgccagacactgttttaaacacttttaatgtatttaatccttttaacaattttacaagatagatgcactgttacttccttttacaaatgaggaaaatgaagcacagagggatcaaacaaccagcacaaggttaaagtcatggaaaatatgagatgtaagccctgatgtttggtattagactacactttgctttcacaaacattatcttgtgatttatgtcacaaataaatcacattatatagcaatgataaagcaattccaaaagataggcatatcagactcaagcatactcaatgaatcacttagctatgggatgataggggctgcctagaaaataatagactgttgtagctcctgttccagttccttctaccaccttctgacgggtatgttttgtttgccatttaacttacatcacaacatgttaatttcaagaataaatttattagtgtttttctaaaagtaaaaataattgaggagaaaataaatcagcaaatgttatattaaatagaacagacacttacggcctggagtcttttcatttttaaggtataaaaagcttttattgcttttatcttacttaaaaagcaatgcgtgcttatgactgaagaattagaaaatctctgcaaaagggagaagaaagcattcacaacccaactacctgatgataaccactgttaatatcttagtaactgtcctttcaagcctatgcatatatatgttcatttaatgtgtgtgtgtgtatttacatcattatttatataacatttttatttttgactgggggaagagcaaaattttattttggaatgaaaaaggccaacggggtagtcagaaaagaataaagtgagtggtgtggcatcctctctccatcttcttggtggcttgggttatacatctgtgcttcaagttcttccaaaggcccaactgttttgtttggtgtgcatgtttgcttaccttgaaagttatcaatcaagctcagagtccgttaaataaaatatagcctatcatctatcttcattatgacctggaaagacagagtccaatttagactcctagccctcttcacaagctctaccctggaacttgcccccaccagtagcctgtcctacttcaacttccattcctggctttgtcctgcccagtgaataggctcatgtacattaggacagatacctgaacccctatggccaagctcattactcatctgccacatcctctcctagtcacctctgagcctcttcttggccatgtatttggctcacacttccctggaagtgggtttggagcctctgggcagggagtcatggagtctagaagattgtgatctagcgtatgggctagatgtggcttgcgggctcagactgggcacttgttggctgcaggaactccttcccttgccgggaaggatgtggctagaagcgggaaagaacaggatcttcatgtattctctatatgaggtgctgatcaaaataaataattatttacacctagagatgttctctaaattatgactgtagaaagtaggtaagtaagttaaaattgggaatgtgtagctttagcatgccaacacctacatctgcagaatccccatggtttatgtgcgctgttgcctttgactggaacaaccttcatcagacatgtgcccttttactttcaccttattcataactgctcaaacatcttctttccttccctttccatctaatctataccaagtgcacccacccctccagcactctgtatcctctcacccccacttatcttcttagaacttatcacgaaatgaaattacagtacctgtacttgtttactgtctttctgccctactagaattccacagaaaattaatctaatttgtcattatatctattgtgcctagaacagtgcctgccacccagtgggcattccctaagtatttgctaaattactaagttacaattaaaaacacacattactcatacatagtggaattctgatattaatttccacttccttttaactaagaaatggggcaaataactggaaataaatcttttctactgcagtctgaattttacttccataaaataaaacacatacaaataattttttaaaattaggatataatatcagaaaccactgcattggctaatggcataagcagcgaaatcttggctcaaccaaacagtcaacaaagaaggagtgtaggccaggtgtccccacctaggctatgctatcttcttacttccttcttctggcaggaaaggagatgtcaggctgtaggaaagtagtagcacgggctacttcctcaaggactaagtaaagtagcattccatgctgtgggcaaaaggagacaggggcagggccaggtgctggtgaggagaggcagtccactctcaagaggggacagtgaggtgaggatccaggacctctttccggaccactcctggtagttctgagttccagtctgacagctcacagacacagccccccattttgcctccagcaggagaagacaaggagatggagagactgtcaacctagaaccagtaatgaccagttccaacttaattacagaaagggagaaaagatcaatcatttaagttgcttcatcgtctaaataaaagtgttttggctgttgaaacatgaacctagactcctgcctcaacatatttaaaatgagaacaaagtggcagtatcatggtggtgggcgtttagatgcttacattgttttcatctacaaaacaggctttcctttcacaccctagctctttgctgggctggtggagctgattgacagatatagcccgctccaaaggaacagccctttctcaaggaatgaatgatttgctctaagtatttaaatcctctgctcaaaatcaaacataaattgaagtatcaaaataaacaaaaatatggtttgtggttttgaaagcatttctttgtgatttttgctaaaaagagaaatgccaaaaaaatttttttaaagattttgagacaattatctggcgcagtggctcacgcctgtaatcccagcactttgggaggctgaggcaggcagatcatgaggtcaggagatcaagaccatcctggccaacatgttgaaaccccatctctactaaaaatataaaaattagctgggcatgatgggcgcctgtaatcccagctactcaggaggcagaggcaagataatcacttgaatccaggaggtgggggttgcaatgagccaagatcatgccactgcactccaacctgggc

SEQ ID NO: 1476 - DNA, 903 bp, Homo sapiens
ctgaagaaatggaggtgctactggctcaaggaacctggattcatttagagagtgtgcccaggatgagacgtgtggagagcctggcctgaaccaacactaacagtctcctggacaggagataagaaaatggaggtcacgagctggagaactccttgctcaagttgcatagctaataagggacttagctgggattcctggccagcagtgtggctccaggcctggtttctaacttccccttgttggcaaccaccttcacagaggaatgcaagagttgttctcaagactcctaaataaagcatttcccctgtgtgggcgacccctgggtcccatgtggggtcagtgtttgggtctctctgagaggatcaggaaggctgctcttccaggaagggctgcagggaccctgggaaccggaccagtccagctcacaagtatgaagagaatgtcgggagaggaagtggtggctatgagtcagcatgagtcatctcgttccaatgagaatgaaggctgagacaagcggtgcctgagcccgtgcctgtcttcagatcttcacagcacagttcctgggaaggtggagccaccagcctctccctgaataactgggagatgaaacaggaagctctatgacacacttgatcgaatatgacagacactgaaaatcacgactcatccccctccagcacctctacctgttgcccgccgatcacagccggaatgcagctgaaagattccctggggcctggttccaactgcccactgtggactctgaggcctctgcatttgcgggtggtctgcctgtgatattttggtcatgggctggtctggtcggtttcccatttgtctggccagtctctgtgtgtcttaatcccttgtccttcattaaaagcaaaactaaagaaaacagaa

SEQ ID NO: 1477 - DNA, 903 bp, Homo sapiens; identical to SEQ ID NO: 1476

SEQ ID NO: 1478 - DNA, 903 bp, Homo sapiens; identical to SEQ ID NO: 1476

SEQ ID NO: 1479 - DNA, 903 bp, Homo sapiens; identical to SEQ ID NO: 1476

SEQ ID NO: 1480 - DNA, 1212 bp, Homo sapiens
aaaaacattttttaatgtcactccattcagaggtaatgaagtgttaattttttttgtttgtttttgcttttgttttttttttttttttgagacagtctcgctctgtcacccaggctggagtgcaatggtgcaatctcggctcactgcatcctctatctccccggttcaagcaattctcctgcctcagcctcccgagtagctgggattacaggcgcccggcaccatgcccagctaatttttgtatttttagtagagacagggtttcaccatgttagtcaggctggtctcgaacccctgacctcaggtgatccaaccgctttggcctcccaaagtgctgggattacaggcatgagccacttcacctggcctgaagtgttagttttatgtcttttttttttttttttaaagaaaagtagttcccttatctccactttccccctttccagcacctcagaggcaactgctttcagctgattactttgacaggcgtgaccttatttccacataattgcttatgtcatgatttttttctttttgagataggttcttgctctggggcccaggagggagcgcagtggcgctcttgtagctcactacaaccttgaactcctggactcagataatcctctggcctcagtctcctgagtagctgggactacaggtacatgctaccatgcctggctaatttattttcacagagacaaggtctcactatgttgcttgggctgatctctaacttctaggctcaagtgatcctcccgcctcggcctcccaaagtgttggaatacaggtattgaaatcaagtttagcctaaagctgcctccttatatatttaagtttggcctaaaggtttgtctgtatatcgtgacaagtggaggtgtaaacagactacacttgtgccaatcactgagttttggccaatcaaatgtagccaactgttcaaaccacgttcagataaggcaaatgccaagctgtagccaagcccagctgtttctgtacctcacttccattttctgtccgcaaaccttccaccgtgtgactgcgctggagtgtccgagcctactctggctgggaaggctgcccaattcttgaactgtttattgctcaattaaactcctttaaatttaatttggctgaagtttttcttttatcacaggtgtgaaccatcgtacctggctgtcctaaatttttaaaaactatcatgcaagtcat

SEQ ID NO: 1481 - DNA, 1212 bp, Homo sapiens; identical to SEQ ID NO: 1480

SEQ ID NO: 1482 - DNA, 2746 bp, Homo sapiens
tggcacacaaaggtggccaaatctgaagactggttcaatttctggttggtaattggcaatgatggaatgactgtccggagtaaagaagcctctctttgttcttgtgccatgatttcccagccaggcagtgcttgcagttcactggactgatcattttctttcacactctgtgcctttgcaaatattattcttttgtctgaaaattgcctgctcccaacccttcattatcatccccactaactctcacccaccctccccagcttgttgacttggaaactccttctttttttaccagctgcaattcaagcaacacctcctctggggagccttttcaactctgccttagtcttttttggccctagtttttgcatctctccagattcactgggctttctctgctttctgggtcacttgttcagtgaagaacccctaccccatcatcaccacaactcttaaccctaccacccttagccctttccagatgagggctgtgctctagcatggctccttcatactcaccatgatgggactgcaaagaccctggtgtctggggcctgaacccactgggcccctgaagttcagcttcctgcagcattcccagaatctgaggaagcaccgtgaaccgaggtctgggctctgacttccctgatcctggagccaggtcatccaatctgtaaatgtaaaggatggaattatttttaccaatgaggaacaggtagactcttacgcctttctccccatgccctatccccaccctttacagactgtgaaagcacacagatttctacttacagactgttctgaagcacatcgatttccacacgactgactggagacatctagtgtgatcgagacctcagctgtgtgttataatcaatgtgccacctttgcttccccctctgctctcattcttgctgctcaataacaccggaactctgctccaggttctcatttctatgcaagtgtagaaatcctctacaatctcctagcaacacaggcataccgctaccctagcttgaaataacctgagtcatgattgttagtttactttaacagagattcttgattgcagaggaactttttttcagtggtctcattacttagcaccatgttgggaacatagcaggtgactcaatcaacagtttttaattaattaatggctttaacattaaataattatagaacacatttaaaacaaaaagagctcttagacatttttgctttaattctctgtgtgatatggagaaactgcctgaggccaggagaattaaggtactttccagagtcatgcagctattgagtagccagactggagatggcatattggtttcctgatcacacagcactattctcttttagaaaactgttatttccatttatgtgagtggaaaacaacatcaggatcaatctggcaaacccctgggaactgtgtttctccaggccatctttaagcctttagattaaaatataaaattgggtaacactaacaatagaagacagtgttcctttgcttctgtccccatcctctacaaagtccctgctgccttttttcctggatgtctccaggtggtgtctcacaggtgattgcaaacacagtcctgccagctcccatatggcacctgtcatgacattccttttcttcttcaatttctagctcagtgcccacagccagagcttcccaggctgcctgtccacgggtgtggcacatctgcagagcctcaggtggctcctgctactgctcaccccacaagccctgactgctaatatctgcccagggccctgtttccttccctagtattcctgtgggctggttagcttgttactcaagagccaccgtgtggagtccatgctcctatagtagcctaaaatgaggaaactgcccttcattaacccaactctagcttgttccaaaacatggagcacagaacattgctgcctgtaacccctggaatggcacaagattatctatttatttatcctttaatcacagctggaggcctcagatatgaatattcaggattggtgaaagaactcaacaatttgactgagtgtcataattgtggcacagggaggaaggaaggacagcataccaagcccttaatcacacgctacccagataccagcataaggcccgacattctagaacaggggccagctcatggcctacttttctttggccggtaaacatccagatggccggtttctgccttaactgatgacattccgccacaaaagaagtgaaaatggcctattcctgccttaactgatgacattatcttgtgaaattccttctcctggctcatcctggctcaaaagctcccctactgagcaccttgtgaccccccattcctgcccccccagagaacaacccccctttttcctttacctacccaaatcctataaaacagccccacccctatctcccttcgctgactctcttttcggactcagcccgcctgcacccaggtgattaaaagctttattgctcacacaaagcctgttgggtggtctcttcacacggacgcacataaaacttactatcaaattctttagaaaaagagcttgtgttctcattgttcagttcccacctacgagtgagaacatatggtgtttggttttttgcccttgcgatagtttgctgagaatgatggtttccagcttcatccatgtccctacaaaggacatgaacccatcattttttatggctgcatagtattccatagtgtatatgtgacacaggaagggg

SEQ ID NO: 1483 - DNA, 2650 bp, Homo sapiens
agaaagccctcaaattatataaggttgaagctctaatgggaaatgttgatgtcatctcagaagtcagagctaatgctatgaccatctgcccaagcgggaatcatgaactccatcctccttatccactgggaggtcagttctgccctagaactgttaccgaatagagttgcccaggttctcggcctgttgaacaaataattgaacaaaatgcacaaagtaacaaaagaatgaagcaaccaaagccaacgcaacagaataagggagtaatgaaagcacagatgtattgaagacaactcactgagtgggactgggctccagcaagctgcacaagagcctctccagttaggatttttataaagccaaaagaacttggcaacacccctaggtgccctttagaggcctccaattggttacatcctatgaaggattggcctgcaaccaatcagaggctgaagtagaaatatctgtcttgtcacaggattgaagatatggcctgtacgcagcccagtcttgcctagaactggctgcacctgctgttcctttgcttatgccccaacccttggctaccctaattccctattctcctgcctcagaactatcttctgatctgtccatgtcttttactcctttgtcattttttggttggactctagcaacaatctactgaatgatttccttgctccatgtttctcttatttctaacccactctccttctatacagtttccaaagaaacaattatgatcacatcccttttgtttgtaaagacatccaaatccttcaatatggatccaaaaccctaattaatctcctttcagaatacctattcatctttatttttaccatactccttgtccaaccccaacctaatattatgagctttatgtcattcttcaaacatgtcatgctgtttaagtctctatgtcattagatttctttctttcttttttattttttcttttgtgagatggagtctcactctgtcacccaggctggagtgcagtggtgtgacctcaacccactgcaatctccgcctcccaggttcaagcaattctcctgcctcagcctcccaagttgctgggactacaggtgtctgccaccacacccggctaatttttgtattattagtagagacgggtttcaacatgttggccatgctggtctcaaactcctgacctcaggtgatccgcctgccttggcctcccaaagtgctgggattacagaagtgagccaccgtgcccaaccaagccactgcgcccggcatctatgtcattagatttcgattttcttttgttgttgttgttgttgttggtttgtttttgtttgtttgtttgttttgagacggagtttcgctcttgtagcccaggctggagtgcaatggcatgatctcggctaactgcaacctccgcctcccaggttcaagcgattctcctgcctcagcctcctgagtagctggaattacaggcatgggccaccaagcccggctaattttgtatttttagtagagacggggtttctgcatgttggtcagctggtctcgaactcccgacatcaggtgatccgctagccttggcctcccaaagtgctgggattacaggcgtgaaccactgtgaccggcctcgatttgtatatatatatataatgaaaaaacttacctgtgtctcatacaagatacaaatttaaatttctcttacataaaaaaagccaagaatgaggcagtccaaggatggtgtggcagccccacaggtatcaaggccccagactcctatttctctgttttaccacccccagcacatgacttaagtacaccccataatttaagtacacctcataattcaaggtggtttctaggacttcagccatcacatttgagttccaggctgaaagcaaaaacaagaaaaatattcattccttcccctttaagaagacttcttggaagtctcacatatttactcacatctcactggccagaaattagtcacattattattagtcagaatgtagatttttaacagggtatgctgtcccccttcccccaaaatagggtttttgatagaaagaagtcttactcacagttttaggggccagctcaaatgctttcatgcttttctaacttttccatgcagaggaggttcccctcatgcttaccaaacatttagttttcattatcgattgatggatggatggatggatagataggtagatagatgatagataatcaataatcaacagataaattcaggtacaaacacacacacatgcacacacacacatacacacacacatatatatataaacacttacgttttccttatcaaaggagctccttataaatagagatcatggcttactcaactttttatcttggcactgagcatggagtaggccttcataaatgtttgttgaataaatgcattgatgcttacataaataaaccagccgggcgcagtggctcacacctgtaaacccagcactttgggaggctgaggcgggtggatcacgaggtcaggagttcaaggtcagcctggccaagatcgtgaaaccccgtctctactaaaactacaaaaattagctaggggtggtggcgggtgcctgtaatcccagctactccggaggctgaggcaggagaatagcttgaacctgggtggcag

SEQ ID NO: 1484 - DNA, 11296 bp, Homo sapiens
gtaagagttatgaagtaagcacttaaaatccagctaaaagcctactctcggttgttttcatgctccccagtgctagaaagagagcctgtctgcgaaacaccagtaattgcacgttgtctgtgtgaaaggacattgaaagactcgataaattacaaggagggagggagctagctctcattgcaaacttgacctagcctagattagcaacccgggatttgactttccatgtgacccttcctctttgtagtcttcaaaagcaagcccgtacaaagcccggctccttccttccttctaactccctatcaggaagctccttcgcccctcaaatcccttcaggggctttgaaatcctgggctcccgagcccaagctgggcatgaatattcatcgggggcgtggccccgccagcgcgcagggctccaagcagctgcgactagcggaaagcgcgcgccagctgcacgcagggaaacagttctcattttgtgtgctcggctgactgcacgtccagcctcgggccagctcgagacggccacattgcctggttgaagatggctgagcgtaaaacagaatgcaagtcagctggagcacgtactactggaggcagagccccatgagaaggggccaagaacccgcacccatcaaaatcaagaagaaaggctgaacccggagagaaaagggagcaactgatgttgccatgcagatcccttggttgctatgagatggtaacatcactctgccccaccattggccagtgcctcctcagctgcggtgcctcccaggctgtgtggttctcacgcgggccactgacacagagctgttactatgcctggctcagcttctcagcttctcaggtggattggtgagtcctggccaattacgcttcagctcatctctactctcagcaaataggaaaagggagtgaaggactgagttttaactcttctaatttcgtaacctgactctctataagaaaaagtaggagaaagactgaagaacccgagagaacaggcctctgagcccaagccaagccatcgcatcccctgtgacttgcccgtatatatgcccagatggcctgaagtaactgaagaatcacaaaagaagtgaatatgccttgccccaccttgactgatgacattccaccacaaaagaagtgtaaatggccggtccttgccttaactgatgacattaccttgtgaaagtccttttcctggctcatcctggctcaaaaagcacccccactgagcatcttgcgactcccactcctgcccactgagcaccttgtgacccccactcctgcctgccagagaacaaaccccctttgactgtaattttcctttacctacccaaatcctataaaacggctccacccttatctccttttgctgactctcttttctgactcagcccgcctgcacccaggagattaaaagctttattgctcacacaaagcctgtttggtggtctcttcacatggatatgcatgaaatttggtgccgtgactcggatcgggggacctcccttgggagatcaatcccctgtcctcctgctctttgctccgtgagaaagatccacctacgacctcaggtcctcagaccgaccagcccaagaaacatctcaccaatttcaaatccagtaagcagcctctttttactctcttctccaacgtccctcactacccctcaacctctttctcctttcaatcttggtgccacacttcaatctctcccctctcttaatttcaattcctttcattttctggtagagacaaaagagacacgttttatccatgaacccaaaactccggcgccggtcacggaaggcagccttcccttggtgtttaatcattgcagggacgcctctctgattatacactcacgtttcaagggtgtcagaccacgcagggacacctgccttggtccttcacccttagcggcaagtcccgctttcctggggcaggggcaagtacccctcaaccccttcttcacctgcagcggcaagtcccgctttcctggggcaggggcaagtacccctcaaccccttctccttcaccctcagcggcaagtcctgctttcctggggcagggccaagtacccctcaaccccttctccttcacgctcagtggcaagtcccgctttcctagggggcaagaaccccccaaccgcttatttccgcaccccaacctcttatctctgcaccccaatcgcttatttccacgccccaacctcttatctctgtgccccaatcccttatttccgcaccctgacctcttatctctgtgccccaatcccttatttccgtgccccaaccccttctctgcttttctagagggcaagaaccccccaccccttctccatgtctctactcttttctctgggcttgcctccttcactatgggtaagcttccaccttccattcctccttcttctcccttagcctgtgttctcaaaaacttaaaacctcttcaattcacacctgacctaaaacctaaatgccttattttcttctgcaatgccgcttgactccaatacaaactcgacagtagttccaaatagccagaaaatggcactttgaatttttccatcctgcaaaatctaaataattcttgttgtaaaataggcaaacggtctgaggtgcctgatgtccaggcattcttttacacatcagtcccttcctagtctctgtgaccagtgcaactcatcccaaatcttccttctttccctcccgcctgtcccctcagtaccaaccccaagcgtcgctgagtctttctaatcttccttttctacagacccatctgacctctcccctcctcgccagcccaagctaggtcccaattcttcctcagcctccgctcctccaccctgtaatctttttatcacctcccctcctcacacctggtccgacttacagtttcgttctgtgactagccctcccccacctgcccagcaatttactcttaaaaaggtggcgggagccaaaggcatagtcaaggttaatgctcctttttctttatcccaaatcagatagtgtttaggctctttttcatcaaatataaaaacccagcccagttcatggcttgttccgcagcaaccctgagacactttacagccctagaccctaaaaagtcaaaaggccatcttattctcaaaatacattttattacccaatcttctcccgacattagaactccaaaaattaaattccagccctcaaaccccacaacaggatttaattaacctcgccttcaaggtgtaccataatagaaaaaagttgcaattccttgcctccactgtgagacaaaccccagccacatctccagcacacaagaacttccaaacgcctgaaccgcagctgccaggggttcctccagaacctcctcccccatgagcttgctacatgtgccggaaatctggccactgggccaaggaaggcccgcagcctgggattcctcctaagccgtgtcccatctgtgtgggaccccactgaaaatcggactgttcaactcacctggcagccactcccagagcccctggaactctggcccaaggctctctgactgactccttcccagatcttctcggcttagcggctgaagactgacactgcccgatcacctcggaagacccctagaccatcacggacgccgagcttcgggtaactttcacagtggaaggtaagcccgtccccttcttaatcaatacagaggctactcactccacattaccctcttttcaagggcctctttcccttgcctccataactgttgtgggtattgatggccaggcttctaaacctcttaaaactccccaactctggtgccaacttagacaatactcttttaagcactcctttttagttatccccacctgcccagttcccttattaggctgagacactttaactaaattatctgcttccctgactattcctggactacagctatatctcactgccgcccttcttcccaatccaaagcctcctttgcgtcctcctcttctatccccccaccttaacccacaagtataagatacctctactccctccttggcgaccaatcatgcaccccttactatctcattaaaacctaatcacccttaccccactcaacgccaatatcccatcccgcagcacactttaaaaagattaaagcctgttatcactcgcctgctacagcatggccttttaaaccctataaactctccttacaattcccccattttacctgtcctaaaaccagacaagccttacaagttagttcaggatctgcgccttatcaaccaaattgttttgcctatccaccctgtggtgccaaacccatatactctcctatcctcaatacctgcctctacaacccattattctgttcagatctcaaacctgctttctttactattgctttgcacccttaatcccagcctctcttcgctttcacttggactgaccctgacacccatcaagctcagcaaattacctaggctgtactgccgcaaagcttcacagacagcccccattacttcaatcaagcccagatttcctcctcatctgttacctatctcggcataattctcataaaaacacacgtgctctccctgccaatcgtgtccaactgatctctcaaacccaagcaccttctacaaaacaacaactcctttccttcctaggcatgcctttctgtccaaacaacttgaccttactgttttagcctagccctcaagtctgtgtgcagtggctgccgctgctttaatacttttagaggccctcaaaataagtagaggcctttcctacagggtctgagaaggtcaccgcagtcatttcttccgttctgtcagacataattcctcagtttagccttcccacctcagtacagtctgataacagacgagcctttattagtcaaatcagccaagcagtttttcaggctcttagtattcagtgaaacctttatatcccttatggtcctccatcttcaagaaaggtagaatggactaaaggtcttttaaaaacacacctcaccaagctcagccaccaactttaaaaggactggataatacttttaccactttcccttctcagaattcaggcctgtcctcggaatgctacaaggcacagcccatttaagctcctgtatagacgctcctttttattaggccccagtctcattccagacaccagaccaacttagactgtgcctcaaaacaaacaaacaaacaaacaaacttgtcatccctactattttctgtctagttcatactcgtattcaccgttctcaactactcatacatgccctgctcttgtctacactgccagtttacactatttctccaagccatcacagctgatatctcctggtgctatccccaaactgccactcttaactcttgaagtaaataaataatctttcctggcaggactatggtgaatctccttaagcactctctaatcagacatcctgagtcgtcccaattcttagaccttttatacctgtttttctccttctgttattccatttagtttttcaattcatacaaaaccgtatccaggccatcaccaatcattctatatgacaaatgtttcttctaacaaccccacaatatcaccccttaccacaagacctcccttcagcttaatctctcccgctctaggttcccacgccgcccctaatcccgcttgaagcagccctgagaaacatcgcccattctctctccataccaccccccaaaaatttcaccgccccaacacttcaacactattttgttttatttttcttattaatataagaaggcaggaatgtcaggcctctgagcccaagccaagccatcgcatcccctgtgacttgcacgtatacacccagatggcctgaagtaactgaagaatcacaaaagaagtgaatatgccttgccccaccttgactgatgacattccaccacaaaagaagtgtaaatggccggtccttgccttaactgatgacattaccttgtgaaagtccttttcctggctcatcctggctcaaaaagcacccccactgagcaccttgcgaccccccactcctgcccgccagagaacaaaccccctttgactgtaattttcctttacctccccaaatcctataaaacggccccacccttatctccctttgctgactctcttttcggactcagcccgcctgcacccaggtgattaaaagctttattgctcacacaaagcctgtttggtggtctcttcacacggacacgcatgaaatttcacagtcatgaatagtgattttttggtttctgtttttgtgattaacttctgcaaatttgtcaatgactttgtcagagttatttttcttcccatattcatgaagtttctatctatctttgatcaaggaacatttttcattaattttattttgaaagcttactttcacatgaaggaacagattaaaaaagtaagaaaaagccttaaacataaggatacatttggcagaaatacgtaaaatctcatttcacaataaattccagaaaatttaaacacaataaaaaactccggcagtcacatagaatgacagaattgaagtaactcaagttctgtttgtctttaccatcgctgagctatcattgtttatttcaatcaattgtttgaaaacgggaatatgtagtacagtaccagggaggctgagacacgaattgtgcccaaagcaagctttgttttgtacttactctcaaaataaatgcatggagttaattctctgaatcaactcccatgtagaatgcaatgtttactaaggaaggcacaattttaaaaagtgctgagttgaagcatacatttatattcctaaaattcaactgcaacttcagcgattgtgtagaacctagaccaacaaaacattttttttggtgttggggagagcagtttatcactgatattgtttagaattgcttgcagtggtgataataaaaagcacgctggctttcagtgggttttattattgtttttaagtcccttccaggccatggaccccttgattgcctgccctggggggtggacccatcttcttgccctgcccttgggaccacactgcagtggaattagcttaaatcattagcttaaatgcctcctttgtcataaaaacattggtgattcctgcagttttgtgcactatttgtgctagctcttgtgtagcctaacatttccgcctgaatgtttgccattttgttctattctgtaacattgtttttgacctctaatttcattttgcaatgatctcagcactgggtttatctttacaaatgaaatggtgagaaacgctttgctgaatcttcacaactggttcaatcacatgggacagtggaatcagagacatgaggttgcgggaaccattatggggttagaatggataagggaaagagaaagaaaaaatagcagaagccatgacttgctcttgtaggtttgctttgtatgacactctttttcttctgtcactgcatcagacagatatgtttagatacaccatgtattaataaatggtttcctcggtagggttaaaaagctccggtgcctgaaattctacctgaaattctggtatctgaagttctgtatattcctttaggttaaatattgttttctatccatgggcctttgtaaagtaactacctctgggagaagtaacacatcaaatctttaacactttagtataaatgagcatatgagattgattcctctattatctgatcagcaggctgggaacccttggtatgcagtcatggagacacctctaaactcagccttgaatgtatatctttgctttaagaaattccaactcctacttggaggaaaacaacagaaaaagaccccctctgttgatgataggtctgaaggaacttcttatgtaaaggatagccatattttaattttatttctttcccaagaacaagaaccttctcctgacctgcaacacagcccctcactttgtccatagagtgctggaggcttcgtgctatcatttgtgtctcatttttattctattcacatatgtctagggagtgggtcctttgagatttcttcttggctctgcttcaggctccataatagcaatggatccacatttcttaatacagtgagggcaggtggcagcaagccaaagctgcctccgggtgtatgtgtgcaggagtggtgttttcagcatgcattgaaaaatcaggagccagccaggacaaaagcccagagtgacagtgtggccctcagaaggatgcctgcaccaagttaaaaaaaaaaaatcatttttttctattgaattcagttaagattctgtgccaggttttgttcctaggagcatcgtgtatgggtgcgtgtgtgtgcccacgtgcacacggctagttgctcacacagctgctacctgataaatcacagaggcaggttgtagaagttgaacctggagagtgttcagaaggtggctgagggtgtgttcacacaaggctatcaagggcaaatgaagtggccctgaccttgttagtaatttgtctcctctcaaggctttcaaatatatttgtgtcattatataccctcaggacattcattaattgcctatctggatgattctgttaataacatgtatttattccaaacacaagttgttaataggaaatactaaaacaaatgtgaatgtggaatgtttttcgttattctagagtatggaaccacatatataaatgtggtaccacatgcattcatactccatttcacaagccattgtccctcagtacatgtaatagtgttttcctaggaatgtgtgtctaatttaaatagttttaaataaaatcatacttttttttttttagacagggtcttgctctgttgccccggctggagtgtactggtatgatcttgatgcactgcaacctctgcctctggggctcaagtgagcctcccacctcagcctcccaagtagctgtgactacaggtgtgtgccaccatgcccggataatttttatattttatgtagaaacaaggttttgccatgttgcccaggctggtcttgaactcctgagcttaagccatctgcctgcctcggcctcccgaagtgctgggattacaggagtgagcccctgcacctgggcaataatcatactttaatctctctaaaaatttagagttccggttgcaaaacttccctttctgcaaagaatgagttaagaatgagagggtcattggccgagtcattttccctctgtgggcttagtagtctcatctataaaagagggtgagtgtaatgaaagatttctaagatcccttttcagctttatcattctgggttctaaaaactgttttgtagtgtgaataatcacttcataatgtgcccatcatcttttaaaatctgagatttttactcttggctgccttaagaggggttcaactgaattgggactagcaggttgtctgaattcgttactcatctcctttattcttttgggatgaagtggaacaagtgttaagtgataaagctataaaagcacacacagatcaacaggaagacagagacaggaagagaagtggagacgcgtcagcattttcccgagacagcttgatctcggaaagcagaagtggaagtccctgttgttggctcacagctttagcgcactgacctgtcggtcacaagcctttcctggaacctggtgggtttcaaatgcaagtggctgtgctgcgggtgtctgtgcaggagaggagtctgtgaactgtatgagttacaggaggttaatccacacggtcaatgctggggcaaggccctcccatcttcaccctgtgaaattgtccccaaaccaaaacattcattgaatgagttttttcttagtatttctattgtgggaaattaaaagccctttccttgctgatggtaaaaattaggtaattttgtggcatcagtggctttcggtagtgtaaacctactcttggagcaaaggtctattggctaagaatatttattaatatattttgaagagaattgacacaggatcaaaggctgttttatgtataatcatttcaaaaaccataaacctgttattaattgttttaataactcttatatcatcaataaacataccttggctatattttacctacataattttggctgaattgatgggagtaaatactacaaaggtacagtctaacctggagtgggatatactcctgaaaatactgtcaaatttcagcgttctctagatacctcattatttatcaaaagttaataattagggatctaaagccaccatatgatattgtcacaaaagtggtaactaaaccccacatccagtaacaagataattaaaacctaaatctgaatatgggagaaaatagagtttaaagggaagtgtgtagaagaggtgctaggaagttactgaaggcaaattccacttgctcaacaattctcctgtggaccacggtggtagccatcagagtgggactggaaagacatggcacaccatataaatgttagcagggcgctttgtaaattgaatatatttagtgtctattgaacgtttagtctgagggtccatttctacctgcctgccttgaggtcttgttctcagtgctgctcagtcgtgacacatgacagaggtgtggctgagatcagctaggaccccagctaactctcctgcttttcccagctgcactctcagtagaccttcttttctagtctcccaggcttaattgaagctgttgttttgctcttggatccattcttccttcaaatctatgaaaaaactactcgaaagaagattgtgagctcttgctgctcctgatccctgagcaggaaaggtgactctaatatgattaatgagctcagctggactttgccccctgacctaagtgatgatgtgggctcccgagaacatttagaggaggagcaggaagagctccagcatgctgtgatgtcagatgccctcctggaaaggtctgggcctggaagaggcactctatcccagcaggatcccctgtcagagtgtgacagaaacatgcggaaggggacagctacccacccactcaccaataataattccacccctctgctagctatatgtgccctctgattcaaggatgttcctgttaaacatggttgctgcttaccactcttgtacctaaagagaaacaaaaccgtggccttcaagaattgggtgaatgactgtgctgacctactctgctcttgatgagacctgagactccctccagcatggacttagggaataaaccctctacccagagacaactcagaagacctgagtttttgctctgactccatctccaagagcagttttatctagg

SEQ ID NO: 1485 - DNA, 11296 bp, Homo sapiens; identical to SEQ ID NO: 1484

SEQ ID NO: 1486 - DNA, 1938 bp, Homo sapiens
tttatacaaacgcaaagcaaaattgggctgccatgaggggcactgaagaagacaaggctgtggatgattaggattctggacactttcctccgaggcttcagtgaagggctgtggggatgatgtctgttacgtgctgaattgtacctgcccgaaattcatatgctgaagtctagacacctagtatctccagatatgatcttgtttggaaatagggtcattggagatgtaatcagttaagatgaggtcattagagcaggctcctaatccaatatgactgatgtccttacaagaaggagcaatttggacacagacaacacacagggagaatgccatgtgaagatgaaggcagagatcagggtgatgcttctacaagccgaggaaagcgaaagatggccagcaaactaggagagaggcaaagctaggaaaggagcctggagcagattctccttcacagcctcagaaggcaccaaccctgtcaaccccttgatcttggacttctaacctccagaactgctacgttctttattggtcaccctcaccgcaagaatgtgagagaggcacagtcatccctactttgtagatgggaaactgaggctctgtgaggttaagtcacttgctcattaagtggacggatggggccacactcagaactgggatcctatcccccagtccaagccttcactaccacaccaaaccattccagtattttgttgatgcttcaaataaaatatgatctgtgtatgaataaaaagattggaaggggctgggtgcggtggctcatgcctgtaatcccagcactttgggaggccaaggcaggtggatcacttgaggccaggagttctagaccagcctggacaacatgttgaaaccccgtctctactaaaaatataaaaattagcctgacagggtggcgggtgcctgtaatttcagctacttgggatgctgaggctggataatcccttgaacctgggaagcagaagaggttgcagtgagccaagattgtgccactgcactccagcttaggtgacgaaaagaaaattggaaggaaatttcacaaacagagaaagacctttcttcttactactttgagaaacctgtgaagtgaaatcattggctcatgatcacccatgtctcccaagacatcttcttgcctactctgcaggaggctggagccatgtctgagcagcatgagaaagcctacatgaggcccctggcacatccgaggtgtgtggggcaccggggcccccagaagaggagcctttggatctgatgggagcaagggctctactgaggctgccagagatgccctcggactcagagtatggaagcgggaccattgccgttacaaacccgcagggaaggggctgagcacccggagggctgtgtgtgcacacatgacgttatcggagtcaggaaggcagccagccgcgaggagatgggaaactggtccacggcacccggggagaccttcacagcccacgcattagccctcgtcagccggtgtcccggcgctccccacaaacccagactctctccttggctaacaatggcctccaccagccgacctctttgagcctctgtgttctcatttcttccatctgccacacatgatgccacaaggtccctgctctgtctctccaacatgccactcattcctgactcacagccttcatgctcacacccctcccttgtcctatcctcactctcagtcatcctgttcaatgccttcatggcacttatcataagctcttacgatcatgtttataggtctggtttcattgttgctgtaggggggtctgtctcccccatttaggcctaacaggccaggaatcttgtctgtctgatttactcctaacatatgttaagtgttcaataaatttttgctgaataaatgaaggaaaaaaatcatgcagcctctgagatgtcatgggatgacag

SEQ ID NO: 1487 - DNA, 5670 bp, Homo sapiens
ccttttcatgttaccatttttttcctacggcgttgtctttttctgattcaattactgaagctttatatagattagtgttaactcttgttttgttaaatatgctgcaggtatttcctcccagaatgcatttggcttttaattttgcttatggtttctttagctctacaaaaagaatgttgacttcatgcatttaaatctgccagtattttcctttgtggcttctgggttttgtgctagacttggaaagttccgggggtcctttactgctggtctgtgggtgctgcaggtcctgccttgccctgcccagagcacgttcctcttcccttcctgtgggtcaaggtagcccccaggccagttctgaagccagtgaggctggactggtcctgacctcttcccgcctgtgtgcgaagctcttccgtcttccgtctcggggtgaaggtggggtgaactgtgacagaatcgcacgctggggcttgacatctagatgacgcgtccttgcctccttccagaaatgcctttggtgctgcagtggctctgctgagaggaccttatgaccctggtgtcgggcatgtgtggccagtaccctgggacactctgagacccccctcccacacccttggggctggcagcatcgaatgggtggccagactgagagttgcccagggccgtgtgtgtagctggaggcctgcagcctgctgccgggggtgagaatgtgtttgggactgagtttgggatactatttgggcctggtttggaacttgttcgggtctcgccccttctggagttgataccagggacttttgggcctctgtttggagccaggatgaggagtttcagccgagctctgagcagggcctggcgttgaggcctgcaggaggttagggcctcctggtcaggcacagggtcccctggtgctcagctcccccttggccctgatctgggacctttgctgagtgctgcggctgcctgcgctgggtgacctctggagaaggcctcaggaccaagctgggtccactcgctggggtcaggtggggtgggtccggccctcactcttccctaggcctattgggtgacccaggcagtccatgcccctctggactctctgctcagtcattcagcgctctttctgcccctcttaggccccaggcactgccatcagtgtccccatcatccaccagtagcaggggtcccggccctgcctgccctgcgtacacagggacatggaaagctgtggcccccatgctgttggtcctggggctgaactcgccctccacctgcctggggctgggaaacccctcattcccacctccaaccctgagctgctgggacgcctgcctcatcactgttggagcctccctgttcttctggaacccggagctttagtcctgagggctgtgtggcctgacctctgccccccaagaggcctggaaccctccacgggattggctgtggtgattcccatggtcctccctttcccacaagccctgagaaggccatgaggcccattccctccgtcccctgtcccctgctggtctcagctgagcacagagcccacttactagggactctggtccctagaggcttcagggaccatatggccggaggacacccagtccttccctgggccagggtgggaggagcagggcagtaactggagatggcaggagaaggtgggagagggtttcaggcccggggtccccttacttcaccccagccacagacacacagaccagaagcagtgctcagtcctctattggagattctgccccctctgggacagatgtccacgctgcccgcgactcctgagcacactcccatggcgggtggcgtgctctgggtgggtgtgcggcagtggccggtcagggtgtagggaaggggactgagaggggaccttggtgagcttgcatttgtgtggggatacacgtgaaggggtgtctgatcccaggactcagggcctcttcctcctggggggcacacagagccccttcccttcctcctcggggaacagccccggaatggggccttcccttggtgcctctaggtcctgccctccagcccatgtccccagaaggtggtctttccttggaggggtcagagactatagcccagggctctggggtcactgtgggaacatctgcctcagctcggcacgcacttctcctggcctgtttcttccactgggaactgggaccctaacccctcaaagggggatccctgagcgagggtcatgggcagggagctggtatggacgggtgtgtgcggggaggggtgactggcgggggctggggtgtcagggggctggggtggcctagtcgtctttatccttggcgccatgtttgaggatgcgggtgaactccacgtagttgaagttgcctttcttatcaatgggtgcctcccggtacatctcgtccacttcctcatctgtgaagcggtcacccatggtggtgagcagctcccggaggtggtcctcatggatgaaacctgcgggcaggggcagggtgggtgagagcaggaacttgggctgagacatacacagcagccccatccctcagccccctggcagctcttgcagacctagaggggctgggaagatacaatcttagtctctggtcagtctgaggaatgaggacgtggcaggaggggtgtgggggtgcacgtgaaggggtgtcggatcccacgtgaaggggtgccagggtcctgaggggaggagttgtgcagtgggactgtctccgaggtgtcacttggggaacttgaggctgtgcacacagatggtgttgggtgtgccctgttttaagcgtgagctctggagttccactgcctgagttgcagtgctgattcccattctccctagctatgtgactttgggcaaggtccttaacctccgtgtgcctgtttaatctagaaaacagggatgaacgtatgccattgcagtgagggaccgtgaaggtagtcaggcccgtgcgggcccatggccatgttaccatggccatcatcaccctgacatgtccctgggaaaaatgagctgagggatggaatatccgttaggagatccgaggaggggggccagtttctataccttcttggcaagaaaggcatgaaatggtttgatttctggaaaggtctaaaacagatggagaatgtgcattgggccagcgggggagatcacgaaggcaggagtcttggggcatgggctgttctggcctagcctttgcggcgacaataaggaggtggcctggcttttatagttctggtgacagaacctgggagatgggtgatgtctgttctggcccttaggggcagaggcactgaatgcctgggccctgttccacttgcatgcagagtggtggtagggggcgccacggacctgaggcttcctcgtcgaagcaggcaaaggcgttgcgaatcacatcctcggggtccgtgccgttcagcttctccccaaacatggtgaggaacatggtgaagttgatgggccccggggcctcgctcatcatgccctccaggtattcgtctgtggggttcttccctgtggcaggtggggtgttccagcctgtggtcctgggccctctgtccccagctgggacaacttgcacccccgtcccccacccctgcccttcaccgctccgtgtgagacgggaggtagtgggttttgtgaactggaaagcatggctctagcgcagccacagcagtgggcgcccggagtccctggctgctcccaccagtttcctcctgtggcctggatgtcagcagccggcagtgctcactaaagtgtaataagaacaaccctctgcagactgctcgctgtggctggtcgaccacgtgccttattgcatttaactttcaccaccctgtgaagtcagcattcttacccacttcacaggtatggaagctgaggcacagagaggccaggtgacttgtccagggtcagacagcaagtaaggaggagacttgagtagacctggcatttgaacccaggcagcctaactccaaagtccagacacagtgctttgctgtcagacaggcctgggtttggatcccagctgtgcaccttggttttccccatctcttaggggaattgtgaagacagtagttgcaaaaggctcataacaatgactggcacaggcctatggactggaatcaactgctgggtttctattgcagccccactacttggtagctgtgtgaccttgggtaaattacttaacctctctgagcctcagtttccttgtttgtaaagtgggaataattgtatctgttcaataggattgctttgagatttaagataatacctgcagggcttcttcttattattatatttgctgctcttgtttttaacttgaagataagggtgtgactcacctgcagacccacggatatgagctacaaacacagtgcatgtttttctgggtggacacccagggctgtcatgaagtctcaggggttcaggggcctgggtgcagggtgtggccttggaaataggaagttttcatgtccctgagcctcacataccctgctgtgtccccctgggatggccatggaagctgaggcccaagaggagctgtgacgccaggacactggggtacttaaggccagccccttctctcaccaggcctcagtccttccacgaagctgggaaagccccagataagaaccctggagttggccaggcgtggtagctcacacctgtaatcccagtactttgggaggccaagatgggctctggagtttgagaccagcctggccaacatggcgaaaccctgtctctactaaaaatacaaaaattagccgggcatggtggcgcacgtctgtaatcccagctactggggaggctgaggcaggagaatctcttgaacctgggagacggaggttgcagtgagccgagatggtgccactccagcctgggcaacagagtgagattttgtctcggggggaaaaaaaaagaaccctggagtttacttcctgccaggtgacctcctgggggagggagccttcaagcgagcctggccagaagcggggagaggtttggtgctcagggccgggggcagcgtgctgtcagttctcccactcaggtttgcctggttctcctgctcagtgcctcgtggggaaatgtcagggtcatggccccatttcacaggaagaggaaagtgcacagggccctaccagggactgactctctggcctcaaagctcgaggcttgactgtcacggggctgtgtcctctggtcctggactctccctcccccaggcagtgtctggtctggatgctgtcactcggcatgaggggtacgcgggaactgggctgagagtggctggctgtggccagcactttgggagggatgttggggcaggcccgtgggttggggcatggtctgtggaggccttgcctctgggcctgtgtttccccatctgcagtagagaattggacttgatttttgtaccctgttagttctaaggtcctgatcctgaggaagtcactgggaccagagaggctatgagagcctgagatgggtgacctctgaaggaggggagctggtctggccgcccctctaggcctcagtttccccatctgtgcagtgggcagcctgcagttcacactttcatttagatgctgacctctttctttcctttctttctgttttgagacggagtcttgctctgtcgcccaggctgg

SEQ ID NO: 1488 - DNA, 5670 bp, Homo sapiens; identical to SEQ ID NO: 1487

SEQ ID NO: 1489 - DNA, 5670 bp, Homo sapiens; identical to SEQ ID NO: 1487

SEQ ID NO: 1490 - DNA, 3981 bp, Homo sapiens
cttaaccgttaaactttaaagctgagagtatcttttttttttttaaacagtgctcagtcctctattggagattctgccccctctgggacagatgtccacgctgcccgcgactcctgagcacactcccatggcgggtggcgtgctctgggtgggtgtgcggcagtggccggtcagggtgtagggaaggggactgagaggggaccttggtgagcttgcatttgtgtggggatacacgtgaaggggtgtctgatcccaggactcagggcctcttcctcctggggggcacacagagccccttcccttcctcctcggggaacagccccggaatggggccttcccttggtgcctctaggtcctgccctccagcccatgtccccagaaggtggtctttccttggaggggtcagagactatagcccagggctctggggtcactgtgggaacatctgcctcagctcggcacgcacttctcctggcctgtttcttccactgggaactgggaccctaacccctcaaagggggatccctgagcgagggtcatgggcagggagctggtatggacgggtgtgtgcggggaggggtgactggcgggggctggggtgtcagggggctggggtggcctagtcgtctttatccttggcgccatgtttgaggatgcgggtgaactccacgtagttgaagttgcctttcttatcaatgggtgcctcccggtacatctcgtccacttcctcatctgtgaagcggtcacccatggtggtgagcagctcccggaggtggtcctcatggatgaaacctgcgggcaggggcagggtgggtgagagcaggaacttgggctgagacatacacagcagccccatccctcagccccctggcagctcttgcagacctagaggggctgggaagatacaatcttagtctctggtcagtctgaggaatgaggacgtggcaggaggggtgtgggggtgcacgtgaaggggtgtcggatcccacgtgaaggggtgccagggtcctgaggggaggagttgtgcagtgggactgtctccgaggtgtcacttggggaacttgaggctgtgcacacagatggtgttgggtgtgccctgttttaagcgtgagctctggagttccactgcctgagttgcagtgctgattcccattctccctagctatgtgactttgggcaaggtccttaacctccgtgtgcctgtttaatctagaaaacagggatgaacgtatgccattgcagtgagggaccgtgaaggtagtcaggcccgtgcgggcccatggccatgttaccatggccatcatcaccctgacatgtccctgggaaaaatgagctgagggatggaatatccgttaggagatccgaggaggggggccagtttctataccttcttggcaagaaaggcatgaaatggtttgatttctggaaaggtctaaaacagatggagaatgtgcattgggccagcgggggagatcacgaaggcaggagtcttggggcatgggctgttctggcctagcctttgcggcgacaataaggaggtggcctggcttttatagttctggtgacagaacctgggagatgggtgatgtctgttctggcccttaggggcagaggcactgaatgcctgggccctgttccacttgcatgcagagtggtggtagggggcgccacggacctgaggcttcctcgtcgaagcaggcaaaggcgttgcgaatcacatcctcggggtccgtgccgttcagcttctccccaaacatggtgaggaacatggtgaagttgatgggccccggggcctcgctcatcatgccctccaggtattcgtctgtggggttcttccctgtggcaggtggggtgttccagcctgtggtcctgggccctctgtccccagctgggacaacttgcacccccgtcccccacccctgcccttcaccgctccgtgtgagacgggaggtagtgggttttgtgaactggaaagcatggctctagcgcagccacagcagtgggcgcccggagtccctggctgctcccaccagtttcctcctgtggcctggatgtcagcagccggcagtgctcactaaagtgtaataagaacaaccctctgcagactgctcgctgtggctggtcgaccacgtgccttattgcatttaactttcaccaccctgtgaagtcagcattcttacccacttcacaggtatggaagctgaggcacagagaggccaggtgacttgtccagggtcagacagcaagtaaggaggagacttgagtagacctggcatttgaacccaggcagcctaactccaaagtccagacacagtgctttgctgtcagacaggcctgggtttggatcccagctgtgcaccttggttttccccatctcttaggggaattgtgaagacagtagttgcaaaaggctcataacaatgactggcacaggcctatggactggaatcaactgctgggtttctattgcagccccactacttggtagctgtgtgaccttgggtaaattacttaacctctctgagcctcagtttccttgtttgtaaagtgggaataattgtatctgttcaataggattgctttgagatttaagataatacctgcagggcttcttcttattattatatttgctgctcttgtttttaacttgaagataagggtgtgactcacctgcagacccacggatatgagctacaaacacagtgcatgtttttctgggtggacacccagggctgtcatgaagtctcaggggttcaggggcctgggtgcagggtgtggccttggaaataggaagttttcatgtccctgagcctcacataccctgctgtgtccccctgggatggccatggaagctgaggcccaagaggagctgtgacgccaggacactggggtacttaaggccagccccttctctcaccaggcctcagtccttccacgaagctgggaaagccccagataagaaccctggagttggccaggcgtggtagctcacacctgtaatcccagtactttgggaggccaagatgggctctggagtttgagaccagcctggccaacatggcgaaaccctgtctctactaaaaatacaaaaattagccgggcatggtggcgcacgtctgtaatcccagctactggggaggctgaggcaggagaatctcttgaacctgggagacggaggttgcagtgagccgagatggtgccactccagcctgggcaacagagtgagattttgtctcggggggaaaaaaaaagaaccctggagtttacttcctgccaggtgacctcctgggggagggagccttcaagcgagcctggccagaagcggggagaggtttggtgctcagggccgggggcagcgtgctgtcagttctcccactcaggtttgcctggttctcctgctcagtgcctcgtggggaaatgtcagggtcatggccccatttcacaggaagaggaaagtgcacagggccctaccagggactgactctctggcctcaaagctcgaggcttgactgtcacggggctgtgtcctctggtcctggactctccctcccccaggcagtgtctggtctggatgctgtcactcggcatgaggggtacgcgggaactgggctgagagtggctggctgtggccagcactttgggagggatgttggggcaggcccgtgggttggggcatggtctgtggaggccttgcctctgggcctgtgtttccccatctgcagtagagaattggacttgatttttgtaccctgttagttctaaggtcctgatcctgaggaagtcactgggaccagagaggctatgagagcctgagatgggtgacctctgaaggaggggagctggtctggccgcccctctaggcctcagtttccccatctgtgcagtgggcagcctgcagttcacactttcatttagatgctgacctctttctttcctttctttctgttttgagacggagtcttgctctgtcgcccaggctgg

SEQ ID NO: 1491 - DNA, 3981 bp, Homo sapiens; identical to SEQ ID NO: 1490

SEQ ID NO: 1492 - DNA, 3981 bp, Homo sapiens; identical to SEQ ID NO: 1490

SEQ ID NO: 1493 - DNA, 3981 bp, Homo sapiens; identical to SEQ ID NO: 1490

SEQ ID NO: 1494 - DNA, 3981 bp, Homo sapiens; identical to SEQ ID NO: 1490

SEQ ID NO: 1495 - DNA, 3981 bp, Homo sapiens; identical to SEQ ID NO: 1490

SEQ ID NO: 1496 - DNA, 3981 bp, Homo sapiens; identical to SEQ ID NO: 1490

SEQ ID NO: 1497 - DNA, 3981 bp, Homo sapiens; identical to SEQ ID NO: 1490

SEQ ID NO: 1498 - DNA, 3981 bp, Homo sapiens; identical to SEQ ID NO: 1490

SEQ ID NO: 1499 - DNA, 632 bp, Homo sapiens
cttaagtgctcctaactagacacataatgtttagtgtgctgccattttttctgagtgttagttttaaatagactattgacaaattacagatttttttcacgtattgaaattatattccagatgattttgagatttactggtataatattctcctcatgaggtaggatggaagggaagaaatagagaaaaaatgttctgctctgaaataaatgtggtgtttcctgacagcgtttgtcaagagatggggttccaccatgtagccccggctggtcttgagctcatgagctcaagcgattcacctgcctcagcctcccaaagtgctgggattacaagtgtgagccaccattcctgcctctatacctctaaaggtgttgaataatttgaatgggaatttgaaggtccatggcttccaaaccagcaggagttaaggcttaattgcttggaaatacattttcatggctgataccagtaacagaaaaatgtctgtatgtcaagaggctctgtactaatcagttaaccataacatgtgccaccccataccttgggccaatgtaactgttaacagcttgaagctattaaaaatgtaccaatggagaactttcttatacttttttcactaatgtgcttcttca

SEQ ID NO: 1500 - DNA, 568 bp, Homo sapiens
tcaaactggcccaaagatccccatagtcggcagaatcttcttgtaccttcaagaaaatggtattcttgtcaatgactaaaaatctccaggccaccaagagaggttaattcagacccccatctggagctctgggtagacctgggaggaagctggagccctggaatagcagaacctttgtgccaccatcgctgaacaggagaaaccaccaagggcagctgtaggagctctggctccagcacttgacaggacaaagacaggagatgggagagaagggctcagaccacagcctttctttcatgacgcttcagtacatgagctgtccggagtaaaaaaaagggctgcatggcagtgacagctacagcatgacctggaagacctgagaagattcagggtgcacgttgagtcgtgctacacaggatgaagctgggggaggtctgggagatttccagggctgaggcggacagcctgtaccacgttgcattttcttagcaactccccaacttacagcctatcggatgctgttagattctgacacatttggtacgaaccaaatggctatgacttaatt

SEQ ID NO: 1501 - DNA, 2183 bp, Homo sapiens
ctggcggccccggcggcggcggcaggtgtggatggggcgaaggtgcgggaacgtccactcccgcgcgcccctctcggggaccagggcggcctcccaggaggagcttggtttctggtcctcataccgtgtggttgagtgaaatcaaaacttccacgatagcaatgctgattggacaaagaatgtgttgtggacacaaaaccaaactctggaggacagaggattcattccaagggtctgcttgtattcaatgactggtctacgtgggggtgtgaagtccccttactccacctgtgaagagtcttcccagtttcagaccaccctcccagcctcctgttattggctaaggccattttgtgactacactgcaggtagagatggattcctggaaatacctcctcaaggccagtgtagagccctcaatcacccactgcccccagcttctccttctcccatctcctgcaccaagcaggtctccaggtgttccagctgctgatgacgtaaagtgtggagttggtccaggaaggtcatgttccatgcagcagaggagcgctttgtgtgagaagttgaagacctgctgtaacacatcatagaggaaagacatagcctgggccttctgcaactggctgacttccaccttctcctgggggaatctgaagtcacttctgtcctttagacacaagaagggagagattctcctcatttggcccaaaagcaccaaggtgttcctgcctagcaggccatggttctgaggcaggttatatcctagagatccagaagagccacagctgcacacctctagggctgccagtagagggaagaggagggccattgagaaatcaggatgcttttggcctggttgagctgaggtcttcatagaaccttggatcctaggttctatgaagacattctatctatgcatggctttaatggagcacaaatagttttcatttttctgagcatttctctaaatttttaattccatttattgttttcatttacatgtcttctatatcagcatccacaaccttttggccaccagtttggtggaagataatttttccacgaaaaatggggtcagggagggaatgctttcagaggcattagattctcattaggagaccacaacctagatccttcgcatctgcacttcacaatagggttcctgctcttttgagaatccaatgccactgctgatctgacaggaggcagagctcaggcgttaatgcttgttggttggcctgcttgcctcctgctgtgcggccctgttcctaccaggccaggaccagtaccccggtccatggatgggggttgaaaaaccttgttctatatgacctaaaaggaggtcatcactctacactcttgatttttgcaatggatgttcaatattcccagtaaacttaagatatatcaatccaaatgaatattgatcaatcagatgagaaacatctttgtgctactgttagaagtatatacttttagcccagatcctagcctccagttttaccctccattttgcataggaaatcaggatccctgggccctatgggtttctgtattcagttaggaaattacctatctctggaaattaaactttttaggactatctttgtttgatatttgattcacagaagacgttgatggttattagtgaaagaacttctctggtgcttccctccttctagaatatattcattcaggttcatgtggttatgcttccctgggggctcaagcttagatcaatgaacattgccttttttgcattattttcttactggagaaatatagcactcctcaggctgcgccaatacccctaaaagaaattctgttggtttgtttttttttcttttttaagatgcatatgggtgtggaaattttaatcttaaaataatgttatttcctcagcagtgatgattcacaaggtatttatcacatcaagtcactccctaaatgcaggctcaccacatcctgatgactttagaactccttttccagggaggttcttgcttctttgttgccaaaacaataaatcctttgtgacctttgtccttgctcctagaatatttgggtgaaggagtatatgctgtcagtggtgacctcctcttcttctgacccatgccctaggtatcaaagtctcaacagccctagaacgctgataacaaagatctgattactcctgaatttca

SEQ ID NO: 1502 - DNA, 2183 bp, Homo sapiens; identical to SEQ ID NO: 1501

SEQ ID NO: 1503 - DNA, 2442 bp, Homo sapiens
ctggcggccccggcggcggcggcaggtgtggatggggcgaaggtgcgggaacgtccactcccgcgcgcccctctcggggaccagggcggcctcccaggaggagcttggtgagcagctgcgacctgtgcataacttggggcgccgccaggggctcgcaggttccacgtccggcgcctggagaaggaagacgcgcgtccccggccgcggcgccgaagccggctgggggaccgcctggtcccgggccagagctgggaggcggtgttccgtgagccgcctggtctggggtgcggggggcgggaagcggccccttcgtgtgcgcttgggcgaggccgggcggcgcttctgtcctcctactcggacccgcaggtttctggtcctcataccgtgtggttgagtgaaatcaaaacttccacgatagcaatgctgattggacaaagaatgtgttgtggacacaaaaccaaactctggaggacagaggattcattccaagggtctgcttgtattcaatgactggtctacgtgggggtgtgaagtccccttactccacctgtgaagagtcttcccagtttcagaccaccctcccagcctcctgttattggctaaggccattttgtgactacactgcaggtagagatggattcctggaaatacctcctcaaggccagtgtagagccctcaatcacccactgcccccagcttctccttctcccatctcctgcaccaagcaggtctccaggtgttccagctgctgatgacgtaaagtgtggagttggtccaggaaggtcatgttccatgcagcagaggagcgctttgtgtgagaagttgaagacctgctgtaacacatcatagaggaaagacatagcctgggccttctgcaactggctgacttccaccttctcctgggggaatctgaagtcacttctgtcctttagacacaagaagggagagattctcctcatttggcccaaaagcaccaaggtgttcctgcctagcaggccatggttctgaggcaggttatatcctagagatccagaagagccacagctgcacacctctagggctgccagtagagggaagaggagggccattgagaaatcaggatgcttttggcctggttgagctgaggtcttcatagaaccttggatcctaggttctatgaagacattctatctatgcatggctttaatggagcacaaatagttttcatttttctgagcatttctctaaatttttaattccatttattgttttcatttacatgtcttctatatcagcatccacaaccttttggccaccagtttggtggaagataatttttccacgaaaaatggggtcagggagggaatgctttcagaggcattagattctcattaggagaccacaacctagatccttcgcatctgcacttcacaatagggttcctgctcttttgagaatccaatgccactgctgatctgacaggaggcagagctcaggcgttaatgcttgttggttggcctgcttgcctcctgctgtgcggccctgttcctaccaggccaggaccagtaccccggtccatggatgggggttgaaaaaccttgttctatatgacctaaaaggaggtcatcactctacactcttgatttttgcaatggatgttcaatattcccagtaaacttaagatatatcaatccaaatgaatattgatcaatcagatgagaaacatctttgtgctactgttagaagtatatacttttagcccagatcctagcctccagttttaccctccattttgcataggaaatcaggatccctgggccctatgggtttctgtattcagttaggaaattacctatctctggaaattaaactttttaggactatctttgtttgatatttgattcacagaagacgttgatggttattagtgaaagaacttctctggtgcttccctccttctagaatatattcattcaggttcatgtggttatgcttccctgggggctcaagcttagatcaatgaacattgccttttttgcattattttcttactggagaaatatagcactcctcaggctgcgccaatacccctaaaagaaattctgttggtttgtttttttttcttttttaagatgcatatgggtgtggaaattttaatcttaaaataatgttatttcctcagcagtgatgattcacaaggtatttatcacatcaagtcactccctaaatgcaggctcaccacatcctgatgactttagaactccttttccagggaggttcttgcttctttgttgccaaaacaataaatcctttgtgacctttgtccttgctcctagaatatttgggtgaaggagtatatgctgtcagtggtgacctcctcttcttctgacccatgccctaggtatcaaagtctcaacagccctagaacgctgataacaaagatctgattactcctgaatttca

SEQ ID NO: 1504 - DNA, 2442 bp, Homo sapiens; identical to SEQ ID NO: 1503

SEQ ID NO: 1505 - DNA, 7479 bp, Homo sapiens
atctcattgaggttgcaatagcactgacacttaaagttaagtgttttcttgcttggtcttagcactctagccaaatggattttgagggcctcctattcatgggtcacagctgcttgactcaaggatttttgcctatgcatgccctgacagtcagatactaactcacttggatgcctgcctctcacactgctctactttatgaagtcaagaccattaataaaatccagtttacagaaaggcctagagaaggttatttctctgaacacttcgctgtacctacttccataacagatgaacttaccagatgtaacagaagcggttcttctgttctcgtggaagatgaagttgtcctttgttttgatgagtcctgaaggacttaaaggctccactggcagacagcagagaaggggagaagaggagaagcagctggacattgaagactctggtttgacataagagagaagcagcttcacttcagagggacaacttgacattgggacatcaggggaagaatgccttcttcctactccatcccctttccagctccccctctcactgagagccacttccatcagcaataaaatcccccacatttactatccttgaatttgtgcaacctggtttttcctggacaccagacaagagcttgggatacagaaaactgtcacactaaccatctgccctcatgaaaaggcagagggtccactgagctattaaacactgaagctgtctgcagacagcaaagctaaaagagcactgtaacacactccctctggtgcttcaggggtaacaggtagtcccgtagacaccgccatcaggctacacggagttttgctccttccagtacccaaaagcactcactccagcttctgcacctgctcacctgcatgctccccctcccacgaggggttgaaagctgcgggctgagtaagtgaggcacccctgtcacaaggcttgagaagggatcaaggaaaatttcctgtttcattatgctttgttcatgcctatctctggacaagcaactatggccagggaaaaggggttgtacaatatgttcaggagaagagaagaagctactcttttggccattttgaacaatagccaattcaccacacagcataattaatggtttagaattttttcttcttttatttttttctttctgtagagacagtatctcattgtgttgcccaagctggtctcgaactcttggactcaagcaatcatcctgcctcagcctcccaaagtgctggggttataggcatgagccaacacgccctgcctagaatttcatttctattcattaaaaatacatcaaatggtttttatattacagtaaaatcactatttcaaatgattattccatatattttatgtgcaaaattaagagctgccatattgtctttaaaggcctgcaggtatagaaaggactcactgctttttatgaacacatctctcctattcacacctccaagagttattgcttcttggtaaccctccattaagcgtttgattaagttcaaggtgattagattattaacactttagtcatggtctggttggcttatccccctacccctctccattcttttaatcactgctctattcatccactcaacaaatatttaatgagtgcctattatatgccaattctatagatactaaacataaatagagataaataaagcatgatctctgcatttaagggctataccaaagatgggacatcagacaaataaacagattattataatactgtgtaagggccaagtccccttcatcctctgaaagttcactgaaaatcaactgacaaaaagtagactaatacaagaaaaagcacacattctattaacatgctataggcgtcttacaaaataagatctcttaaaaaggcaaatgattgacccacttatgccatgtcgaggttacagaactaataggtgtctggatcatggcaaaactaattacaggagggggagaagaggaggcctggctagcaaaggtgatcttgttctgtggatgaaacctcacaggcctcagccctcagaaagaatagatggtaaatgtttattttaggcttttaaaggtgtcagactcttggccaatctttcctagatctgacaaagcctggctgcatcaatgtagattctctacagatgcaaatcaccgcctcaacacacagttttacagagctgcttctgtttgcagaccctctgaatgttacaggtagttagacaggcatgagctgggcaggagagggctctcctcaacccaccaggaatgtcaggtgatgattcaacgattagcacattgcttctctacagatgataatttggcagcaggcaccagggagaagcaaaaataacttccaataaaatctcaggtattgggtgaatgagtctagacacgtagattaggagacaaaatggcagagcatgaccttccgggggcagtccaccagaaaagagaagaagacctgagatgtgcctgtgtacaacctcctgaatacactgcgtgtgctcacttcccaagcataaggagggcactccacatgcaggcagcccaccctaagggaagaatcatgggaaagggggacgtgagaagcaggaggtcggccagcctataaagtcctgggatcaaggttaaacaccactcttgacctcgatgcctcgttgggtctcttccaagtgtatttttctttctttcctgttctaaggtctttttaaataaacttccactcctcctctgaaacttgcctttgtctctttttctggctattcccctcagtcgaattctctcttctgaggaggcaagagttgaggttgctgcagacccatatggattcgccaccggtaagtcagatacctgccatgagactcagatatttgccaccagtaacatgaacggacatttcaaaatatgtcaaagaagtgtatcttgaggggaagtagaatattctccttcaactgtactgtatgataagtgctgtgataggtcttttctatttttcactagtctctgggccacaaggaacaatctgtccctttgcatctcaaaatgcttgctcatcctactcagttagaaattaaataattcaaacttaaaataattcaaatataaagctgttagaacttttcattattctgagccttgggaggaatgtggctatgcagcctgaatcatgtactcagtagctacaatttctgcctttcatatctgtaaataattaggaagaacaagtggcaccagagataagaccccttcatatcactgcccctcctcatggagtaataaggtaatcttccttggaatgtagcaatctgcaaccaatcaaattgctgtggtgtatgcactggtcttatatggaaaatgcaatcttgctggaacttctctgtctgcctacataagtgaaaccttaacttctccacttctgtactccaaatgactgctgaccccattcatttggagttggtgtttccaagtgaccatcctaaagctttgcactagaaaaaactccattctgaatcatatatttttttccaaatgggatctcactctgttgcccaggctggagtgcagtggtataatcacagctcacttcagccttgacttctcaagctcaagtaatcctcccacctcagcctcttgagtagctgggactacaggtgcctgccaccacactcagctaatttttaaatttttctgtagagagggggtctcactatgttgcccaggtttgttttgaactcttggatttgatcagtcctcttacctcagcctctcaaagtgctggtattagaggtatgagccaccacacctggccccaatcatattctttgaatctcattatttaaggttaacaccagtgatgtctacatcttttcaagcagggactaacttctattcacaattatagataaggattaaggtgaaaacacccttgaggactaagcgttttaaattcacactgaggtaaaatgagtgattttatatcctttcttgtaagcaagttcccccacccctgctctctgcctgctgtctagaagaagtaaaaccaggagtcctctgtgaaattaccactaaccaggcaccatcttaacgtgttgttaaacatcatctgttttcctctgggtactagcagtcactgagttctctcttactgaaaaagcgaagttgcgtatttcattcacttgcttttatgagtcctttggctcttctaggctttctttttttgatttaaccagcccacaaactaaagtgagtatctattaatatttccccagaccactattcaaggaaatgaaccacttgacattaatcatgatggcagaactccttgactgacagtcttttctcagaattcatgaggctacagtgcctgtgggtcactgctgtgcaaactttgctaaccaagacattccctgaggagtttgtgagcagtttgttagcaagtcatgtccctcaagggctctaattgagtgggtctggggaaggacccagaaatctgtagtgttaccaaacctaccggctgattctggagctggtgttccaaggaacaaatttcaaaaaaccttgcaatatagggtttttttttttcttattaatggggtaaatttaagtatttaattaatggggtaaattcatccattcattcaagtacttatcaagcactttctatgtgcctcctaacttgattttttattgctaattatttttaatttaaactccattgtcaagtttcacttttcttaggagagttgccaagggtgaggcttataagagacaaagtggaattggctgcgagagtggtcacttcagctgcaggcgaggaggtgggagggatgacatccaggcggttggaaaccatctggtaggaagcaaacccaatgatgaccctcacctaaggaacttggctatttgtgtaagcgtccagagggagtgatccctggccccataacgtgctgaggcaatttcaagagttacgagaggatgaagatttcaacatgtgtgatcagaaagttgaatgagatctttgtctgggcagctagcaggccttcttctgttttctttactattatactgtgactaacgattgggtgtttggttttggttataacttgaaaattgttgtgatccatgtgaagtaatgtcttgtgaatattccacatggatgcagcccctacatcgtcagatctctccaggtatttcggaaagattttaatccctcagcttaaacacaagttccgttttagggccaatccccagatggaggagttagatgtacattccttcaaagaggccccagccagccaccccaaggtttggagcccgtgagtgagaaagtctggaacttttggctgcttggtttcatttttttagttttctttttgggagtggtggtagaattttacaaagacttggtgggggaagacgggaagagagctgtcccagaaaggaagattttatactccataccatcttctgactttccctttttaaatggtcttgtgatttgtctccagagaagagttgggaacaggacctagaaagaagaggggcagctttgttggaatttattgctggttctgcacaggccctggcccgggtcccagggacatcagggcccagagacctcacgtggcttgtcctcacctggcttgcctaggtttgaggtgttgctcaagacagagcctttgctgctgcccctgaacactgcctgccagcaccccagcccaccaccctgacctcatcaccccggaaaggagcaagctcatcaaataggacagtgcttggggtcttcgccagtagctagcactggctgctgtttatgagcatctgttatacacaaggcagtggagcattctcacatttaatcctcaacacagtgctatcagagatgggggtcttgttatgtcacccaggctggccttgaacgcttggtctcaagagatcctcctgcctcagcctcctgcgtaactgggactacaggaacataccaccatacccagttactttcaaggatctgaattcaggtctgttagtctccaaataactgtacttttaaccactactccttaagaatttggtcattcaggattaagtttagctgtataaccagaaactccaaataataaaagtttaaattagatacaaatttattttccactcacatgaagaagtccagaggtagtcaagttgtggctagtgaattctattaggggttcaggcatctgcagtgttcttgctttgtcctccttagcacaatgtttccaccactgggtccagagtggcagcctgagctcagcaattccatctgcattccagccagcaggagtaaggatgaggagaaagggcatgtttccttcctttgggggcgttttttagacgatacataccaaacttctacttgcatgtcatttgccataacttagtcaatggccatactagctgcatgggaagctaaaaaatgttacctttgttttgggcagtgaagtgaccagcttaaaattaagaaattgattactaaaaagggaaaaatggttatcaggatacaactagtaagctcaactacaactgttagacctaagtctgcaatgctaagccacatagtaaatgatgaaaagtcaaaagtagagacttgaatatatgatgtaaatttttctaggtcgcaattttatgcatggtttaatgtttcatttttgtccagttgttaaactgtttgctagattaacaatattcatcttgaatgtaaaatgttatagccactatggaagacagtttggtggttcctcaaaaagttaaatctagaattaccctatgacccagcaatttcactcctagatatatacccaagacagctgaaaatatatgttcacacaaaaatgtgtacacaaatattcatagcagcattattcaaaatagacaaaaatgtaaacagcccaaatgtccagtaatgatgcatggataaacaaaatgtggtcggtccatacaatgaaatattcagcaataaaaaggaatgaagtactgatacatgctaagacacaaatggaccttgaaagcattatgctaagtgaaagaggccagacataatggccacatattgtatgattccatttacatgaaatgtctagaatagggaaatccacagagacagaaagtagagtagcgattgccagggaatggtgggaaggaggcacaagggtgaggtttctgtttggaatgataaaaacgttgtagaagtagatagtagtgttggttgcacaacataatgaggacactagaaatcactgaagtggatactttaaaatggtgattttcagccaggcatggtggcttacgcctggaatcccaacactttgggagggtgaggtgggcggatcacttgaggtcaggagtttgaaaccagcctggccaacatggtgaaaccctgtctctactaaaaatatatatattaaaaaattagccaggcatggtggcggg

SEQ ID NO: 1506 - DNA, 7479 bp, Homo sapiens; identical to SEQ ID NO: 1505

SEQ ID NO: 1507 - DNA, 3138 bp, Homo sapiens
atctcattgaggttgcaatagcactgacacttaaagttaagtgttttcttgcttggtcttagcactctagccaaatggattttgagggcctcctattcatgggtcacagctgcttgactcaaggatttttgcctatgcatgccctgacagtcagatactaactcacttggatgcctgcctctcacactgctctactttatgaagtcaagaccattaataaaatccagtttacagaaaggcctagagaaggttatttctctgaacacttcgctgtacctacttccataacagatgaacttaccagatgtaacagaagcggttcttctgttctcgtggaagatgaagttgtcctttgttttgatgagtcctgaaggacttaaagccttagtattctcaccattcttgaaaatgtcacacacttcagatcgtcagcctcctagacactagaccttgatcattttgtgaatatcactcttcaggaagtgttcctggacgtaaccaagggtcaggctgcttattctcatggcccaataatgagatgcagatgaactgggaaagaagagagtttatttctgcaaccagcttcagggagaaggccaggaaaatattgccagaccagctcaaaattacaaagttttccaaagctcatgtaccttctaagtctacgtgctccactggcagacagcagagaaggggagaagaggagaagcagctggacattgaagactctggtttgacataagagagaagcagcttcacttcagagggacaacttgacattgggacatcaggggaagaatgccttcttcctactccatcccctttccagctccccctctcactgagagccacttccatcagcaataaaatcccccacatttactatccttgaatttgtgcaacctggtttttcctggacaccagacaagagcttgggatacagaaaactgtcacactaaccatctgccctcatgaaaaggcagagggtccactgagctattaaacactgaagctgtctgcagacagcaaagctaaaagagcactgtaacacactccctctggtgcttcaggggtaacaggtagtcccgtagacaccgccatcaggctacacggagttttgctccttccagtacccaaaagcactcactccagcttctgcacctgctcacctgcatgctccccctcccacgaggggttgaaagctgcgggctgagtaagtgaggcacccctgtcacaaggcttgagaagggatcaaggaaaatttcctgtttcattatgctttgttcatgcctatctctggacaagcaactatggccagggaaaaggggttgtacaatatgttcaggagaagagaagaagctactcttttggccattttgaacaatagccaattcaccacacagcataattaatggtttagaattttttcttcttttatttttttctttctgtagagacagtatctcattgtgttgcccaagctggtctcgaactcttggactcaagcaatcatcctgcctcagcctcccaaagtgctggggttataggcatgagccaacacgccctgcctagaatttcatttctattcattaaaaatacatcaaatggtttttatattacagtaaaatcactatttcaaatgattattccatatattttatgtgcaaaattaagagctgccatattgtctttaaaggcctgcaggtatagaaaggactcactgctttttatgaacacatctctcctattcacacctccaagagttattgcttcttggtaaccctccattaagcgtttgattaagttcaaggtgattagattattaacactttagtcatggtctggttggcttatccccctacccctctccattcttttaatcactgctctattcatccactcaacaaatatttaatgagtgcctattatatgccaattctatagatactaaacataaatagagataaataaagcatgatctctgcatttaagggctataccaaagatgggacatcagacaaataaacagattattataatactgtgtaagggccaagtccccttcatcctctgaaagttcactgaaaatcaactgacaaaaagtagactaatacaagaaaaagcacacattctattaacatgctataggcgtcttacaaaataagatctcttaaaaaggcaaatgattgacccacttatgccatgtcgaggttacagaactaataggtgtctggatcatggcaaaactaattacaggagggggagaagaggaggcctggctagcaaaggtgatcttgttctgtggatgaaacctcacaggcctcagccctcagaaagaatagatggtaaatgtttattttaggcttttaaaggtgtcagactcttggccaatctttcctagatctgacaaagcctggctgcatcaatgtagattctctacagatgcaaatcaccgcctcaacacacagttttacagagctgcttctgtttgcagaccctctgaatgttacaggtagttagacaggcatgagctgggcaggagagggctctcctcaacccaccaggaatgtcaggtgatgattcaacgattagcacattgcttctctacagatgataatttggcagcaggcaccagggagaagcaaaaataacttccaataaaatctcaggtattgggtgaatgagtctagacacgtagattaggagacaaaatggcagagcatgaccttccgggggcagtccaccagaaaagagaagaagacctgagatgtgcctgtgtacaacctcctgaatacactgcgtgtgctcacttcccaagcataaggagggcactccacatgcaggcagcccaccctaagggaagaatcatgggaaagggggacgtgagaagcaggaggtcggccagcctataaagtcctgggatcaaggttaaacaccactcttgacctcgatgcctcgttgggtctcttccaagtgtatttttctttctttcctgttctaaggtctttttaaataaacttccactcctcctctgaaacttgcctttgtctctttttctggctattcccctcagtcgaattctctcttctgaggaggcaagagttgaggttgctgcagacccatatggattcgccaccg

SEQ ID NO: 1508 - DNA, 3138 bp, Homo sapiens; identical to SEQ ID NO: 1507

SEQ ID NO: 1509 - DNA, 1278 bp, Homo sapiens
aagaagtgccttttgcctcccaccattattctgaggcctcctcagccatgtggaactgatgacacatctagaagaccctcaccttatgcttatgctggccccttgatcttggcctccagaaataacccagaacagcaagattttaggaattattggaaaagcattttttgaactgtgtgttcatcttaaaagccaaattctccctcccttcaaaggacagcatgaggtataatgaagaatcttgaggtcctcctggattaccaaagtgggccctaaatccagtggcagaagacacagacacagagaggagaccaggtgaagacaaaagaagaggctggagtgatgcaaccatcagagagtgaaaatactcagttacctcctggtttatgaggcaatgaagtattccagcacataaatattgacgctgagacccatgggatgtaggagtgctgagcacatttgcaagacataaagaccgaagtgtgtgtggtatctagatgagatgcatggtgatgactggagactgggcgtgatgaatgacttaggaaacctctggagggtgcctgctttgtggccataaaccactgtgcccatgtggaaaacactgcagtcctggggcagaagataaacttcatgcttgataaaaaaaaaaaaaacaaccaaaaggtaaggttttcttctggtgtgctgcagtctttagtcttcttctgttttccattcccactggcagttcaaagatgtccttaatccatcatatgcctcttgaatgtgtgctgtgggtttactgtcatgatgaaaaactacttcatgaacttagtgaaggaactcgggattgagtccgagctgcttacatagcttctggggaaaattcacccaaatgtgggggaagcaatccaagaggcacttcaagtatttgttttgaaataaaaatattgacagtggtacatattttttttcccaaaggtgtttgttattccataaatccagataggtgaatttcattagcgaacttcagatcactgatttgatgatactacctctgttatgtctcaaatctgccccggcacctctatcctactgctgctagtataattcagaccctctcccctgaactgttaccttagactcctcatgtctctaatttgttttacctttctcagctagattaatcttcctgaagcacaaatccaatcatgtcaatatttttctcagaaacaaaatagtatccctttgcctggagaataaagtctaatcttagccagttgactcagctccggc

SEQ ID NO: 1510 - DNA, 599 bp, Homo sapiens
tagtatcactgggccagcctgcttctgagggatatttgtagcctggaaacagtgaatttgatctggtggcagtgtggactggagatcaagtctaccatgtaggtctgaagcctgaggctgtggagtccagcttactgccagtgtgtgtggtatctagatgagatgcatggtgatgactggagactgggcgtgatgaatgacttaggaaacctctggagggtgcctgctttgtggccataaaccactgtgcccatgtggaaaacactgcagtcctggggcagaagataaacttcatgcttgataaaaaaaaaaaaaacaaccaaaagaggtgaatcacttcaaagagaaggaccagattctcatggaccccactgccatgctggccagacatcttgctgccattgttttcctgttatttactcccaaacagatggtctataatgaagaattgacttttctttgttctcaagcaaaggacctttggtcaatccactcctggaaattaccttcagctctctttgaaaatggcttcactgtcttcatttataagattttgttgatgtgtcttggagggaagaatgacctatttctcagacaag

SEQ ID NO: 1511 - DNA, 5220 bp, Homo sapiens
cacgtttcccattggccgccgtttccggaagcccgccctcccatttccggaagcctggcgcaaggttggtctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcaggaactgttggaaactactgaaactggccgacctgatcttcaaaatgtgcccctaggaaaggtggatgccaccgtgttcacagacagtagcagcttcctcgagaagggactacgaaaggccggtgcagctgttaccatggagacagatgtgttgtgggctcaggctttaccagcaaacacctcagcacaaaaggctgaattgatcgccctcactcaggctctccgatggggtaaggatattaacgttaacactgacagcaggtacgcctttgctactgtgcatgtacgtggagccatctaccaggagcgtgggctactcacctcagcaggtggctgtaatccactgtaaaggacatcaaaaggaaaacacggctgttgcccgtggtaaccagaaagctgattcagcagctcaagatgcagtgtgactttcagtcacgcctctaaacttgctgcccacagtctcctttccacagccagatctgcctgacaatcccgcatactcaacagaagaagaaaactggcctcagaactcagagccaataaaaatcaggaaggttggtggattcttcctgactctagaatcttcataccccgaactcttgggaaaactttaatcagtcacctacagtctaccacccatttaggaggagcaaagctacctcagctcctccggagccgttttaagatcccccatcttcaaagcctaacagatcaagcagctctccggtgcacaacctgcgcccaggtaaatgccaaaaaaggtcctaaacccagcccaggccaccgtctccaagaaaactcaccaggagaaaagtgggaaattgactttacagaagtaaaaccacaccgggctgggtacaaataccttctagtactggtagacaccttctctggatggactgaagcatttgctaccaaaaacgaaactgtcaatatggtagttaagtttttactcaatgaaatcatccctcgacatgggctgcctgttgccatagggtctgataatggaccggccttcgccttgtctatagtttagtcagtcagtaaggcgttaaacattcaatggaagctccattgtgcctatcgaccccagagctctgggcaagtagaacgcatgaactgcaccctaaaaaacactcttacaaaattaatcttagaaaccggtgtaaattgtgtaagtctccttcctttagccctacttagagtaaggtgcaccccttactgggctgggttcttaccttttgaaatcatgtatgggagggcgctgcctatcttgcctaagctaagagatgcccaattggcaaaaatatcacaaactaatttattacagtacctacagtctccccaacaggtacaagatatcatcctgccacttgttcgaggaacccatcccaatccaattcctgaacagacagggccctgccattcattcccgccaggtgacctgttgtttgttaaaaagttccagagagaaggactccctcctgcttggaagagacctcacaccgtcatcacgatgccaacggctctgaaggtggatggcattcctgcgtggattcatcactcccgcatcaaaaaggccaacggagcccaactagaaacatgggtccccagggctgggtcaggccccttaaaactgcacctaagttgggtgaagccattagattaattctttttcttaattttgtaaaacaatgcatagcttctgtcaaacttatgtatcttaagactcaatataacccccttgttataactgaggaatcaatgatttgattccccaaaaacacaagtggggaatgtagtgtccaacctggtttttactaaccctgtttttagactctccctttcctttaatcactcagccttgtttccacctgaattgactctcccttagctaagagcgccagatggactccatcttggctctttcactggcagccgcttcctcaaggacttaacttgtgcaagctgactcccagcacatccaagaatgcaattaactgataagatactgtggcaagctatatccgcagttcccaggaattcgtccaattgattacacccaaaagccccgcgtctatcaccttgtaataatcttaaagcccctgcacctggaactattaacgttcctgtaaccatttatccttttaacttttttgcctactttatttctgtaaaattgttttaactagaccccccctctcctttctaaaccaaagtataaaagcaaatctagccccttcttcaggccgagagaatttcgagcgttagccgtctcttggccaccagctaaataaacggattcttcatgtgtctcaaagtgtggcgttttctctaactcgctcaggtacgaccgtggtagtattttccccaacgtcttatttttagggcacgtatgtagagtaacttttatgaaagaaaccagttaaggaggttttgggatttcctttatcaactgtaatactggttttgattatttatttatttatttattttttttttttgagaaggagtttcactcttgttgcccaggctggagtgcaatggtgcgatcttggctcactgcaacttccgcctcccaggttcaagcgattctcctgcctcagcctcgagagtagttgggattataggcatgcgccaccacacccagctaattttgtatttttagtaaagatggggtttcttcatgttggtcaagctggtctggaactccccgcctcgggtgatctgcccgcctcggcctccgaaagtgctgggattacaggtgtgatccaccacacccagccgatttatatgtatataaatcacattcctctaaccaaaatgtagtgtttccttccatcttgaatataggctgtagaccccgtgggtatgggacattgttaacagtgagaccacagcagtttttatgtcatctgacagcatctccaaatagccttcatggttgtcactgcttcccaagacaattccaaataacacttcccagtgatgacttgctacttgctattgttacttaatgtgttaaggtggctgttacagacactattagtatgtcaggaattacaccaaaatttagtggctcaaacaatcattttattatgtttgtggattctcatggtcaggtcaggatttcagacagggcacaagggtagcccacttgtctctgtctatgatgtctggcctcagcacaggagactcaacagctggggtctgggaccatttggaggcttgttccctcacatctgatacctggcttgggatgttggaagagggggtgagctgagactgagtgcctatatgtagtgtttccatatggccttgacttccttacagcctggcagcctcagggtagtcagaattcttaggaggcacagggctccagggcagatgctgaggggtcttttatgaggtagcacagcaaatccacccaggataggggagacaggacatcgattctgcctcccaaagggaggagtggcaagaaatgttcagctattttttaaaactatcacagcaatattaatatgtcagaaaaaattaaagcatcctgatagctgcatttctaagtaattggtctcctttgaaattctatgaattgtgtttttttatagtttatggcattattctgaggaggggtcaaagactctcccatatgttagaagggtcctgcacagaacaggctcacccccgcccacgtcccccagtgtttgaaatgcatagtgtttgctctggtttattggttagggcaggactttctcatttgttttagatctaacagcagtttagaaattggcctgtaacttttttttggcctgatttccttctgtttgtgccgatattctcacctcagtaggaatcaggagcttcttttgctgttcttctgttttggatgcattggaagagcaaatagccaccagagaggataccgtaagggatgtggaaaatgagttcttttgcgcttatccagtgaggttgattttcagtcaatgagcattcagtatatgcctgggactctggctttattttttagctttgtgatgccaaacccatcaatgaacttctctgtatatttgattcatcatgaaatggtgacactgagggtggctgatttccaggtttacatcagttgccccaggggaagtgcctggcccttgtctggttgttgctgctctaactttgccctgttaattgaagaaatgcggctgtaaacacttcctggggtgttgctggtattttctgtcctcacagtttacagagaaacccatattttcagcctcttcctctgctttctgtcttttctgaaccatctcacccgacctggtgtaatcttcattgtgtgtgagtttgcacagatgtaacatctcctcaaagcctagtgcccacctcccacctccacgaaaatctggagctcaggaaccaccactctccccaacccattgcaggcttgaacatttgatggtggaaaccctgccctgagtttgtattatggtgggttctcttgggtcttgttctctgtgggtctgtcctgcgctatagtgtgtggagccggggggattttcactgtgttcctaaaggaagggcacaaggagttgttgggcaaatggtctgatatttccttttttttttttttgaaacag

SEQ ID NO: 1512 - DNA, 5220 bp, Homo sapiens; identical to SEQ ID NO: 1511

SEQ ID NO: 1513 - DNA, 5220 bp, Homo sapiens; identical to SEQ ID NO: 1511

SEQ ID NO: 1514 - DNA, 5220 bp, Homo sapiens; identical to SEQ ID NO: 1511

SEQ ID NO: 1515 - DNA, 5220 bp, Homo sapiens; identical to SEQ ID NO: 1511

SEQ ID NO: 1516 - DNA, 5220 bp, Homo sapiens; identical to SEQ ID NO: 1511

SEQ ID NO: 1517 - DNA, 5165 bp, Homo sapiens
cacgtttcccattggccgccgtttccggaagcccgccctcccatttccggaagcctggcgcaaggttggtctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcaggaaaggtggatgccaccgtgttcacagacagtagcagcttcctcgagaagggactacgaaaggccggtgcagctgttaccatggagacagatgtgttgtgggctcaggctttaccagcaaacacctcagcacaaaaggctgaattgatcgccctcactcaggctctccgatggggtaaggatattaacgttaacactgacagcaggtacgcctttgctactgtgcatgtacgtggagccatctaccaggagcgtgggctactcacctcagcaggtggctgtaatccactgtaaaggacatcaaaaggaaaacacggctgttgcccgtggtaaccagaaagctgattcagcagctcaagatgcagtgtgactttcagtcacgcctctaaacttgctgcccacagtctcctttccacagccagatctgcctgacaatcccgcatactcaacagaagaagaaaactggcctcagaactcagagccaataaaaatcaggaaggttggtggattcttcctgactctagaatcttcataccccgaactcttgggaaaactttaatcagtcacctacagtctaccacccatttaggaggagcaaagctacctcagctcctccggagccgttttaagatcccccatcttcaaagcctaacagatcaagcagctctccggtgcacaacctgcgcccaggtaaatgccaaaaaaggtcctaaacccagcccaggccaccgtctccaagaaaactcaccaggagaaaagtgggaaattgactttacagaagtaaaaccacaccgggctgggtacaaataccttctagtactggtagacaccttctctggatggactgaagcatttgctaccaaaaacgaaactgtcaatatggtagttaagtttttactcaatgaaatcatccctcgacatgggctgcctgttgccatagggtctgataatggaccggccttcgccttgtctatagtttagtcagtcagtaaggcgttaaacattcaatggaagctccattgtgcctatcgaccccagagctctgggcaagtagaacgcatgaactgcaccctaaaaaacactcttacaaaattaatcttagaaaccggtgtaaattgtgtaagtctccttcctttagccctacttagagtaaggtgcaccccttactgggctgggttcttaccttttgaaatcatgtatgggagggcgctgcctatcttgcctaagctaagagatgcccaattggcaaaaatatcacaaactaatttattacagtacctacagtctccccaacaggtacaagatatcatcctgccacttgttcgaggaacccatcccaatccaattcctgaacagacagggccctgccattcattcccgccaggtgacctgttgtttgttaaaaagttccagagagaaggactccctcctgcttggaagagacctcacaccgtcatcacgatgccaacggctctgaaggtggatggcattcctgcgtggattcatcactcccgcatcaaaaaggccaacggagcccaactagaaacatgggtccccagggctgggtcaggccccttaaaactgcacctaagttgggtgaagccattagattaattctttttcttaattttgtaaaacaatgcatagcttctgtcaaacttatgtatcttaagactcaatataacccccttgttataactgaggaatcaatgatttgattccccaaaaacacaagtggggaatgtagtgtccaacctggtttttactaaccctgtttttagactctccctttcctttaatcactcagccttgtttccacctgaattgactctcccttagctaagagcgccagatggactccatcttggctctttcactggcagccgcttcctcaaggacttaacttgtgcaagctgactcccagcacatccaagaatgcaattaactgataagatactgtggcaagctatatccgcagttcccaggaattcgtccaattgattacacccaaaagccccgcgtctatcaccttgtaataatcttaaagcccctgcacctggaactattaacgttcctgtaaccatttatccttttaacttttttgcctactttatttctgtaaaattgttttaactagaccccccctctcctttctaaaccaaagtataaaagcaaatctagccccttcttcaggccgagagaatttcgagcgttagccgtctcttggccaccagctaaataaacggattcttcatgtgtctcaaagtgtggcgttttctctaactcgctcaggtacgaccgtggtagtattttccccaacgtcttatttttagggcacgtatgtagagtaacttttatgaaagaaaccagttaaggaggttttgggatttcctttatcaactgtaatactggttttgattatttatttatttatttattttttttttttgagaaggagtttcactcttgttgcccaggctggagtgcaatggtgcgatcttggctcactgcaacttccgcctcccaggttcaagcgattctcctgcctcagcctcgagagtagttgggattataggcatgcgccaccacacccagctaattttgtatttttagtaaagatggggtttcttcatgttggtcaagctggtctggaactccccgcctcgggtgatctgcccgcctcggcctccgaaagtgctgggattacaggtgtgatccaccacacccagccgatttatatgtatataaatcacattcctctaaccaaaatgtagtgtttccttccatcttgaatataggctgtagaccccgtgggtatgggacattgttaacagtgagaccacagcagtttttatgtcatctgacagcatctccaaatagccttcatggttgtcactgcttcccaagacaattccaaataacacttcccagtgatgacttgctacttgctattgttacttaatgtgttaaggtggctgttacagacactattagtatgtcaggaattacaccaaaatttagtggctcaaacaatcattttattatgtttgtggattctcatggtcaggtcaggatttcagacagggcacaagggtagcccacttgtctctgtctatgatgtctggcctcagcacaggagactcaacagctggggtctgggaccatttggaggcttgttccctcacatctgatacctggcttgggatgttggaagagggggtgagctgagactgagtgcctatatgtagtgtttccatatggccttgacttccttacagcctggcagcctcagggtagtcagaattcttaggaggcacagggctccagggcagatgctgaggggtcttttatgaggtagcacagcaaatccacccaggataggggagacaggacatcgattctgcctcccaaagggaggagtggcaagaaatgttcagctattttttaaaactatcacagcaatattaatatgtcagaaaaaattaaagcatcctgatagctgcatttctaagtaattggtctcctttgaaattctatgaattgtgtttttttatagtttatggcattattctgaggaggggtcaaagactctcccatatgttagaagggtcctgcacagaacaggctcacccccgcccacgtcccccagtgtttgaaatgcatagtgtttgctctggtttattggttagggcaggactttctcatttgttttagatctaacagcagtttagaaattggcctgtaacttttttttggcctgatttccttctgtttgtgccgatattctcacctcagtaggaatcaggagcttcttttgctgttcttctgttttggatgcattggaagagcaaatagccaccagagaggataccgtaagggatgtggaaaatgagttcttttgcgcttatccagtgaggttgattttcagtcaatgagcattcagtatatgcctgggactctggctttattttttagctttgtgatgccaaacccatcaatgaacttctctgtatatttgattcatcatgaaatggtgacactgagggtggctgatttccaggtttacatcagttgccccaggggaagtgcctggcccttgtctggttgttgctgctctaactttgccctgttaattgaagaaatgcggctgtaaacacttcctggggtgttgctggtattttctgtcctcacagtttacagagaaacccatattttcagcctcttcctctgctttctgtcttttctgaaccatctcacccgacctggtgtaatcttcattgtgtgtgagtttgcacagatgtaacatctcctcaaagcctagtgcccacctcccacctccacgaaaatctggagctcaggaaccaccactctccccaacccattgcaggcttgaacatttgatggtggaaaccctgccctgagtttgtattatggtgggttctcttgggtcttgttctctgtgggtctgtcctgcgctatagtgtgtggagccggggggattttcactgtgttcctaaaggaagggcacaaggagttgttgggcaaatggtctgatatttccttttttttttttttgaaacag

SEQ ID NO: 1518 - DNA, 553 bp, Homo sapiens
ccaggctaatttttgtatttttagtagagacagggtttcaccatgttggccaggctggtctccaactcctggcctcaagtcatcctcccgccttagcctcccaaagtgctggaattacaggcatgagccaccacgcccggccatcttcttgccagcaactcttagaccaggaagcctcggatggcagctatgaagtcctgtgggcggtcagcgtggatccagtggccagcgttcggcaccgtctgcatctgggcccgagggaagagccgcataatctcagggtggtggctgggactgtgcatcgcagcgacggccatcaaaaacgggtgaaagtgggatgaggaggagtgaaagagacacgtggaagcagaacggggagaaatggagagagctgtgtgagcccatatgcccggtggtatttctggcctctcagccaccccccttccacacccaaggcctcccctggtagggtccccaggctggggcctgggcgagtaaagcatgcccctcctactacccaggctagcttactgcacgaactgggagtttccac

SEQ ID NO: 1519 - DNA, 553 bp, Homo sapiens; identical to SEQ ID NO: 1518

SEQ ID NO: 1520 - DNA, 553 bp, Homo sapiens; identical to SEQ ID NO: 1518

SEQ ID NO: 1521 - DNA, 553 bp, Homo sapiens; identical to SEQ ID NO: 1518

SEQ ID NO: 1522 - DNA, 553 bp, Homo sapiens; identical to SEQ ID NO: 1518

SEQ ID NO: 1523 - DNA, 3759 bp, Homo sapiens
cacgtttcccattggccgccgtttccggaagcccgccctcccatttccggaagcctggcgcaaggttggtctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcagttccagagagaaggactccctcctgcttggaagagacctcacaccgtcatcacgatgccaacggctctgaaggtggatggcattcctgcgtggattcatcactcccgcatcaaaaaggccaacggagcccaactagaaacatgggtccccagggctgggtcaggccccttaaaactgcacctaagttgggtgaagccattagattaattctttttcttaattttgtaaaacaatgcatagcttctgtcaaacttatgtatcttaagactcaatataacccccttgttataactgaggaatcaatgatttgattccccaaaaacacaagtggggaatgtagtgtccaacctggtttttactaaccctgtttttagactctccctttcctttaatcactcagccttgtttccacctgaattgactctcccttagctaagagcgccagatggactccatcttggctctttcactggcagccgcttcctcaaggacttaacttgtgcaagctgactcccagcacatccaagaatgcaattaactgataagatactgtggcaagctatatccgcagttcccaggaattcgtccaattgattacacccaaaagccccgcgtctatcaccttgtaataatcttaaagcccctgcacctggaactattaacgttcctgtaaccatttatccttttaacttttttgcctactttatttctgtaaaattgttttaactagaccccccctctcctttctaaaccaaagtataaaagcaaatctagccccttcttcaggccgagagaatttcgagcgttagccgtctcttggccaccagctaaataaacggattcttcatgtgtctcaaagtgtggcgttttctctaactcgctcaggtacgaccgtggtagtattttccccaacgtcttatttttagggcacgtatgtagagtaacttttatgaaagaaaccagttaaggaggttttgggatttcctttatcaactgtaatactggttttgattatttatttatttatttattttttttttttgagaaggagtttcactcttgttgcccaggctggagtgcaatggtgcgatcttggctcactgcaacttccgcctcccaggttcaagcgattctcctgcctcagcctcgagagtagttgggattataggcatgcgccaccacacccagctaattttgtatttttagtaaagatggggtttcttcatgttggtcaagctggtctggaactccccgcctcgggtgatctgcccgcctcggcctccgaaagtgctgggattacaggtgtgatccaccacacccagccgatttatatgtatataaatcacattcctctaaccaaaatgtagtgtttccttccatcttgaatataggctgtagaccccgtgggtatgggacattgttaacagtgagaccacagcagtttttatgtcatctgacagcatctccaaatagccttcatggttgtcactgcttcccaagacaattccaaataacacttcccagtgatgacttgctacttgctattgttacttaatgtgttaaggtggctgttacagacactattagtatgtcaggaattacaccaaaatttagtggctcaaacaatcattttattatgtttgtggattctcatggtcaggtcaggatttcagacagggcacaagggtagcccacttgtctctgtctatgatgtctggcctcagcacaggagactcaacagctggggtctgggaccatttggaggcttgttccctcacatctgatacctggcttgggatgttggaagagggggtgagctgagactgagtgcctatatgtagtgtttccatatggccttgacttccttacagcctggcagcctcagggtagtcagaattcttaggaggcacagggctccagggcagatgctgaggggtcttttatgaggtagcacagcaaatccacccaggataggggagacaggacatcgattctgcctcccaaagggaggagtggcaagaaatgttcagctattttttaaaactatcacagcaatattaatatgtcagaaaaaattaaagcatcctgatagctgcatttctaagtaattggtctcctttgaaattctatgaattgtgtttttttatagtttatggcattattctgaggaggggtcaaagactctcccatatgttagaagggtcctgcacagaacaggctcacccccgcccacgtcccccagtgtttgaaatgcatagtgtttgctctggtttattggttagggcaggactttctcatttgttttagatctaacagcagtttagaaattggcctgtaacttttttttggcctgatttccttctgtttgtgccgatattctcacctcagtaggaatcaggagcttcttttgctgttcttctgttttggatgcattggaagagcaaatagccaccagagaggataccgtaagggatgtggaaaatgagttcttttgcgcttatccagtgaggttgattttcagtcaatgagcattcagtatatgcctgggactctggctttattttttagctttgtgatgccaaacccatcaatgaacttctctgtatatttgattcatcatgaaatggtgacactgagggtggctgatttccaggtttacatcagttgccccaggggaagtgcctggcccttgtctggttgttgctgctctaactttgccctgttaattgaagaaatgcggctgtaaacacttcctggggtgttgctggtattttctgtcctcacagtttacagagaaacccatattttcagcctcttcctctgctttctgtcttttctgaaccatctcacccgacctggtgtaatcttcattgtgtgtgagtttgcacagatgtaacatctcctcaaagcctagtgcccacctcccacctccacgaaaatctggagctcaggaaccaccactctccccaacccattgcaggcttgaacatttgatggtggaaaccctgccctgagtttgtattatggtgggttctcttgggtcttgttctctgtgggtctgtcctgcgctatagtgtgtggagccggggggattttcactgtgttcctaaaggaagggcacaaggagttgttgggcaaatggtctgatatttccttttttttttttttgaaacag

SEQ ID NO: 1524 - DNA, 3759 bp, Homo sapiens; identical to SEQ ID NO: 1523

SEQ ID NO: 1525 - DNA, 3759 bp, Homo sapiens; identical to SEQ ID NO: 1523

SEQ ID NO: 1526 - DNA, 3759 bp, Homo sapiens; identical to SEQ ID NO: 1523

SEQ ID NO: 1527 - DNA, 3759 bp, Homo sapiens; identical to SEQ ID NO: 1523

SEQ ID NO: 1528 - DNA, 3759 bp, Homo sapiens; identical to SEQ ID NO: 1523

SEQ ID NO: 1529 - DNA, 3230 bp, Homo sapiens
cgcgaacacgcagcagcgagaatctacaggggcgtggtttgcgcacgcgggaactgggatctcaaccccagggctaggtgcctcctcccgctgctttccgccagctgcggggtgtgagattaatccccgccgattagcgccaggtgtactaagcgctggatggttccctgaccagatgaaacatcagccgatgttctaatgccggtcccctgggcgctgtccccgagagggaaaacctgttttctgaccccggctctagtcggcctctggaggtctgcagctgggttattttacctttgaaacggacgacacctgccccgtgcaccccagcggctcctccacacggagagatggtgtcagtcaaaggccgtctagatgacgagtttatgaaattgttcctggcccgtgccgggcacgaccttgcagagagcccagaagatgaaaccccagccctgccaggagctcacctgctaattaggaggacaacgaatcacctcacctccctagactttgcttctcctttattcagtgagggattggactagctggtccttgaggacttttcagaaagtctggttctgggagatgaccaatgggatcatcttatgctatgagctttcctggaatgacaggtaatggagagtgaggagattttacctgatatggtcctgtttgcaccatcagccagcaacctttctgggaagcgtgcttattatgtaccaacataaaagcttgaatataagaacagaacacaagaacggggctgaagctctaacagaaaagacataagacccttgagaaagcattacttgaacacaaggtttctgggacattaaacatgggtataagtgctgctatagtacctttctggggaagacttcctcctgtctcggggacttaggcatcatcaaaggcagggtgggatgaagaaagtaaggtgaatgctctggtagactgagaagtctaggatatacagggggacttcaggtgtcaaaacaagaggagaaggcttcagaagcacacaatgtcagggtcagaattgaagccaggttgcagcccaaaggggacagacagccctgccagttactcgtgcttcagaggtggcacggctgctctcggagaagcaactgactatttcagttttccctgactacagctataaggacgctccctacctgccaccctccatatcatcccccgcccgcacctagacacccgaatcaaggcaatgaaattgtcttgtgggacatctatgtgcccagcaaagctcagcacattatgtgcatttttattcaataatgacaacgatgttcaagatcagcgctgttactctcatgacacagatgaagaaaggcctagagatgaagtcacgtgcccaagtctgcagggtcctgactcatagagctggtatggaaactgatctggctggttctggagcccctgcttttccatttcaccactgactaggaggagagagaggaccctgaaatatcgtttagttcaatacttgactctctagacaaagaactgggaatgacacatatgggaaataaggaattctccatctgcagaggtctgctaggcattttctctgaggagtcaatcattcaccgttctctcaaaagcagcttatgcaaaatatgatctcttagcagccacagtattcaataccctgattaggttcaaatcagaaggcaaacacctcaaggacaagagtttgcaacaaaaaaggcaacaacagcaccctggacactcatgtcaggacattccaatgtgcatacgcctccttaagcacagagggatgctgaagatgatctaccaaagcaaacattctttctgttttgtctccacatcaaaggaaggaaattgttacatggaaaacaggaacaagtaatttataacctatttctgcttggtcctagaatggactgactatcctcacaccctatcacaagcactgttcacccctctcttccttcttagagaagttaaaaactgtgcttcagtgagctcccatcccactcaaagtaaaaccctcaatcttgactgtgcctagaagacccaagaggattctggccccactactcttctctcatctcatctcctgctcttccttctgctccctccatgatcatcatactggcttcttgatccttgaacatgccaaggactcttcccttagagagccatagagctccctttctcccttccttcaaggtgtcaaagaaaatactgtttcagcaccctccaagtttattacacccagaaggatattaagacccaagactgagtcgcaccaccggtttccaattctgcttctcagattaaaggagaactctcttccccattgttcctcttctgtgaatgagtaggagagaccagagaccaggccttgcccactaccgaacccagatctttgttataggttaactgactcctttattgtcgtgtaccttgctaagaccagatgacacccgagatgccaagactgttaaatcttcagtgaggaatgttaaatctacctttccacaaagaaaaagaccacctggactaattagatcatttaaatgatgcattaaaccttacacagaaagatgttgaaattctgctaggctttcccaagcttcctctgtataaaggatcccaaacttcactttggaatacagacttccattctgtggaatctgggcttcccacacaggcctgtcctcaacgtttgtgcctaaatcaactctatttaaggtaaattctgaccttcttgcgtcctttagtttaacaggggtctctggtgaagtgcctccttattggagaggacatttctgtcacctcaccctcatacactgctcagcccctccccttgctttattttctccatggtgcttccctgacatgtatgcccttgttgagggcttgcttcctctccttgactagaatgtaagttgcatgaagccagggacatcagcttaattcagtgcagcatccccagggcttagagaatcacctggcacacaggaggttttcaataattaagaaacaaatttgtgtaaacagcaagggtgggagttggcagaagtgcattctgtataaaacacaggtatttgtgtttggctgttggtgctaaggaaggctgtgaaaggtgagttcaagtttgcttctgatatacattggaaatatcaactcctctttctccgtagccacaactcccactccctacctcttttctttctcag

SEQ ID NO: 1530 - DNA, 16275 bp, Homo sapiens
ctgaaactcttaacactcaaaagcaaattctaaaaaccaaaagcaccctaacagaaatgaggaatggcttacttagtagacagaacatgacaaagcaaagaaccaatgaacttgaagatacagaaacttaccaaacaaaaagataaagaggaaaaagaaagaacatccaagaactgtgagaaagtttcaaaagatgtaatgtgtaattggaataccagatggagaagaaaaagaaaacagtggaagaaatacttgaagtattaatggctatgaattttccaaaattaatgacagataccaaaccacagatccagaaagctcagagaacaccaagcataataaataccaaatctacacccaggcatatcatatttaaactgcaaaaaaccaaagagaagagaaaatcttgaaagaagctagagagggggaaaagccaacaccttatccatagaggaaaaaggataagaattacattatctttctcttcagaaaccatgcaaacacaaagaaaggagaatacatgaagtgttgcaacaaaaaagctaccaaactattattctgcattcagcaaaattatccttcaaattcaaagaaataaggatattttctgacaaacaaaactggaataattcattgccagctgacctgccctatgagaaatgtcaaaaagaactgcataaaaaaggaagagcattagaaaagtactatattaaggtaaaattaagttttatttttcttaactgatctgaaagataactgtttacaataatagtaacaaagtattgagtgattatagcatgtggataaatgaaataaaaggcagtaatgatataaacaggaaggaagaagtggtagttatttgatgctagatgtagattagttatacatgtacttttcaaactttagggcagtaactaaaaacatttttaaaaagaatgattaatatgctaacagaggagataaaatggaatcatataaaatgttcagttaaacctataaaaggtagaaaaagaggtgtggggggaagaatcaggtgcaacaaatataaaagttataaatatgattgatactactgcagttatattaatacttaggttaaatatgaatactctaaatgcaccaatttaaagacagagattggcagtgtggattaaagacaagacccaactacatattgtctacaagggacctattttaaataaaaatatttatacagattacaagtaaagggatggaaaaaggtacaccatgctaacactgattgaaagaaagccagagcagcgatgttaattttatacaaagctgacttcagaggaaggacaattttcagggataaagaagggaattacatgatgataatgtgggtgaattctctaagaagacagcatctttaatatatgtccacctaaaaactgagtgtcaaaaaacatgaggcaaaaactgatagaactacacggagaaataggtaaatacgctattacaattggagacttcaacaaccctctttcagtaattgatacatcaagcaggcagaaaattaagacacagttgacctaaacggcactaccagtcaacttgatctaattaacatttatggaatactctaacaacagcagaatacacattcttcagctcacatggaagattcaccaagataagccatattctgggccacaaaacacactttaagatccttaaaagtatagaaagcatacaaagtattttctcagaccacatggatttaaattaaaaagccaataatagataactggaaaatctccaaatatttggagattaaacaacatacttctacattagacatgagtcaaataaaaagtctcaagagaaattaaaaaatgttttgaactaaatgaaaatacaacttattacaatttttggatgcagatagaacagtacttagagggaaatttatagcattgaatacatatattagaaaagaaagatccagaatcagtcactgaagcttccacctcaggagactggagaaaatagcaatacagacctcaagcaagcagaagagaagaaataataaaaattagactaggaaccagtgaaattaagtacaggaaaataatagacaaaatcaatagaacaaaatatcttgttctttgaaaagttcaaaacatccctctttgtcctcgtgctccccacaggcgctgggagaagatggatagagacccctcccggccctcctctgactgtccactctagggtcttttaaacacccaccctcagaagctgggtttccaacagcaccccttgagcggtggcacccttcatcctgggcttggagaaggttatagttagaaagccccttccttgattgtgtggctgacatctttaaaacgccaggtctttcagtcatctctcagagctatttaaaaataaaagtcacatagaccacagggttctaccatctatttttgaaaaaggcaaatcagcttggtgaacatataaaccctaggggcagccctggttatttccctggaggaattttttccctccttcatcctggaggaaggtagggacgttcccagggttccctccagattcacctcagtcatggggagctggtgtaatgccctcttggagacctcagaacacacaacaggatgtgactcaggactcagagatgtgagtcagtttccagggtgatgtgttagggcgagccccagtggtggtttgcatctcactgtctgggacccctgggaagaaaggcctaggctccccttgcagacaaagggggtgaccccagatgcttcccagcatcacatctgtcagaggtgtgtgatgtcaggggcctttcagagtccctgggggtgggtgactctgctctgaaagggacatttccctgaaagttccactgtctttgagaagcagtgtttcctctggcctctgcagcagggagcaaagctccggcacagcacaagtaagaagagcagtcacctattcctactacaggtacccccaggtagcagacaccggctcagcacactgttgctatatcattgaaatcccatgataacatgagtcagtcagcaccagctctggatcctggaaaaaagggaggttgtgaaacagctccaggatttgccaaccgttcgtctctggccggctgcagacatcttggttagtcatgtgtagctcagatgcattcgttgttccagcaattactttgaagagaagcagacagaccaagccggggcagaaccctgcctgggtatgctgttttaaaggcctcaggttttgagggatcccatcctcactgccgacctgccagcctgggaggtggcaggctgcctgcgggaaggaagaagggagccctgtgtccgcctctccaccactccctgcttccgggacccgtattcatcacctcgccggggaagctttgtggctttgtggtcagggccctgtgaatcaagaatgctggttcctcacatcaggccgcccccaaccctgctggttcaccctggagtccttttcttttcaaacctctgtttcctcacctctaaaaatgggggtaaccaggctcacttgcctcacaggtgtgagagttaattaatgtttgtggggcagctttgagatccacagatgaaaggtgctctataaacgcaaaatgcaattcctcattagcactgtcagacggttcccaggggaaacagttcaccctgcaccacgaggctgctaccctcagccagatgagtctgagacacgtctgggaaagggctacgtatttaggcagagtgcttttggagggagggttcaaggataggtcactagcttccagaaaagatgggtgtttttagaacatgtctcattctcagttggcatcgtgtccctgaggcagagggagagtggccttcagtgcacacagctggagggaccatagttcagagggaacagaaggcaccttctggtttctgctgcctcctcccttgcagacagattctttctctgtactttgttaaataaacatttgttgcagacatcttttccataaggatcttctgcactgtgcactttctgcacctctgccccccgtatacaactttccaggcctgaaggagctctacagacaggttgggtacattcctgcaacaccagcacatcatggatgtttagattcttctatggccaccctatttatttccttccactcctccatgtccttcttctccaggagggtaaagacaactttctgctcccttctactcctctggcacctttgccccgcttagttccttgaaaaacatgagccagaaatattgtgttgagggctgggatatctcaagcagcctccatcctgagactggacccttggtggagaatgaggatactcactccagtaaaacaaatcactgacacctcaagtgggagctgggaagcttcaagcagaagaggcacagcatctcccaggactgcacacagctaaagaaacagaattttctgaagaacactccattgaggtggcacctgatatcaagaggattgtgcacgcttgatagtctatgcttggaaggcctgggttgggagactgtcatctccaacctgcagtccaggctgggcatggaaggccgtgctttacagccaatctccactgtgctgatgaggggccggtgggatttcctagagaggcacctgtgatatctctggctaaacagatacagttaagagctgtcgctggggcagatcatgttaagtaacatggctgagatttgccagggtccatgtaatgccttagggtgtcagcacgcaagaaaaaaaaagaagtgactttacgtctgggactgcagaggctacaaaatgatgaaccccctaacctatgagttgtcgatattggagaatacgatgcttttgagcccagctcagatggagatctgttccacacaggtgtgtgtcatgccagtttgcagcctgggcttcctctggtgactaccccatccatctctgccactgccccagctctctgtgcccaagtgctgtccctgagccagacctctggtgggagaggccgagggggcatggagcagtgatctcaaaagccttcctctctacacaaacccaaccacgggtttctcagtgggcattctcctagctgcagccttagtttttactttggcacttttttgatgttgtaaaatgttagaactgtttgaaaaattctagagtggcttgaagcccagcaagcagtctctgttgtcttctgcttccatatgacatgggccctaaggcaggcttattggattttatgccagggattctggttttaagcagcaaactctgaggcatggcattctaataaaatcagaagaaaaactcatatgaatgggggaaaaggagaattcaaaacaataaacatgaaatatggcttaacataaagatgcttttgtttgttctggccccaaacattttcaggatttgggaacctcatcccagagctgtctctctaaaagccaaaagggcttcagtaaggatacaataagggcatagttctgcagtctgagaggtaaggacagagaccctagcttggcccctcactcacagtgtgctgaagcaagtaacttaatgccttggagactcagtttccccccataaggagatgttattgcatctgtcccttagattcctgggagggtgaaatgtgcccctctgcccgatattgtcaatgcagtagctggcaccttgaaggcaggaaacagtcttctctcccctgcccttccaggaaaggataacagtgtctggagagtactgttggcttagctggttgttgctccaggtaacagaagagggagaggcttggtctcacaaagccaccagaaatgagaccttccttaggcagccagagttccaaggtgcactattccagcggggtagcatgcaccgctaggatgcaacataagcccttcctcctgcagagcagcagcctcctccttcacaaggagcaccatagccaccctgcagaacacagctgcgtcagggcctcacagcagtgttgcaccgtgccagccacaacacagattctgaaagctgcattttacaaatcgaggattcactgctctttgtcttgtgaagtgtgacccacaatgaatggcaaccgttctttctttaagagcttccattccatgctcccaatttgaaggatatcctgacaaagggaagtagaattccccaagtggaagtgcctcgtccccttcaataaacgcgagtgaaatcaaagggctgcttctgtgctctcttcctctgtttttctcatgcagtcctcccatctgactaccttgtcacagctcttcttttcctacctgcatcctcttcaccttgttttcctttcccacacatcaggccaaggcttctagaattccttgcagcaagagctggaggacagaacctcagggaactgccctgtgggaatgcttcatgtcgtcttctacacgccctctgacctggccgctgcacacaggtctttcactctatgtgattccctggctgccccttcacctccaagagctctgaacggctttacaactaggaagtctctgaatgtgcagaacaatgagtttctctttcagcagggccttgccaccccagttgtttttattcccccctctgatatgctagagataatgatagatccaggaagtatattttcttcacactaggaggggccttgccccacaactggagacatgccattcctgtctttactgtctgttctgatgggagctcctgagagatggcaggacaggcagccttcattcctaaacacagtgtcctgcagacccacccgctccagcttatttttcacagacatatttctggaggagtagtgtttattatacctctgaaactcaaggcttctccatgcacagaaatagcctccaagaaacagccctctatacccccgagaaatgcccccaagaaacctccatgcccctgagaaatagctctcttgcacctctctattttttgaaatttcttaaatatttgccaccaagcaacagagtgaataagaggctaaaatgttccctcatttggtgacaagttcctatgcaagttttgaattatttggaataattggatttctttggcttgtgagccaaggggaatcactatcactttcttctatggtatcagaaaactccctctttcttctaagttcccctgctgcagtcttctcccccaccttcatgtgagagctacacaaggggaatttgttcacttaagtttgcagccattttgcacaccccaaagagttgaccttgatgtgaactaattgggattgcagtgggttaataacacaggttggtgaggtggaatttgcagcataaaggaaacacttgaagataagagccatttgtgctttcataagctcatccctggtgctctgaacaaaggacacaaactaataaagtcagattcatctaggggcaatctacactcgctcaccccaaactctgattcagaaaggcaaatggaaatctgccagaattcttttaaactccaacacagatctcgatttaaaaaatgacacacacaaaaccgcttggtaataagcagacctctgatgatctacagatccacagcttcgtttattgacttagagaaagtaaatggcatttcaaatacaaccttcatacttcaatagatgaggtcaccctgagaaagatgatactcagcccagcagtgggaaacctccctccagagaactgctttgatttacaaggccaaggaaggctttctcatagaagccatatacttgggctaaaatggagtaattttttttaaaaaaattaaatgtagaggttgagatagcagacaactatgaaactcttgctcaacaagagggatgacctatggaagacaggaatgctaggacctacagaactgaagggtcaaaattgacttactaccaagtttagatagctaagtaactcacatttttttcaggcattgagatcctgtgtatattgactagaagatccttgtgaatttcccaattactcttaaatagcgatcatcaaacgggtgatttctcctccaggggatttctggcaatgtctggagacatttttggttgccacaactgaggaagggggagtgctactgtcatctagtacgtggaggccaggaatgctgctcaacatcctacaatgcacaggatggcccctacaacagagaatgatcctgcccacaagatcaagcgtgccctaaagtgtcaaagaaaaccttgctcagggaaagcacacactgccacaatggtttcagctaccatgatgacaagacggaagatgtgacttctagaggtgctcttcaggatcggggaaagctaacacagcattgtcccctgggcacagtacaaatgaactgaggggtatgaggagatgaggtgtgtggtgagcactttctggagcccttgtgagaatcctgggtggctgcagtcatgatgcacccagggggaaactccatccccatgtaaggtttaaggcgactgctctctcagtctcatggcctggcacccagacttagagctggcatgttgagccctgggtgagctgcaggtgtgaactaccaacaagactgctcctgagctgaccgtcggctttgccatctgggagggtacaggctagcacttgcctctcctgggcttcctgggcatgagtcacatgtaactagataatgacgcaaatcaccgtcaacattacttaaggtttcattctaatgtcttatggaatgatagagcagaaagcaacctccgagacagcagagacaaccatgccagccccatctcagagaaagctgcagtgcggaatggtgaagggactccccctattctccacagcagatagcaacagagcagggacagaccttctggctctttgtagactactgctttaactacatgatagttagaaactataaccctcccatcaatctagttaccatgtactgacagaacaaaaagacctagctaaacctcaaaaaaaaagaagtcactggaaagcacattgtccagatggttctggtggggaacacctttgcctgcttatagctctgtgagatcctgagcttggtgagatggactgggaagtcctaacttcatttatgtcttctctccaccctgaaacgatgccaaaatgaccccaaatctcaaataaaagttggtgtctgttgctgtaaatgtacaaataacccaaagtcaaaattagggatggaagttaccattccttttgccttctgtgttttgaggtggtcgtggggaggaggaaggctttcagggacaagcagacggcgacagggatcacactgtcacctgtgtgcgccttttcttctaatggccttaaactgccaagtggctgcaactgcagcgtgctgattttaaatgcttttatggaaagcaccatccccttttcgactagcatcacttaaaataatgagttagatgcacttgtattattctgtctttcaagtggattaaattcacaggctcgctctcctccagtctcgcaagctttggcctggctgtctgaacctccagattagactgatgagcacatgccagacagcaatgaaatgcaattacccaggcaaacttttgaaggatttgagccctggggcacaggctgtttacgaaagactaaaagcaccgtttgtgctgagcaggaccagttgcctccgtcttttccagttctggatcctgcctgccactggactgcaggcaggatttctgggggcctgataacatcaggcttctgtccacacctcagcacctcggggtctttgctctgtttttcaacaagaaaatgcaagtaccaacaaaagcctattataacatctccctttgtgttcactgactgactctctctctctcattgacttatttttttgtattgtgtactaccccgaaaaaatgcagccaggaatcatcctatagctgactggctgtgtaacttctttggaaatgaacaacctttccaaaaaacaggaacttcccgtcttctttgaaaaaaaaaattaaaaagcaaaccagtctcaacagcacctctgaattaccttccccttgatttgaacaaaagaggtttcagaggaacagaggtggagggaagagaaaacaaagaatgggcaaagggaaggttgacaaggagagtgaccatggtctcccctctgctgacccagacttttttttgtttgtgtgttttagacaactgtgggtgacacagaggtgttggaatggttcttcatccattcagctgaaaattaaaatgtaattctgctaggagaatgctggggaggggagggactggggaaggttccttggcttttgtagttgctgtggaggaagcaccaagtgaagccagcaggatggcagcactgaaacgctccagggctggggttgggggtcctgaagcccccgccatagggcacagggtgggtgtgggaaagaagcttccatgaggagtgggaaaatacgagggatagcaagaaaaagagtaaacttggaaggatgggtttcagaagtgctggaaccaagaacaatctagaatgcttttagagaaggaggccacacaggggcacatctgcacaccaaggaaggaggaagaacgccactgccaggagctagcagtgagtaggggttgggatccaaggaagtggtaggtaaatcatgcactcttactctggggccgagatgtcttacaaaatgtggaaagcagggtcaggattcagaaggcagcctccgatgaggctgagcagtctttagaggaaggaagatgaaaagaaagaagctgggatgagagagtttggcctcagagagggaatgggaaagggcaggggggctcactagcttagttagcagaaggctgtgaaagtgatgagggccagaaagccaagaagcatggagacttcctaggctcctcctcatcacaaacaagaagggaaatggcccaagaaagggcaggtggtgccagccaggctctccccccaggttcccagctgggatctgggaaaggagaaggaaagaatggagaaaggaaacagccaaagggccccagcagagagttggtgctatgtaaggaaagaaattgtttagggcaggatattctgaaattaacttaaaacctaaaacaaacagttttgacttgctgtcccaggagcaaggaaaaatccttcctcaacgactcatgcacccctttctctgcagctctgggctaggttcgtgggggtcctgggaaggagagagcgttcctgcccacctggaagtctccttccaacttgttgatctcagaaccctgatgtgctctggggagaagagtgtgtagcgggtgggggcacgctcagggttgcctgcctggatggcatctcggtggtggtggttgagtttttactgtcttacagcacagatggtggaaaatcatagccatgacagttggtgaagcgtcactcaaacatgcagcctatctggtaacagcagaaggcaatgtgtggggaaatgccaaagtgacagagaccaacagatcagtcaggagtcgggaagggagtcagtctgggcctcagtgaggacaaagatgttctggaggagatggggcaggtgaggtgccctgaagaatggcaggattcggggatgtggtggggaggagaggaaggaactttctgggtaggcatccagcatggaccaaagcttgtgggcaggactggtcatgggtgttcagagatcaagcaggaagatctgcagcattcacccacctcagtgtccagcctccctcctgttcgttggcttgactttttggtcatttcagagcaagaatgagcttcggaagaatggagcaccttgtggcccagaacaaggcagggaggcatggctagagaaggagacaggaaactggtggttccatggtctccataggtatcaggcctccctggcatcagctgacctgaaatagcaacacctgcttcttcggccactttcctccaaaggtgacatattcagacaggttctaccaggagtgcagggctaagggaacctatgcagtgcagtccctggactctctgaaggccaaagtatcaacagtgagcacattgggtcttcacacgtcactcaaggtcacatagaggggattcaaactcaggctggagtgtagccagaagtccaggttgcctatgctcattgctattcaccgtctgtcactctgctgcctctgaaaagttgtccttttgtttctctgggattgtcaactgatgtacatacagagatacaagggtggctgagctacaaatgatttatactacaagaaacagactggcgcaacctcatctctggtaagtcctcagtctcaaatgaaataaacagcatatggattttccctgttgtgtcgctgaggccaaattaggagtcagcaatggggcttagtgcttaaataagttgtgtatggatgagaaggatagggctgcccattccttgtttgagtgactgctggcacctaaatgcctcccggctcaggtaagagcctacctgatcacaaacagagctgggagatttgtcgagttactcaagcccccaagacatggccactacatgtgtgagattttcttagctcttctacacaggctccttactgttggctctcgcagtaaagagtggtttttgataactctgggaagctcttttcctgactcctacactatgggcctccacgtcgtgtggtcctgcaatagaaagtcatttcagggtggctttgactaagtaatgatccttcagagcgatcatcacccttgaggggtgccagcctgtacccagaaggactcctgcccggggccgcctcatgtcagggcctcttgagaactggatttgcaaagtgtctgcagacgtaagtcctggtggcctgctctgtctgctctgatcacaggggacaggaaggctgaaccaggacagaacagtttgcggtttcatcaatgaataatatggagctggggacaaagtcccctctactttctgcggctgtcactgaaatgtcagcagtggagggaaaaccagaagagaaaacctctcactgacaggcgccctcagtgtgcaaagagctcaagtttcagtgctggggtggggtgggggctgcgcccctgcctattcaccccactcctcccctgggctgctccactcccatgatgactgggaatttatcctacaacaggccacgagctccttgttctgcagtaggaaattatccttcataagagggcaactgttagtattgtttgtttgttttttaatttccaaaagtaaggagaagtttattaaataagagcgggggaagggaggagggagaaggagagggaaagggcccgagaggcagctgaccccagcatttcccgtctccccttggcttctcccatcccccttgtcccagacccccctccttctggttctgaatgtgaaaaataagcagcctgcacctcctcgactggagatgtgtctaacaaggccctcattgtctcagacaggtgtgagattggacttgattcggggccaacacctccagtaccggagccagctctgtgagccgaaaacatgcaccagccctccagtaataccactgcagccagccagagactcaacaatttaaggcttaacacacacaacataaatcagaggaggatggaccagccgaccggcagcttcttgggcagatgcctgcagactgtctgcagatcataccctgcctgtttgggttatttgagactctttttctgtaatataaagatgagaaactgggtggagcagcgtgcagaggcacacgggtgtttgtcctgtcttgttccaacagcccctctttcgcctaagtgctgttttgaagggactgctcaggacggttcacattgctacatccaaatcctaggaatgtgtccaagctggggaggaggggaaaggaaagctgagcgctctgatatgggtggtatctgtgtgaccctgggcaagtctcttaacctctctgggctcatccatctaacaaggggtctagttttctgcgattcactcatctctaatgctcagaagttcaaagtcactgtaagaagtgcccaagtcagaggaggtcattacacttgggaggaaactcacagcaccattgaatgctgtttctgagtggatccatgtctttgagcaagaaaagtctctcctcctcatacctgttctttagaaacttgtggttctcagactgctgaggcaagcccagagctcgagcccccgggagtgtggtcatgacatggcaagagccacacgctatgggaggggaagatggagatgacaggtctgcactgctagttactgccatgctccagtccctcttcctaatcaattcttagataagtttcattgaggagggaggattaccaagtcaccaagtcttagtgaagggagggggcccagaagccacccgtcaatgcgggagcccccactctggtgcctctgaaagaagggcatttggtctctgcaaattcctgtgacattccagggtagcttttggccctgccattcgtcaccctgaccctgaattcatggacaaggacgtggccgtcacagggatgccttcatctggtcccagctctctccctctcatagccgtgtactctgttgggagcaattggcatgaagtttggcagtggcatcctgaaccgggatgacaggaccatcagtcagcaccagcctcccgcccctcctggcctcggcctgccaaagcctcgtattcccacagctgtggctccagcctctgccctgtcacactcgcacacctgtttgccatcctgcttctggcccgccagcccaagccacagcccccaagcaggcttaaagggccgggcttgtgggaggaatcggcacaggatggtatttactcaaaatcacacaggacggtgaaacttggttaaaagaaatccttttgtagctgcttcattaaaaacaccaaagaggctgaccattcacatttgttgaatgcatccaattcatgcaagtaatgggacaggtcagggttcacccttgcctgctacccacgtgggctttgtgctcaggaagtgacctgtcggtctcctgtagctggttgtccccaacagggagcagggctggggtgccggctggggctgcggagggtgggcatggctttgaggaggatatcccttccttgctgggtggggctgagtagaatgggcgtggctttgaggaggatttcccttccttgctgagtggggctgaggagggtaggtgtggctttgaggaggacttcccttccttgcatgctttaagaatccctcctccagccaggcatggtggctcatgcctgtaatctcagcactttgggaggccgaggcgggcggatcacctgtggtcaggagttcgagacgagcctggccaacatgctgaaaccccatctgtactaaaaatacaaatatatatattagctgggggtggtggcagactctgtaatcccgactctgtaatcccggctactcgggaggctgaggcaggagaatcccctgaacccgggaggtagaggttgcagtgagcctgggtgacaagagtgaaacaccgtctcaaaaaaaaaaaagcatcactcctccttagcacgaattcaaccttttaaaaatggagactcagaagcagcacatgatactgaacccaaccatgggacctagcatctccctgagatggtgtatttccagaaaaaggcagtgtgacgtacagcatggttcagtgcccaagtgaatgatccacaccaaccctagagactgttctgaggctacctctgaggcagacccgaaccagccaatgggaagagcactgggccaggagccagaaaacctggatgttaggtctgcctctagttcggaaaatcactgaaactccctgggcctcgagtgtctcatgagtaaaatatagggctttgagcaaagaagtttaaggtcctttcaactttaacagtttaccatttggtcttgtggaacagtggttatgggaaggtctcctgtttgggtttatccaaggaaacaaaactcaaatgaaaataccactaaaaccaccaatacctttatccactctggggctcccgaggaataaggagacaccgggggaattatcgcagagtagctgtgtgacttggagaggaccgatgggtacaactaactggtgatacaacaatgccgccaataagagcacataaatagcaataatagtgaaaaagaataacattgaccatttattaagtattgaaagtgtac

SEQ ID NO: 1531 - DNA, 2297 bp, Homo sapiens
ctacaacctctgcctcctgggctcaagcaattatcccaccatggcctcctgaatagctgagaccacaggcccacaccaccacacctggctaatttctgcattttttgtagagacgaggcttcgccatgttgcccaggctggtctcaaactcctaagctcaagtgatctgcctgcctcagcctcccagagtgctgggattacaggtgtgagcaggtacagcaggctgagcaccaatgagactggcgaatgctgagttagtttcaccaccatacgcctcctgttccttttcctgctttacctctttggtctcttgagactgactataaatagaactgaaatgcacatcctgtgatttttttctccttcattcagtaactccttcagagtaacaatggtctgggtgaggtatagcaccatgcacagtggacattttgcctcaaggcagtctactttaagatgcaatccatggtttaacctcaatctaattacaacaaaccagacaaatccaaatatggagacagtatgaaaaacaactggcctggactcatgaaggtcccctatgcaactttcctgtgtaacttttcctacaggtttggaagggaatggaatggataaaaaatcttagtctttgttgacaaagcaataaaattcttgttcattgaagtttgaaaaaacttgtaacaaccatcaattctcataaccattagtgtaaaaggtataaaaagctggtattacatatgtatttgacattaattagtatataactataaacacctattaaagtaataaaatgtaaaacatccccttaagaaattaggaacttgtgagaaactgctgtactgataacagattattcaacatctgtgcacactggcagccacactcacagtctctggccagcaatgttcgctgcttctgtcaccctacaaccaggccaatacttggatttacaacctaaatttaaacagccatggaatgtgtccacaatttaagtcaaacctattacaatatattctaagggcttttcccaactgcctaggattctgtggcattacttactgcttgaaatagctagtaactattaattgttaataatcattacctaacgtattagaactcaggaatccttccatttcactagcatggctgagataatggttattaccattattacatcgtagcccattattctaggctaacaaaaaaggggtggtgatggggggagcagtgggggaaaagatactttgaacacctatgtatataggtgttcaccatgataacatcattataacaaattcctctctaaaaaagattttgttaactatttctctcccaaagagactgtttaaccaatttttaggtacggaattacaacctgaaatcaagccttcatttccctctcaacttaattaccacttcctataagaacttgattatatgtctgagaaccgagatagtaaaatgaggagtctgactgaacaatcgagattactaccattggacaaaccctgagaggaattactcttcaattctcctggctttcgttatcaattatatgatattaaagagagaaaaaaaaaaccttacccagttattttcccaaatgactgcaagaacaactaaacaatgtaaatgatgaaataactcaaaaagttttgagaagggggttgtaagtccatatgtggaagtttaacttttctccaattctatttactaattcactttcagaaaggttaaatctttttattttttgaaacagagtctcgttctgtcacccaggctgtaagtgcactgcaacctctgcctcccaggttcaagtgatcctcccaccccagcatcccaaggattacaggtgtgtgccaccacgccaggctaatttttgtatttttagtagagacggggtttcggttcgccatgttggccaggctggtctccaactcctgacctcaagtgatccgcctgcctcaacctccaaagtgctgggattacaggcatgagccaccacgcccagcgaacagtcagtgtttttattcatttcttatttctttttctgaggtggagtttcgctcttgttgcccaggctggagtgcaatggagtgacctcggctcactgcaatctccgcttctcaggttcaagcaattctcctgcctcagcctcctgagtagctgggattacaggcatgtgccaccatgcccagctaattttgtatttttagtagagcaaggtttcaccgtgttggtcaggctggtcttgaactcctgacctcaggtgatccacccgccttggcctcccaaag

SEQ ID NO: 1532 - DNA, 2297 bp, Homo sapiens; identical to SEQ ID NO: 1531

SEQ ID NO: 1533 - DNA, 4722 bp, Homo sapiens
cgacgaagctgcgtctctcagactgccactcttactcctcgccctgtagcagaaccccaacccccggcctgagactccagggatcggctgagctcgcgggctaacgctgtgaagcctgcccagctaccgtgacgtcacgagacccccgctatctcgttggtggctatttcctctcccgctgtggtccctggagacgccggaggagatttccgtgacaacggcaagctggctgcaacgaagccgcccacgtaggcctccccggcctgctggaggagaggggatcccccggggcagaggcggctacacccggagaacccggaaaccggaagcgcagatcctgccggctctggactagccgctcagcaccagggcggaaggaagacgaggcgaggcaagcgccaagcttccatccggacttcaaggccagtggctgggtctggttttctcaacacggcctcctagtctccttcccgcttgggcatctgtttttcttatatagaccctgaagccgcccgtgatgttctgtaagcaggttccgcttcagaatcagaggtacttaagagggaacctggatgctagacctgcccttgctgctggcctcagtttctttacctgtaaaacagggattttggaactgttaaattaaatcaaacttaaaagaattacaacttaaagctgctggaactttacatgatcccgagccttgagaggaatgtggctatgcagcctgagtcatgtggcatgcagatgcaacctctgcctttttccgctgtaaataattaagaagaccaagtagcatccaagagtcacctaagctgaagattcccttgagaacaagtactgtcctgtggtttcatggcctttcttccatttgtggttcttgccaagcggaatttaaatgacatcttatcaagatggataaaccctagtttcccagtgctggaatatagaaaatggatggacaagtaaatcccactcagcacccatagcccaggcatggggacctcaacacatttgagccgcagagatcacctttcattgtgaatagctctgagatgatacttctggttgaatgtctttttgtcacttccggctggatctaccatgaaagatttctgaatccaggaagagagattgactgggcaacatgttattcagaaacaggaccttgccctgtcactcaggatggagttcagtggtccaatcatggctcattgtagcctcaaactcccaggctcaagcaatcctaccacgtcagtcttcccagtagctgacagggtctcactctgtcgcccaggctggagtgcagtggcatgatcttggctcactgtagtgtagacttcccagcctcaagggatcctcccaccccagactcccaagtagctggaattacaggtctcatgctctcactcaggctgcagtacagtggcacaacctctactcactgcagcctctacctgccaggctcaagcaattctcctgacttagcctcccgagtagctgggattacagttgaagcatatgtcctgtgagcttaggggtgctacaagttgaccactgcagcagtaaagatgattctgaagaatggcatgggatggatcctttcgaatgcacttgagcagcggtctccaaccacagggccacagagctggagctggatctaccatgaaagacttctgaatccaggaagagagactgactgggcaacatgttattcaggagatggggtctcaccctgtcgcccaggcttgagtacagtagtgctatcacagctcactgcagccttgaactcctgggctaaggatcctcctacctgagcctcctgagtagctgggactgtagggtctccctctgttgtccaaggctggagtgtagtagtgctatcacagctgactgcagcctcaaccttccaggctgaagcgatcctcccatctcaacctcccacgtggctgagactacaggcgcttgccactatgcccaactaatatttggaattttcctatacgtggattccagaggggtgacagcgaaacgtgggaccatccagttgcaggaaaacgagcttaacacgcccactgattctacattatgctcctacctcccggcagcctctccaggcccagaactttctccagtcggcctccacagaccaagctcatgactcacaatggcctatttaggcccataccctacctcacggcagtctccgcagatgaggctactgcctcacaacagcctccacaggcacagctccatcgttacaatggcctctttagacccagctcctgcctcccagccttctctctaggccctgaactttctcaagtcgacgtcaccaggcccagctcatgcttcttggcagcctctccaggcccagctcttcctcccggcggcctctgcaggcccagactgtcatcaagtcggcctgtccagggccagctcctgcctcccggcgccctctgcaggcccaagtcgtcctcaagttggcctccccaggcccagctccagcctctcggcggcctctccgggtgcaaaagttcctcgagtcagcctctccaggcccagctcctcctgcctcccagtgcctctttcggcccagcccagctcatgcctctgggcggccttcccaggccccgcttttgacttttggcggcctctgcaggcctcgacaaggcccggcctcctgcctcccgaagcctgcacaggcccagcctctgcctcacagcagactctccacgcccagctagctctcgcctcactgcggcctccccagtccaaagctcctgcctctcggccgcttcggcaggcccagctcccgcctgccagtgcctcttcaggcccatggggctcattcctcacaacggcctttccaggccccgtttttcccttccggcggcctctccgggcccagaacctcctcaagttggcctctccagacccacttgcaccctccgggcgtcctctccaggcccagctcttcctcccggctgcgtctccaggcccgactcctgcctcccaacaacctctttggactcagtgcctgcccatctcctggcggccttggtcggcccacagcttcctcaagccaagctccccaggcccaggtcaggcctcacggtggcctctccaggatcagctcctgccctccgatggtgtctccaggccccaaatggtctccggccagtgggctcctccacgcccagcttgggcctcccggcgacctctgcaggcccaagtcgtcctgaagtcggcctctcccggccctgcctcccagcaagtaagcaagcttttttggcttagctcctgcccagctcccaaccgcctttgctgcagaaactttggggtctacaaacgccggcgagagctgagccgaaagagcttgcttgctgggaggcaggagctgggccgggagatgcagccaggaggaacagctgggcctgcagaggccgccatgcgggaggcagaggctgggcctcctcaagttggcctctccagacccacttgcagcctcccggcgtcctctccgggcccagctcttcctcccggctgcgtctccaggcccaactccggcctcccaacaaggtctttggactcagctcccccgcagcttccagcggccctggtaggcccacaacttcctgaagccaagctccccaggcccagctcaggcctcacggtggcctctccaggctcagctcctgccctccgacagcgtctccaggccccaaacggcctccggtcggtgggctcctctaggcccagcttgggcctcccggcagcctctgcaggcccaaatcgtcctgaagtcggcctctccaggcccagctccagcctcccggcggcctctgcaggcctaagtcgtcctcaagtcggcctggaaatgggcctggaagagctgcaagtcggcctccccgggcccagctccgtcctctcggcggcctctccaggtgcaaaacttcctcgagtcagcctctccaggcccagctcctcctgcctcagtggcctctttcggcccagcccagctcatggctctcggcggtcttcccaggccccgcttttgacttttggtggcctcttcaggcccagaacttgacctccagtcggcctttgcaggcccggcctcctgcctctcgaaggtctgcatgggcccggcctcggcctcacagcggactctccacgcccagctagctctcgcctcactgcaccctccccagtccaaagctcctgcctttcggccacttcggcaggcccagctcctgcctgccagtggcctctttaggcccagctcattcctcacaacggcctttccaggccccgtttttcccttccggcagcctcttggcctctaatttttttatcttttgtgtataaatcccaaattatggaattttggaatatttccaccattatataaatattttggtaggtaatttatttggagtgagtttctgcaccaagcccgaattttttattttattttccttattatttggtgttaaacaggtttaatgacggtcatggcaactttttggcacaatgaaaaatatcgcccatgatcaacgtgttctgttctggggaagggggcaaaggcagggtgaatcactttcttaaaaagtacagcttaagttgggagtgcagagggaatggggagaaaaccctcccactgcctgtgtcgaagtgcaggagcccccacccccatactcacctgagtccagcccctct

SEQ ID NO: 1534 - DNA, 4851 bp, Homo sapiens
agctgcgtctctcagactgccactcttactcctcgccctgtagcagaaccccaacccccggcctgagactccagggatcggctgagctcgcgggctaacgctgtgaagcctgcccagctaccgtgacgtcacgagacccccgctatctcgttggtggctatttcctctcccgctgtggtccctggagacgccggaggagatttccgtgacaacggcaagctggctgcaacgaagccgcccacgtaggcctccccggcctgctggaggagaggggatcccccggggcagaggcggctacacccggagaacccggaaaccggaagcgcagatcctgccggctctggactagccgctcagcaccagggcggaaggaagacgaggcgaggcaagcgccaagcttccatccggacttcaaggccagtggctgggtctggttttctcaacacggcctcctagtctccttcccgcttgggcatctgtttttcttatatagaccctgaagccgcccgtgatgttctgtaagcaggttccgcttcagaatcagaggtacttaagagggaacctggatgctagacctgcccttgctgctggcctcagtttctttacctgtaaaacagggattttggaactgttaaattaaatcaaacttaaaagaattacaacttaaagctgctggaactttacatgatcccgagccttgagaggaatgtggctatgcagcctgagtcatgtggcatgcagatgcaacctctgcctttttccgctgtaaataattaagaagaccaagtagcatccaagtctcttgtccttctgcctgctgttgtgggatgatgtgtagaggaagatagtcttcctctacacagcaagaagatccctaccagatgcagccctctcaaccttggacttcctgacatccagaactagtcacctaagctgaagattcccttgagaacaagtactgtcctgtggtttcatggcctttcttccatttgtggttcttgccaagcggaatttaaatgacatcttatcaagatggataaaccctagtttcccagtgctggaatatagaaaatggatggacaagtaaatcccactcagcacccatagcccaggcatggggacctcaacacatttgagccgcagagatcacctttcattgtgaatagctctgagatgatacttctggttgaatgtctttttgtcacttccggctggatctaccatgaaagatttctgaatccaggaagagagattgactgggcaacatgttattcagaaacaggaccttgccctgtcactcaggatggagttcagtggtccaatcatggctcattgtagcctcaaactcccaggctcaagcaatcctaccacgtcagtcttcccagtagctgacagggtctcactctgtcgcccaggctggagtgcagtggcatgatcttggctcactgtagtgtagacttcccagcctcaagggatcctcccaccccagactcccaagtagctggaattacaggtctcatgctctcactcaggctgcagtacagtggcacaacctctactcactgcagcctctacctgccaggctcaagcaattctcctgacttagcctcccgagtagctgggattacagttgaagcatatgtcctgtgagcttaggggtgctacaagttgaccactgcagcagtaaagatgattctgaagaatggcatgggatggatcctttcgaatgcacttgagcagcggtctccaaccacagggccacagagctggaggtgagcagcagctggatctaccatgaaagacttctgaatccaggaagagagactgactgggcaacatgttattcaggagatggggtctcaccctgtcgcccaggcttgagtacagtagtgctatcacagctcactgcagccttgaactcctgggctaaggatcctcctacctgagcctcctgagtagctgggactgtagggtctccctctgttgtccaaggctggagtgtagtagtgctatcacagctgactgcagcctcaaccttccaggctgaagcgatcctcccatctcaacctcccacgtggctgagactacaggcgcttgccactatgcccaactaatatttggaattttcctatacgtggattccagaggggtgacagcgaaacgtgggaccatccagttgcaggaaaacgagcttaacacgcccactgattctacattatgctcctacctcccggcagcctctccaggcccagaactttctccagtcggcctccacagaccaagctcatgactcacaatggcctatttaggcccataccctacctcacggcagtctccgcagatgaggctactgcctcacaacagcctccacaggcacagctccatcgttacaatggcctctttagacccagctcctgcctcccagccttctctctaggccctgaactttctcaagtcgacgtcaccaggcccagctcatgcttcttggcagcctctccaggcccagctcttcctcccggcggcctctgcaggcccagactgtcatcaagtcggcctgtccagggccagctcctgcctcccggcgccctctgcaggcccaagtcgtcctcaagttggcctccccaggcccagctccagcctctcggcggcctctccgggtgcaaaagttcctcgagtcagcctctccaggcccagctcctcctgcctcccagtgcctctttcggcccagcccagctcatgcctctgggcggccttcccaggccccgcttttgacttttggcggcctctgcaggcctcgacaaggcccggcctcctgcctcccgaagcctgcacaggcccagcctctgcctcacagcagactctccacgcccagctagctctcgcctcactgcggcctccccagtccaaagctcctgcctctcggccgcttcggcaggcccagctcccgcctgccagtgcctcttcaggcccatggggctcattcctcacaacggcctttccaggccccgtttttcccttccggcggcctctccgggcccagaacctcctcaagttggcctctccagacccacttgcaccctccgggcgtcctctccaggcccagctcttcctcccggctgcgtctccaggcccgactcctgcctcccaacaacctctttggactcagtgcctgcccatctcctggcggccttggtcggcccacagcttcctcaagccaagctccccaggcccaggtcaggcctcacggtggcctctccaggatcagctcctgccctccgatggtgtctccaggccccaaatggtctccggccagtgggctcctccacgcccagcttgggcctcccggcgacctctgcaggcccaagtcgtcctgaagtcggcctctcccggccctgcctcccagcaagtaagcaagcttttttggcttagctcctgcccagctcccaaccgcctttgctgcagaaactttggggtctacaaacgccggcgagagctgagccgaaagagcttgcttgctgggaggcaggagctgggccgggagatgcagccaggaggaacagctgggcctgcagaggccgccatgcgggaggcagaggctgggcctcctcaagttggcctctccagacccacttgcagcctcccggcgtcctctccgggcccagctcttcctcccggctgcgtctccaggcccaactccggcctcccaacaaggtctttggactcagctcccccgcagcttccagcggccctggtaggcccacaacttcctgaagccaagctccccaggcccagctcaggcctcacggtggcctctccaggctcagctcctgccctccgacagcgtctccaggccccaaacggcctccggtcggtgggctcctctaggcccagcttgggcctcccggcagcctctgcaggcccaaatcgtcctgaagtcggcctctccaggcccagctccagcctcccggcggcctctgcaggcctaagtcgtcctcaagtcggcctggaaatgggcctggaagagctgcaagtcggcctccccgggcccagctccgtcctctcggcggcctctccaggtgcaaaacttcctcgagtcagcctctccaggcccagctcctcctgcctcagtggcctctttcggcccagcccagctcatggctctcggcggtcttcccaggccccgcttttgacttttggtggcctcttcaggcccagaacttgacctccagtcggcctttgcaggcccggcctcctgcctctcgaaggtctgcatgggcccggcctcggcctcacagcggactctccacgcccagctagctctcgcctcactgcaccctccccagtccaaagctcctgcctttcggccacttcggcaggcccagctcctgcctgccagtggcctctttaggcccagctcattcctcacaacggcctttccaggccccgtttttcccttccggcagcctcttggcctctaatttttttatcttttgtgtataaatcccaaattatggaattttggaatatttccaccattatataaatattttggtaggtaatttatttggagtgagtttctgcaccaagcccgaattttttattttattttccttattatttggtgttaaacaggtttaatgacggtcatggcaactttttggcacaatgaaaaatatcgcccatgatcaacgtgttctgttctggggaagggggcaaaggcagggtgaatcactttcttaaaaagtacagcttaagttgggagtgcagagggaatggggagaaaaccctcccactgcctgtgtcgaagtgcaggagcccccacccccatactcacctgagtccagcccctct

SEQ ID NO: 1535 - DNA, 1076 bp, Homo sapiens
gacaacatggccaggaaaaacacgttaaacaaagggtgttgctctgtcacccaggctggagtgcagtggtgccatcatagctcactgcaattgttacaggagaggggtcctgatccagaccccaagagagggttcttggatttggatcctgtgcaagaaagaattcaggtgacttagaatgcctgaccatgtgggaatgcagcccagtaggactcagtctcattttacccagcccctgttcaagatggagtcgctctggttcacacgcctcagacacagcctctgcctcccgcctcagcctcctaagcagctgggactacagtgcatacctgattttctcgacctcttttatgaaatatccccgccagactccctcgaccgtgccacccccaggttcccgtgcatacacaacattgcgggataggtattgtggaatgaggatccgtgttacgacctacagaagatgtggctgtgaagtcaggagtcacggtctcagagttgactgcactgcctcgtagctgtgtgaccttcaggattttgttcaaccccctctgagcttcagtttgctctctgggaagactccaaggataagagcatctacctcctcagcctgctgtgagagttaacagggccagggccaaagacgctttgtctgactgctggtctgcggggagctctaaatatgaatctgctacatcaccttcacttttgaattcggctctgatgttccaaatgttcttggccgttccttcgtgtttctcctgtacgaatttcagcttctttttgccaagtatctccccacccccgcccacccccacccccaaataaactcactagaatgttggctgaaaatctgataaggctacacattgatttggaaagaaatgattttttgtgagagtcaaactccctacccattttttttcttttgttttttcaaaagtttttttcttacatttgtcattcaagtttgtcattttcttgctacagattccaaacacttttcaagaggaccgtcgctaagtactttatactcttgtttgggtttttttagagtaaaaaatgttcaaattcta

SEQ ID NO: 1536 - DNA, 1076 bp, Homo sapiens; identical to SEQ ID NO: 1535

SEQ ID NO: 1537 - DNA, 1076 bp, Homo sapiens; identical to SEQ ID NO: 1535

SEQ ID NO: 1538 - DNA, 1995 bp, Homo sapiens
gaggcgggctgaggcaggagaatcgcttgatcctgggaggtagaggttgcagtgagctgagatcgcaccattgcactccagcctgggcaacagagtgagactctgtctcaaaaaaaaaaaaaaacccaaaaaaacagcaaccaaaaaaacctgatttcatgggggcaagattcaaatgtcaacttcagtttgagattaggaggccctgattcattaaaccgatagttatgtattggacctaccatgagttgaatgcatgcatacagtgtggtgggaagggtctgtgagctctgagaggccagagtttgagagtctggcggtgcttctagtcataacagacacataataggacataaaaggagtagtatttacctactaagttccaggcctatgataatgctttacactcactggcttgccaaataacttataaactatacaaactttattatcaggaactgttatatttaataactcaggcaaaatattcacatactcttaccagtactaatagtcattaccatgattgatcttttaggctgtctttgacaaacagaaatggacagtgtcgtacggttccagcatttaacctctcctccacctcaatcttacttccctacgtttctctttgcctcttctttctcacttagttttgaatcaattatactttgtcgatctgttagctgtcttagatccttttaggagcagcatacaaatagaaaaatacagtctcccatatcccacaaccaaatataaccacaatgaacatttttgtgtattgctttccggtatttttctctgcatatttatgtacatattgaagccaggttgaagacagcctgtaattatgtcagccctgtgttctgttccgttagcatttctccatttaaacctgactctttgaagtccagtgctgtctcatgactagataacacattatttgacttttctggaattctggctgtatctaaggggataggtttcctgtcactgagcctgactgaacaattctgagattatcaacactgccatagggccccgaaaaagcgtctaatgaatgcaaaagttcaaagcggttttgttcaggtgttatttttggagacactttctcaggcttttatgatgcaatccactttgtgcccctctcttgcagcagctgcggccagggaaaaagcactaagtgggcttgctcactggtcctcaggggtgggtaccctgggcaggtcagcccagaagtcagctgcctcctctccaggccctgcctggacagctgagagtcaagcagacagttatgtgccatccctacctcttttctgtcttcagtaactggcagcttcatcctgccagagagtttggaatgagctaggactttcccatcagtctgaactcctgggttttcccaggcctggtgactcagagggtaaggcaccgagccgaggaagagaaaggagaacctggactcctgggtgcctttgtctcaccacacaatcacctcccaggaaggctgtcatccaatcactcctgtggaatctctctgccactttgttgtaaagaaagtcagccccagtgaagggtaaaaagaagtgccagagggccttggggacaagccatatactggtagaaagggcactggggcagggtccgaacagctgagagtatgtctagcaccaggatgaaaatcagtagttcacagagctgctttgtttgacctactccgtatttttttaatggtacatttcacataaagacctgtatatctggcttccccacaaaagtcaagatctgacagcatctgactatattttctcatgcaatatctgaagctgggtagcagccagccctggatggggtgtttcctctccagattaacacagagcctaccaacttgttaaatctcacctcataggacaataggcgcaaaaatatactgaaatgagttgaaaaaatggtaatactttttttttttgagacagagtctcactctgtcgcccaggc

SEQ ID NO: 1539 - DNA, 1995 bp, Homo sapiens; identical to SEQ ID NO: 1538

SEQ ID NO: 1540 - DNA, 938 bp, Homo sapiens
ccactctccccaggctggtcaatgggcccaccccacggtaagcttcaaggatggcctgcttgctgctgatgagtgaagtaagcccaaaggttgtcggggaaatacctgcattcctaagagcattattgacacttgccaaaaaacagaaacacctcaagtgtctatgggtggatgaatggatacacaaaacgcggcctttacataaaacggatattattcggcttatattccgacacaggccaattctgacatcgatgaaccttgggggcattaggctacgtgaaagaagctggtcacagaaaggcaaataccacatgattccactcggatgaggtgcttagagcagttagattcatcaagtcagaaagtaggagggtggtggccaggagctgggggctggagaaacggggagctgttgttcaatacaggggtccccagcccccccgggcatggaccggcaccagtccgtggcctgttgggaaccaggatgcacagccggaggtgagtggtgggtgagcaagcgtcaccccctgaaccccacttcccatccgagcagcagcggcattaggttctcgtaggagcgtgagccctgtcgtgatctgcgcgtgcgagggatcgcagttccatcccgaaagcgctccccacccttccccggtccgtggaaaaagtgtcttccacgaagccggtccctggtgcgctggtttcacagatgcggagtctcagtttagccaggtgagagttccggagatgacggtgctgatggccgcaccagagtgtgaacgtgcctcgggccactgatgcgtacactggatggaaaattttaggcatgtgtattttgccatgattttcttttgttttttgtttttgtttttgttttttttgagacagagtctcactctgtcacccaggctggagtgcagtggcgcgatctcggctca

SEQ ID NO: 1541 - DNA, 5074 bp, Homo sapiens
tagtaagcacttatcagatatttgctgaatgaaggaaaaaaccctcatctggaagaaaaaaaaatgagatatttaatcaacggtcttcaaaataaggtgaaaaaagattgtaaagattcaatgacaaagttttattaaataccaatactggctaggcacaattagacacattattatctcatttgctgtatctggtatcaaacaacaaagcctgaaagattaccatagattttgatggcctcattaacataattaatccgtagtgacattccctggataataaatacagttttatgtccgtgtgtcttctgtgtcttccaagttgctacagggctctatttgatctgagaaactgactgctgtttacatccaggtatgcaatgtgacattagaattgaagcagaaaggaagcaaaacaaaacagggttcatgaggaaaataatcttctaagaactaacatggcctggaggtaaaatgcaaatatatccggtaataagaagcccagattactgcagataaaagattaaaataggattcaattattcatctccatttgcaaatctacaaactaggaggaaggactaacccttttcctgggattagtaactaaatttaatgattacagcaaatataaagttcttttgtaaattattgttggttaaggattgacttgcattgacaacacactttagctctcgcccctttcattctccccctgcaagaacaaaggcaaaatgaacagtgaggaaaacctggaaacaggaccgagtgtttgctatcacttgattcctttgaaggagcaatgctttctcataatataggttttatagtatcatcaagtacatcagttaagcaaatcaagtgctttgtgttctgtatataaattacataatacaagagtctgtggcagttaagaatctggttctgcactttgggaggccgagatgggtggatcacgaggtcaggaattcaagaccagcctggccaagatgctgaaaccccgtgtctactaaaaatacaaaaattagccaggcgttgtggcacacacctgtaatcccaactactggggaggctgaggcaggagaatcgcttgaacccgggcggcagagattgcagtgagctgagatcgtgccactgcactccagcctaggcgacagagcaagactccgtctcaaaaaaaaaaaaaaaaaaaaaaaaaagaaaagaaaagaatctggttctgatcagaatccttaaaatactgtcttcttttttatcacaattgcccttttggatgtgagtgctggtctcaaaaagatttgcagttaaaagaggaacagcaaaaaagacttacaccaaaatagcaaccaactctaaaactattacaggtgagaggtagacagcttcataactcaatcttctactaccaggtgatgttaaaaaaatactttaacatcaaaatcacctacaaatattcctccactttcatatgctgagcaatttcagcttagagtgactaagtgttatttatctctctatcttcggcacctagcacatagtaggcagtcattagttatttgctgaatgaaggaaaaaaaccttcatctgaccaacgataaatttcactaaaattgactataataaaatctgtatgggctccacatgaaaactacatgaacttcacttccccacatacctgacagcctatacacttccttatgtttcatttctttaaatatactttaaaaattgcttatttacacaataaaaacaatgtccaccataaaaaaaaaagtctctagaactattggaattagtctcagaataactcatctgattggatttgatatgagatcattctcagattgttctgtggaatctcccaattccaataatgatgcttgcaatatcctttagctgtctatcagttctggtctttattcaggcccaaagagagaagaaagaagtagactaagataaaatgggtagtctgtgtattcatgtagtgaatatattcaagacataaatatgagacagaaaggtcacttctgcaacaaactaagtctgatcagagttaagttagcttccctctctgagcctttatttttctcatctctaagacagattcatcctagaagctctctggtcctttttagcttcaatgttctatgattggttctcatttaattgatgcaccaactgaaacactcactaatcatacattttgctggaggttgatcaatccttagcaaatcaggaagaaatgaatgttccacttacttcgtgcagaagctcaggaagctgggctctaaaggcccaagtttttgttgttgttgttgttgttgttgttttgcctgaagcaatgtatgtaatttaataatttaaatagtgtttaattaaatagtgtcttgtttaaatgctatataacattttcaactgcggctgcacaccagaatcactcaatgaactttattttactgctgcttgagtcccaccctcagaggttccttttaattgatctgtgtgcagcctgggcatggggacgtttataagctctccagatgattctaacctgagcaaagggaatgatgactggcatagagcaatgagtctcaaactttagcatgaatcagtcacctggaaggattacaaaaacacagattgtgagatgccacgctcagagtttttgattcactaggtctggaacttcttttttctcttctgggaacttgctttttgttttttgtttgtttgtttttttgtttttgagacaaggtctcactccgttgctcaggctagaatgaagtggagcaatcacggctcactgcacctcagtctcctgggctcaagcaatcctcccgtgtagctgggcctacaggaatgcaccactaatttgtttgacttttagtaaagacagggtttcaccacattgtgcaggctggtctcaaaactcctgagctcaagtgacccacctgcctaggcctcctagagtgctgggattacaggcatgagccaccatgcccagcctatgaacttgcttttctaacaagttccccagtaacgctgatgcttttgtcaggaccttgctttgagaaccacttccagtgagagaatatcattgatgctggcatctgaagtcctgagtttaaatcctgattctattattaccacctacataatcctagtcaagtaattttttctctcatttttagtctctttgtgacaatacttagatcccagagttatgagacatgaaataatgtaccaatcagagtttggtacagtccctggcatagaacacaataacaaatattaacttcctttttccattatacatggctagatggaacaattaagttaaatcgataacacataagttgaaacttcacaggaaaacaaagtacagctagttgaagcaaacaatatcttataattatacatgtaatacagaatgatagagaaatgttttaagtacttaaaaataccttcgttcaattttcaaaactttgaacgtaataatttaggtagtaggaacattagatgcaatctatagaagaaatattagactcaatctatgaagaacatgaatttttttacaacctataatggatcctgatacctcatctataattttagttttctatagaatcaataatataattagtgtacctgcttaaaactgtattacattgatcttcaatgctacttaatttctgagaaaacctaagttataagagtacatcagaatctctattatcaaccaaagcaaaacttctaccaacgacagaatggatactttttaaacaaatttacatataccaacaagcaaaaaactagagctttcattcctgcttgacatttttttcactttgtgtgtctcaaggctctctcaggaatcagtgtccaaaccatgaggtgaatcctgggaggtaagcaagcttgctgtagaagccgctgtacatgccttcaggaacagaaagggtaccagaggctgtgccctcctagtgtggctggttggagtgacaactagaatgttgtccgtgtttttctgtggaacctacaatgagtccagttgtctaagtgagtctcaaaggtattgaatagttgatgtcaaaaggcactttatgtcaggactgtttaaagcaagtttctccctataccagtagtgacccagaggcaaggtcttaccggacctcttattttcaaaagccttccctttccaattgagcctgatgccattatgtgacatctttttttccctgaatttctaaaagaaaatgtgatgattacctgcatatcttctttgttgctgcatcgtgttttgcatggtacccctttaatattgttttcaatacttagcctgctgatatacttttaacttctcacctgtttatgaattctcttaactaggctgtgaggcccttaagggtcttcaacttgtccctttcctccacgtaactttctcaaacgccccagttctcagtaacttttctcttttgctgtctgtaatataaacatgacccctacttacactgtcctacctatgtggccaataagagtgttgtcttcgcagttggaacccaaaagccctatgggatggaggatatgcactgtacttctttgtaaaagtgtcttgacaaagctgatgtccaatcaacatttaattaccagactgtccaagctagaaatgaaatacagttgattgcctgagtcctgataatcttgctaacaaaattataaaaggcctatagtatggccaatatatttggctaatggaaatgattttcttaaagccagaaaattcagctacccatagtgcttaaaaccagccttaaaagaacatgaacaggatggttcccaccttatcgagatcactggcattccatagtatccattcattcatatcctcctcctaggccgcatgaaacacctaccacatttccctacctcctaaagcaaacaaaactcttttcctccctcttgctgcaaaaaggtttattaaaagccgtatgtagtgtataaagcctttcaaaaatactagcaatccatgcctttctttttttgagatggagtcttgctctgtagcccaggctgg

SEQ ID NO: 1542 - DNA, 5074 bp, Homo sapiens; identical to SEQ ID NO: 1541

SEQ ID NO: 1543 - DNA, 5074 bp, Homo sapiens; identical to SEQ ID NO: 1541

SEQ ID NO: 1544 - DNA, 5074 bp, Homo sapiens; identical to SEQ ID NO: 1541

SEQ ID NO: 1545 - DNA, 5074 bp, Homo sapiens; identical to SEQ ID NO: 1541

SEQ ID NO: 1546 - DNA, 5074 bp, Homo sapiens; identical to SEQ ID NO: 1541

SEQ ID NO: 1547 - DNA, 822 bp, Homo sapiens
tgctttctggcctccagttggagtccatctctggcaagtgctggcaagaaagggattggagggtcataggagaaacagatgaagatcctgaataccaaagagggccgctgacaggtctaggagtacacttctagcacctagcagagagaggcttcactacatcatgcttcctgacatctctccctttgaagagcagtcagactcctgctttgctcttcagacttaatttgggggtttaacagccatgtgaagtgctcactccccctttgccttctgccatgattgtgtgtttcctgaggcctccccagaagctgagaagatgcttcctgtacagcctgcagaactgtttgaatgagagaggcagaagcacatttccaatcactgggggaacctgagaccattctttccaacccattttgccaaatggatgtcctgaggaaggtgttccaagagaggcgatgtcaggatagtgtctgattggagggtgcccaaggcacatgggagaatgtggaagaactggaaagacttgggtgttgctgatgttaaattacttaggtatctctgtagaaacttagtgggtcattccttctcttcacaatccctttcttaaatttatgataaacgtgaaaggtaatcaaaacaaaagcagggcaaaatgggaaaataagttcccactttaactttttctggattatttaaaggtctactggggcaaatgtgatgaaaattaaaaaaaaaattgcagatcatcagtgtttaaaagcaaatgctttctgaaaattatagcttgtatgttaacatgatttgttgaaatctgttttt

SEQ ID NO: 1548 - DNA, 822 bp, Homo sapiens; identical to SEQ ID NO: 1547

SEQ ID NO: 1549 - DNA, 2100 bp, Homo sapiens
accaatgttacccatagatttcaggcattgtataaaagaacatgtggaactccctgctctgttctgtttctctctgactaccagtgcatgaaacccctgtcacgtatcccctagattgctcaatcaatcacgaccctttcatgtgaaatctttagtgttgtgagcccttaaaagggacagaaattgtgcactcagggagctcggattttaaggcagtagcttgccaatgctcccagctgaataaagcccttccttctacaacttggtgtctgagaggttttgtctccggctggtcatgctacatttcttggttccctgaccgggaaacgaggcagacaaaacctgggtagttaaggggctacccgaggcagccccttaggcggcttaggcctgctgtgtggagcatccctgcaggggactccagccagcctgagtgaagccatccgaagagcgatcccagacggagtagtcaaggaaggcctcgctgtgcagacaacactgagcaaagacttgaaggaagaaagggaacaagatatcaagatatttgggaaaagcatattccaggcagaggtctgagcaaatgcaaagacctgacctgaagggagaatatctctgggtgttcaaggaacagtaaggaggccagatggttgaaaccagctgagaaaaaggtgcagtaactttaaattcctcaaatcccctgagtgcaaggccatggctcagaaaagccttgcaaacaacagcattaatctcccctacaaggacttgacctccgaggtaaccaggcgccgagtcaccatgatcacaagaaaagagataattacccagaaaagtgatgaagctaaggagatgctctcccacttggatttggagcaagcccctccccctcacaggacctacctcacagtacctcctgccccacctccttctccagctgaggatcccacggtctcctaagatgtaaaacttattttgaagtgaattcttacacagaactccagaaaacagtttcagtggcattcttgaggtttgtcttagaagactcttgaagatctttgttctttcctatttttcttcacctagaaccaccatagagcatggtttacccttgctaatagacttagtcatttttggttttttaatccaagtctctgatatgatatgcatatattttgatctttatgttatgctatagaactgttgctgtagtcagttgtatttaaattaataaacagttatcaggccttgttgtttattactaaatctgaatcagtgaaaagtctaggccttttaaagtctagagtttaaagatctcaggtcctgggaaccctgaggtagctggattttcaaaacgcaacctgagacactacagttgtgtggccctatattttggagctgcattcccatgccgtgtgctggggctaaggtggttgagtttcacatttattgacagtgtttttaaagtttgtttctgggagatttgaagtgattttcaaactctgtaacagaaaactctaccctgaaaagcagccaagtgtagagtggttctgttgtggagaagtccattgcttgagtcctctccaagctccttgacgggccccagtgcacctctaaggacttccggggctcttctgaattgttcgaaggcatcaaaaatgtgataattctggcatacatatacatataaaaaatatccccacatgtcatcctttatttcgtctgctgcttcttagagtccttgtaggtgttctgtctccaggcctgcccttgtaaatgtgctcggctcccctatgagaaaggagtcaaagcttctgtacaccattgtggagtcagggtaaacactctgtgatctcccctgatcccatgcatttaataaaaccaatgttccttctttaaaagtaaaaagtgctccggttcttctacccccatagtagttggctgtgccattggtgtggaagtcggactccttacctgtggccttcagcagcatggggcagggaaggagcctgcactgagtgtctgccattgccagctggatgctggacatacacatctccctctcctcagtctggtgaagaatgggcctgcgctgtccaataggac

SEQ ID NO: 1550 - DNA, 2224 bp, Homo sapiens
accaatgttacccatagatttcaggcattgtataaaagaacatgtggaactccctgctctgttctgtttctctctgactaccagtgcatgaaacccctgtcacgtatcccctagattgctcaatcaatcacgaccctttcatgtgaaatctttagtgttgtgagcccttaaaagggacagaaattgtgcactcagggagctcggattttaaggcagtagcttgccaatgctcccagctgaataaagcccttccttctacaacttggtgtctgagaggttttgtctccggctggtcatgctacatttcttggttccctgaccgggaaacgaggcagacaaaacctgggtagttaaggggctacccgaggcagccccttaggcggcttaggcctgctgtgtggagcatccctgcaggggactccagccagcctgagtgaagccatccgaagagcgatcccaggtagagaattgccccggtggaacgcctcgccagagcagtgcgtagcaggcccctgcggaggattaacacagtggctgaacaccaggaaggaactggcacttggagtccagacatctgaaatttaacggagtagtcaaggaaggcctcgctgtgcagacaacactgagcaaagacttgaaggaagaaagggaacaagatatcaagatatttgggaaaagcatattccaggcagaggtctgagcaaatgcaaagacctgacctgaagggagaatatctctgggtgttcaaggaacagtaaggaggccagatggttgaaaccagctgagaaaaaggtgcagtaactttaaattcctcaaatcccctgagtgcaaggccatggctcagaaaagccttgcaaacaacagcattaatctcccctacaaggacttgacctccgaggtaaccaggcgccgagtcaccatgatcacaagaaaagagataattacccagaaaagtgatgaagctaaggagatgctctcccacttggatttggagcaagcccctccccctcacaggacctacctcacagtacctcctgccccacctccttctccagctgaggatcccacggtctcctaagatgtaaaacttattttgaagtgaattcttacacagaactccagaaaacagtttcagtggcattcttgaggtttgtcttagaagactcttgaagatctttgttctttcctatttttcttcacctagaaccaccatagagcatggtttacccttgctaatagacttagtcatttttggttttttaatccaagtctctgatatgatatgcatatattttgatctttatgttatgctatagaactgttgctgtagtcagttgtatttaaattaataaacagttatcaggccttgttgtttattactaaatctgaatcagtgaaaagtctaggccttttaaagtctagagtttaaagatctcaggtcctgggaaccctgaggtagctggattttcaaaacgcaacctgagacactacagttgtgtggccctatattttggagctgcattcccatgccgtgtgctggggctaaggtggttgagtttcacatttattgacagtgtttttaaagtttgtttctgggagatttgaagtgattttcaaactctgtaacagaaaactctaccctgaaaagcagccaagtgtagagtggttctgttgtggagaagtccattgcttgagtcctctccaagctccttgacgggccccagtgcacctctaaggacttccggggctcttctgaattgttcgaaggcatcaaaaatgtgataattctggcatacatatacatataaaaaatatccccacatgtcatcctttatttcgtctgctgcttcttagagtccttgtaggtgttctgtctccaggcctgcccttgtaaatgtgctcggctcccctatgagaaaggagtcaaagcttctgtacaccattgtggagtcagggtaaacactctgtgatctcccctgatcccatgcatttaataaaaccaatgttccttctttaaaagtaaaaagtgctccggttcttctacccccatagtagttggctgtgccattggtgtggaagtcggactccttacctgtggccttcagcagcatggggcagggaaggagcctgcactgagtgtctgccattgccagctggatgctggacatacacatctccctctcctcagtctggtgaagaatgggcctgcgctgtccaataggac

SEQ ID NO: 1551 - DNA, 2224 bp, Homo sapiens; identical to SEQ ID NO: 1550

SEQ ID NO: 1552 - DNA, 1593 bp, Homo sapiens
gctctgtccaagtgcgagctgcaatctagtcttgccttccgtctgccacttttccccctcttttttttttcttttaggctacgttctttattggtcaccctcaccgcaagaatgtgagagaggcacagtcatccctactttgtagatgggaaactgaggctctgtgaggttaagtcacttgctcattaagtggacggatggggccacactcagaactgggatcctatcccccagtccaagccttcactaccacaccaaaccattccagtattttgttgatgcttcaaataaaatatgatctgtgtatgaataaaaagattggaaggggctgggtgcggtggctcatgcctgtaatcccagcactttgggaggccaaggcaggtggatcacttgaggccaggagttctagaccagcctggacaacatgttgaaaccccgtctctactaaaaatataaaaattagcctgacagggtggcgggtgcctgtaatttcagctacttgggatgctgaggctggataatcccttgaacctgggaagcagaagaggttgcagtgagccaagattgtgccactgcactccagcttaggtgacgaaaagaaaattggaaggaaatttcacaaacagagaaagacctttcttcttactactttgagaaacctgtgaagtgaaatcattggctcatgatcacccatgtctcccaacatgagaaagcctacatgaggcccctggcacatccgaggtgtgtggggcaccggggcccccagaagaggagcctttggatctgatgggagcaagggctctactgaggctgccagagatgccctcggtaatgggggtgacatagaggtgccagcacagcctgtcaggcaacgagggaaggagggacggtgggtctgactcaaaggacacgagctgcctttgctgtagtgcaaccgtggcccattgctcattgtgctgctctcaggactcagagtatggaagcgggaccattgccgttacaaacccgcagggaaggggctgagcacccggagggctgtgtgtgcacacatgacgttatcggagtcaggaaggcagccagccgcgaggagatgggaaactggtccacggcacccggggagaccttcacagcccacgcattagccctcgtcagccggtgtcccggcgctccccacaaacccagactctctccttggctaacaatggcctccaccagccgacctctttgagcctctgtgttctcatttcttccatctgccacacatgatgccacaaggtccctgctctgtctctccaacatgccactcattcctgactcacagccttcatgctcacacccctcccttgtcctatcctcactctcagtcatcctgttcaatgccttcatggcacttatcataagctcttacgatcatgtttataggtctggtttcattgttgctgtaggggggtctgtctcccccatttaggcctaacaggccaggaatcttgtctgtctgatttactcctaacatatgttaagtgttcaataaatttttgctgaataaatgaaggaaaaaaatcatgcagcctctgagatgtcatgggatgacag

SEQ ID NO: 1553 - DNA, 1593 bp, Homo sapiens; identical to SEQ ID NO: 1552

SEQ ID NO: 1554 - DNA, 2882 bp, Homo sapiens
gacatcttcttgcctactctgcaggaggctggagccatgtctgagcaggccagacaacacatctacagggtgcagatgacctatgggcagccacactgtgatgcctgtgtgagggcctaaacttcagggaggaagaaagtgaggtcagatcctgagggagcacttgctctcctgcagcaggcatgggggagcacctgactgctgaggatggcttcggaacatttgtgtgaagagggataacagatgctgcatgccagagggatggtggccataggccgcaagattcggttcttctggccgcagaagaccctgacttcacctttcaggcctctgtttccttatcaacgaaataagagcatgtgattaattctgcaggtgcttccagcttggacttttttgcaaatattttcattcaactcactttagaaacctgcagggagtctctctttgcaattccagaaaaatcagcatttttgtcaaagacattttggatgcccatcttcgggaggatggtttccagattgtaggaggcagaaatggaaaatctggggatgaacacctctatccacctgtggagtagggaaaaggaaacaatgaggtcacaagcccatggtgtctgcatctctgctcctagatgccattttgggagactccgttcttcctccaaccactgctaatttctgctaaaaaggtcaacacatcctagccaagaaacccaggttgctcttgaaataagcctcccagctgagcaggtccagcactaaaaacatgcaaggagatagacgagcccccagtgaagtgggtgcagaggtgaaaaagcagtcagcaagggagtctatggcagaaaccaacaggagacgtccagtagcaatggaagctcatcaaccacccactcactgtccggaatacctcctcagcagcacttcctgatgcaagccctgctaataatgccctagagcagcaaagtccagcagaacttcctgtgatgctgggaagatcctagacctgcactctccagtacggtagccattagccatgtgtggctactgagcaacttaaacagtggcttgtgcaaatgagaaactaaaatgttaattttactacatttcagttaacttaagtgtaaattactgcaggtggcttagcggctactatattgaacagcaccacctgataatttagcacaatattttttttcctctgcaatggtttccctgaaccaagagtaaacagcccacatgtgttgaacttcttttttttaagatggagtctcactctgtcgctcaggctggagtgcaatggcacagtctctgctcactgcaacctccaccccgtgggttcaagtgtttctcctgcctcagcctcccaagtagctgggattacaggtgtacgtggccatgcccggctaatttttttgtattttagtagagacagggtttcaccgtgttgcccaggctggtcttgaactcctgagctcaggcaatccacccgcctcggcttcccaaagtgctaggattacaggcgtgagtccagcctgaacatttattatatgccagacattgtcccaggcacattcaacaacacttcccccttttaaagacggtaaagcttacttttagtgctttgcccaaggttatgtacttagtgactcacagcaacgaaagcacaaaaatattggatggacacatttcagtcctcatctgacaggtgtcttgtgacccctcatgccagggacagctctcttttccctgccactgtcctctttccctgttttctctgtgctccatctgctgctctgtactctgtccctccctccctgaaattctgtgccacctcctcttcctatccccagccccagatgcagcctgagaagagaagaaatcgctgacacaccctgcagcatctcttcatccttaactttgagtttttgccagtgctgtgtcctctaccaaagctgcccttgccaagcctctgtgtgctcatatgctacccacatgtgcagctaaaccccaccgcctccttgaagctgtccctcagtcccagctgaaagtgatctctctctgctcagaaactcctcagcacctttcctgccctcccgtggggcattgcccaatctctttcttgaattccagttacactgcagccttccttctctcttcccagactatgagcaccagggaacgctgctaaaatcattctaagatgccaaaaatatattgctaagagacagaacataaaacgtggacattccttttttatctcatgattaatctttttgctattctccatattttttgtactcaccatactaattacagaactaataataacattattagctagcatttactgaacacttactatcttctaggaattcttctaagcactttgtaagtagcaggttactttaccttttcaccaacctttggatttggtaatattgttatcctctttcttatatgtgaccaccaatgcttttgtttgctagcttttatgggatcattccatagatttcaatatcagataggcttctagagccagctctgcaagcatataacagctacatgaccttgggcaattcacttaccccttggagcctccatttcctcatctgtgtaatgagtggtactaagactcctcatcaggtgatagtgaacttcaagtgtgaacatgtatagacagccccaggctctctgtcctgcatgcagttggtgctcactgtgcagaagtgattatccaacagctgttagcacaatctctccctcatctttgaatgtgtgcatcccctgcctcagggcccaggagattgacacagatgcccaccttttctggagtgagtggctccactttctcagtgttctggctgacaaggcctgttccag

SEQ ID NO: 1555 - DNA, 6029 bp, Homo sapiens
cacaggcatttatctcagatgaagtttcaggttggactcattcttctgccccaacagcagaatgactcattgagccattgagccattcagcacattctctatatggcagattcggtgctgtctctggaaatacataaacatagagcgattcctttttctgttgaggcaaaatatggatttggttaatttctattcacgtcatgaatgtggtatgtggaaggtcttctgagagcagaaagggatgtttcacagcacagcccggctgtgtggtgctcagggcaggccctctggaggaggtgagcctgggctcttggcctaatgtttcagctctcactttccagtcctgagctgttgttgccagtccatctttcatgagaccattggagtgatctttctggtcttgtcacttcatggtttaaagtttccctgggcctacacagtgaagtccaaattcagcatggtattacaagacccttatgatccagtcttaaccattggttaggtatcctacccatactgtttatctcttgaatacctctatgctctttgacaagtccagcccctacgtgttcatacctcacttctgtgacacagccttgcttcagggctcccaatctctgtagcctccctgaactgtgcatttgctctgctgcttgatttgtttctgtgactgttccattctcctcgggacacatagcagggaccttgtcttggtccttttttttttggctttaacagaacatagcaaagaacctgacataggtgtagtctgagtttaccactggggttatcacagaggtctgctaagtgaatacaacacagtggggacccagaacctctagaaagggttgaggattacaatccccagatagctacaatcagggaataatgtaacctgtttgcctagggtgctacatggtaatcttgaattagaacaactgagacttccatgggaccttagggtgataaccattaaacctactctttcagtgtttactttgtaaaagcatcacactaaggaggttgtcatttaatcctcacacctaccctgggttattaacactgttgatgaagaaagccttacttggctaagatatggagcaggttagtaagtggtagaatagatactccagtcctgtctccaaaatgcaaatttttttttaattaaaaaaatttctaattttcaatatatttatttttgattttttattttctgtagagttggagtttcgccatgttgtccaggctggtctcgaactcatgggtgcaagccataccccaacctcgaccttccgaagtgttgggaatactggcatgagccatgatgcctggcctcaaaatgcatacccttaaccactatgctctcacatttttagatgtgggatttctgtctacgacgtcgcccccactaagacctagggcttaggtgtcgaggtgggaaagatcttgaggcttttcttctcaaaattaatcagaaacgatgtgaattttatatctctttctgaggttttccccataagctaatcgggattagtagacttaaaggtgaatgaccaactgtatccctggttcactggttaggaagagtacatagtctttgtgtataggctattttcctcggtaaccttgggcaacatgcttgacttctccaagccagtctcctttgtgaaaggtgatatacttacaagacattatattaaatgagaacccaggcaggttacctaccctaccatgacactggaagtattctttgccttaagaaaaggagaattgctggttggttccaggtccggtgggtaccctcatttcccctgggcaattttactgtaaaaatagaccaaggatctcaaggcccagtggcttttgccttctgggatacttttttacctccctgtttagtagtaagggtcacattttaaattgcagctatcacactggagggatcagatcatttagaactttgactgcttaaatattactcttgctaagatcttgagcttgtctcatgttgacagactagtgaagttggttacgttgtctgtctcctcactggagggagagattcagagttgccctgtccaacccagtgctatctctggaaagggttggattgaaatctagtctgccttcattctgaggtataatcatgagggttaggtgaaagggtcccgagtgagaagatggcatgggtcctagggtggggagcccgatgccaagtcagacttcactcggtatgtttattcaaagccccactttcactcgtagcatatcataggtggtctctgcaagttgctgaccctgattcagactgttccataaaagtcagacacttggttttagttcccaaactgattttgatgacattcttgactgcagggcttggagttaaccccactgggcctgagttgtctctctgtaaagttacacatcatttcagactcaaaggcctctagcatgcagggtctggtgtcataataggcaccaatgggaaccattactgtcattgccttttttggctttaatcttcccaattgtaagttcctttcatgtttaaaacaagtttaaaagacagggggacttaggcatgctcaggcagtctagcctttaatgtaagaatttcaaaacataaaggaaaaaaaacttttttttttaagcagtactttgtgagttacaagacagcagcagctccttagtgttgattgccgaggcctttttggtttgaaaactctgcttcctttgtgaatttggtgttaggagttcttattgttattctgcagcctttactattgtcctttatttactgaacacagtgaataccaagcactgtttattagaggttaggagtaggggcaggtgattaaaaaaacaaaaaagctaataatctcctcaagcaatttctggcctaatagaattatagtagacagtgaagtatctaaacccagggaatcagattgaggcaccatgtccatcgccttgagaattaataggctgcatttctgggttctcctttttttttttttttttgcccaactgagtctttctgtggacttacatggaacttcttattctcttaaatcattaagttacttgacaatattcttggatttggagaaactggatgtagggccgtatgaaaaaatcattcgaaatcagatttaggggtataaggttggataggaatgttttagaaagaagaatgtaaggcagataactaatttgtcacatccaaagtataaaactgctactttttccctagaaaagggaagctcattttaggcagcctaaaccagtaagattttcttcctcctccaagtgcagatttttgtacctttcgtttgtcaaaacattctttggccctatgcatgccagagtgatatagaaaggaagttaccacatttttttgagaacaaatcactcctgataaaatttcttagacaattgataatcattttaagaagaaatttaattgtatttagctctgtgtctcgcccctttggtgtcactcttctacctcttccatcactatagctaaatatttagaagtatatcttgacacctagcacaaatgttttggttaagtatcttaaaactgatggatggtatggctggggcagcatggctcacgcctgtaatcccagcactttgggaggccaaggcgggtgaatcacctgaggtcaggagtttgagaccggcctgaccaacttggagaaaccccgtctctactaaaaatacaaaaattagtcaggggtggtggcgcatgcctgtaatcctgtctactcaggaggctgaggcaggagaattgcctgaacccgggaggcagaggttgcagtgagctgagatcgtgccattgcactccagcctgggcaacaagagcaaaactcagtctcaaaaaacaaaacaaaaacctgttggtatagtacgaaagaaacgtcttgcagttttctgttgcagagaattaattagaaccaacctgttggattatacacattcacctttcagaatcctttcttctctgtggaaacccacactctcagcagtgtgtgggaacacagtagattcttaaggaatgcttgttgaatgttgcagtctgcatcttcttgaagtaacagaactgttggtagctgtttaaaagtaaaatgtgtctaaagaccttttggaaattaagatgtaagagattaatgcaccaaagcagtctcttaattacttaaaatgaattatttcaaagaatctttaattgaattttctgtgaagtctggaatttgtaaattatgtccctttgttcaaaccagcccctgaaaagaacaattaaggcaattaagatagcattaaagttttcaatgaagttggcattttctgtgtattaagattagatgttagctgctgaagtttgtggaggtcggacataaagcttccaacatcagtaatgcaaaattgtcttgaacctgcgataaaattttgttggacttttttttcattgcagtgaaaagggccatgtagcatgcctcaaagccaggttactcagcctagtccttgtttaagcagttttgatattcattcaagttcaattttctcactgattttatgattaatttcttggaaaatttgaaagttttcaagaagtaaaaaattaatatcttgttatcccagtatatagagattaacttcagttcaatgtttggtgcattttcttctagtctttttttcaatgtataaatattaaagttatttcatagttgagatcatactgcatatatgattactgtatcttgcttttttcattttaacgtcgtgagcaattttcccatgacattacaaactgtctttgaaaaatggaaaacatttggggctgtcagcataactgaaaatgttttcttggtgtgacacatgtatctttgtaattggtttgatttagtgtgctttatttcaataaaaattcagtattataatttacagattggggtggggagtggtatctacttcaaattactgaaatcttcctagtagaattcctttttaaatgtttgaactcccctggtacatcttaaacacgacattgacactgcaagtgcttggatgtcctggcacctcagaacacaactttgtgcaaaaggagtgctgtgcatctgaatagtgcaattcatttccaatgcaagaatgccagtttcttagggcccccggtcaggatattacccacttggtttaagttgtgatttcaaatcccattttctatgggagatacactggtggaacaaatctgcagagggccctgcacctgcgctggtggatcaacggtgtcttctcacctccagggctagctgccttgccttccctcgtggggcttaagtggctgggaagcagatagacagtgtagatgaagtcctgggccactggctgctggactgaggcagtgagatgactgggctggcatttgttctttctctgcctgtgtgtgacctctaactatgtgcctggaaactgaattacatgtaattaatgctgcaaacaggattttcttattgcctaagcatgaacttggtatgaaaataatagttaataatttactatgtaacttggattcttataacctggactgtaagtttgttttagctccagtgggagtttccttttcaaagtatgatgaaaccatcctcatcttttctacccctggactaatcatttaaaatggatacagacactttaaaactgctgagtttatcttgtgttaagcaattaagacttctctgtctaatcatgctacttgttctgcttttgtcaattgatactctcatagcccttttgaaaaagtatgtttttgtagaaattaagttgtatgccctcaggacgtacaacttggttttttttttttgttttttttgtttttttttgttttttttttagttctgaagcatgtttagatttttctgtacttgtataggtctgattgtttatgtggcttagctaaggtttcctaaagcatcttctagtagctgtcattggtttgtaaaataaaatttgggctgtcaaaatgc

SEQ ID NO: 1556 - DNA, 404 bp, Homo sapiens
gggatgttcgtttatttgggcaaatgtgtctcgttagggtcattctgaaaagaagcccagtgtgcagtcattagcccctggggtagcgttgctactaagtggttggggagaagtcagggaagaggaagaggtggcgttccccagcctcacccgtggagaccccagcgaagcgggggcagggagggatgatgaaccctcatcctttacctccttctccaaccctccactagcgctgctttcctggtcaaacctgcatcttcactgggtcatgccccaaggcctctgagggacttccacagtggtaaggagggctgccctttttatttttttttggttgtggctgagaatgctggagatgctcagttctctccctcacaaggtaggccacaaattcttggtggtgc

SEQ ID NO: 1557 - DNA, 404 bp, Homo sapiens; identical to SEQ ID NO: 1556

SEQ ID NO: 1558 - DNA, 404 bp, Homo sapiens; identical to SEQ ID NO: 1556

SEQ ID NO: 1559 - DNA, 404 bp, Homo sapiens; identical to SEQ ID NO: 1556

SEQ ID NO: 1560 - DNA, 404 bp, Homo sapiens; identical to SEQ ID NO: 1556

SEQ ID NO: 1561 - DNA, 404 bp, Homo sapiens; identical to SEQ ID NO: 1556

SEQ ID NO: 1562 - DNA, 1604 bp, Homo sapiens
cacaaaccctattatgttcgttagggaagatggcttgtagttttcttttctcattgtgcctttgtcaggttttggtatcaaggtgatgctggctttgtagaatgagttagagaggagcccctcctcctcaattttttggaatagtttcaatagaatcgataccagttcttcctttgtatgtacagtaaaatttagctgtgagtccatttgatctggggcttttttggaattgctgaatcatatggaaggtgtattttttaatggaggtgaatcacttcaaagagaaggaccagattctcatggaccccactgccatgctggccagacatcttgctgccattgttttcctgttatttactcccaaacagatggagtgtcgctctgtcacccaggctggagtgcagtggcacgatctcggcttactgcaagatctacctcccgggttcacgccattctcctgcctcagcctcccgagtagctgggactacaggcgtccgccaccacgcccggctaattttttgttttttttagtatagacggggtttcaccgtgttagccaggatggtctcaatctcctgacctcgtgacccgcccgccttggcctcccaaagtgaagtctcttttcaaaatcttaatgcttacctgtgtttcttttatgaggaacgtcacggaatcaagagtttttgtcttcattcttattaacttgtaaaaattctaagttaaagacataaccctttgttgtatttgttgtaaatattttgaaaatttgatgtttctctttacattttgttttcgtgactttttcaagtctaatatttaggtataatggacgtatgcccattaaacctgtgacttccttttattagtcttctagccatagtattctgcttagaaagatttagcccaaatttttaaaaatattctccttcttattcatcttgttattttttattgttatgttctaattcatatttaataattttggtatgcatgatatgcatctctgtcataccaaatggaggattaattgtccctgaatttacgtggacttagccctcagtctatataatttccttcctaatcttcagcataaatccatacctcatactgtttctgtaaaatacttgtcttctctgtttcatccattattatgattcacatcttatttggccaaatttaattcttaagcaactcttttcagaataacatgattggtattataccttctgagcctttaatgaccaatataggtttttttttccctcagagatgaagaataggttaaatatgccagaatttcctaaatactccactgactctccaatgagattttaacatattttaaagtagaaggggcactgttgtccaataaatttgggaaagtgtgttaacagaattaaaactctttttgatgtgtgcgtttacgtttgaatttattgcagggtttctcagagctcttaataaaacgtggtgttttatgtttttctaggaaataaatgtaatatatattacatttataagtacgcataaagtaggcataagatagggactcccctccacttcagactgggcaaataggaagaccccaagtgtatatacggaag

SEQ ID NO: 1563 - DNA, 4273 bp, Homo sapiens
tttttcaatgcaatgagaaacagctgtgcttgggaataaatgacaacgaattttttttatctcaacagctgtcctgagagcatgtctctacatctctacctgcattctggattcagggagaaagccaaaacggacgacaagacactagatcagccgtgtccagccctttgattacaaggacttttccacctatctgtggtggaaaccccttgaggttaagaccccacaatcacatgaggatggagtggctcaccctcagtcaacaggccagactcaaggggttcctggcaagtcatttctccctcgggccttcggtttcctcacctacaagatgagagggctggaccagatggaaattcagggggtaaggggatgtcctcacgcagcccacccccacccccacgggaccctggagcctccatcccagttcccaccacgcacccgctccacaaatcctgcccaaggtaactctttcctgataaggcgaattgcttgcttccttgaattctgctctcaaagatacccttcattttctacctaatattaataactttaatcattcattattccattactatgctctatagtgtatacaatttctgttctttgtcatgttattaactaaattatttattgggtccagtaacgtattccataaatattgtacacataaaaattgtgttatttttattcctgtatgctcagctgcccaataacagtctgaggattaacatatttgttaaatgcacaaatacattctttcacaaatattagtttaataattttatattaaactccctctatacttacaatatgaattagataattcagaataaacattccattggaaaaagctacacaatttgttataaaacatccttaaaagcatcagaaaattaatacagcaatgaagaattacaggaccaaattaagaatggtatgaaagcctgtttgtgacgcttatgtttgggttatctctttatttgagtgactataaatctcaaaagagaactaaagggagaaataaccatatctactaacatgctaagggtacttaaacatctcttagtaattgagaaaattgaaagaaaagaaaaaagagaaagggagaaagagaaacagcgaaagggataatgaaggcgagaaagaagaagagaaaggaagaggaagaaaagtaaaaaggaggagggggaaggaagaaggaagaaaggtgaaaagaaagaatggtaaactttttaacaacataatttatccttctagaatatgaatgttggtctatttgatgatgtcccacaaattcattagtctctgctcattgtttattttttattctttctgtttctcagagacagtattttccattttcttctcttcaagttcatggcttcctctgtgtgtgcaaatatactcttaaatccctctggtgatttttaaatttttatcattgtagttttccactccagaatttgttatctctttgctgatattcctactttttaatattttttctgattcctttatttctttgtttatgttttccttttgacatttgagtataatgaagagagttgttttaaagtctttgtctggtaagtttgatgtctgggtttccttagggatattttctgtcactttattttgttcctttgaatgagccacactttcccattctttgtatgccttgtaacgttttttgaaaactggacattctaataattataattactatgtggttactctgtaaatcagacctccccctacaaacacagtaatgttttgtggttttaaattttctttacttattatattgttaaggatttttttttttagtgaaattttccaaagtgatttacaaaactgtttggtttataaggtgtggtcaccgaagtctttttgtttccttaacaaatgttaagctaatgttttgacagtgattttctggtatgtcaggaaccaatcaaacaggcatatacaagaaaaacaaaaagaaaagcaagtaatcattgtccagcaaaatatgtctgtaggccatgcagactggctttgtgctgggttctttaaagccggcacaaagtgtgtgttcactcttgcactgagtgaagttcaagttcactcttgcacagagcttgcactgaggggagggatcggccaaggtaaaagtgtagggtcttcttatgacatttgtcagcatgtggcttaacctatgaatacgtgtgactttgtagactctcccatgtacgtgaatgaggcgtgagccaccacgcccagcagatttatttattttttaatctttctttttttttttttaggcagagtcttactctgtcacccaggctggagtgcagtgacacgaccttggctcactacaacctatgcctccccagttcaagtaatcctcccaccttagcctcctgagtagctgggattacaggcgcctgccaccacacccagctaatttttgtgtttttagtagagacagggtttcaccacattgtccaggctggtcttgaactcctggcctcaagagacccacccgcctcaggctcccacagcgctgggattacaggcatgagccgccatatctggcctatttattttttaatttttcaaatgagaaggttgggttaggtaatttttaaaaatcgcttcaagtttcttaactccacaattattttcctgagactcttgcaagcaactgatctttataggtcatgcctcaaattcccaattgatgtcatctgggcaaatcagtccaatgacagccacaagtggtcagaaagctttcttagcagccctcttggtcactaggcacactacctaggagtcaagctgtgacaagaggctgcttcttaaacttacaaaagataggatcttccaggatgtgctgctctgatgtttttgaagggcatagagaaacacacgggcaatgtttgcagaggcaacagactaaagaaagcacatctatagttgtattggctttgtgtgggttgtatggtaaacaggtagtcaccctgcttaatgtgggtatcccattttccataaatgtctatttcaccaccccaaaaagccctcttatcatgaaattaatcatctgatgcacttcaagtaccagtcacaaaaatgatgaactcaggcagaattccactgctagacaagcccagacaaaaactgttactgttagccaaggaaatttgcacacaattttgataagtggcactaaagccacataagacaggaaatgggttagaggacatcaatgtattgagacagaaagtgaaagggtgggcaggatttgcgaggttaccagtttgaatatggccattcctgcttttactaaaggtcaatttagaatacaaatgttacagaattcatttagagccaaaaagtaattctgacaaagactgtcttaaaatgcaagatttttaggtccaaaatttcttacgtaacctaaaaaatggaaatcttcacaatgtaatgagattgggtcacttaaatagtgttatatctaaccagtccagacagaccagctaaacaatcctattattaaaagcctctagagagtgttcaacaaactccttagataatgaagcttggggcagcaacacatccctcattatagtcagaaagttctcttaacatgtgagccaggttattgcgtgcatttatgttttcccacatgctgctctttcctcaaggaatgcgattctcctccccgactccctgcctggttcgctcattcttcaagatcaaacacaaaagtcactgtgtgtgtgatgcttctccaattccactcatcctggctgccattcatgcactagtgcatgtatgcatttttacattttttaaattacaaaaatcaacctattataactgcttagatatatatgaagtaaaaatgaaagttctccctttacatgacccatcccccatcatttccctctttatcttatactgtcagcattcccagcttgtagcacagtgtctggcaatagtaaatcctcaaaaaatgatcaatgaataatttaataatgattaataaataaattaatgatgatggtgaagataaatttttagcatttattgaacgctaactacaaaccagggagtgtgttaaatattttataaaaatcaatgaatgagctaaaatgccattctgttatttttttgtataggttttaatattttactcataaatatgcttaaagaatattataattatatgacttagattgtaaaacaatatgtacagcagtgtcctattttttagaataaa

SEQ ID NO: 1564 - DNA, 4273 bp, Homo sapiens; identical to SEQ ID NO: 1563

SEQ ID NO: 1565 - DNA, 4273 bp, Homo sapiens; identical to SEQ ID NO: 1563

SEQ ID NO: 1566 - DNA, 4273 bp, Homo sapiens; identical to SEQ ID NO: 1563

SEQ ID NO: 1567 - DNA, 4273 bp, Homo sapiens; identical to SEQ ID NO: 1563

SEQ ID NO: 1568 - DNA, 32757 bp, Homo sapiens
tttgtaatttctttattagctagttcattactgttatacagaaactactgatttttgtgtgttgatgtggtgcctttcagctttcagctaataagtgaattcattcattagcatcagtagctttttcagtggattattttggaaatttcatatgtgtagaataatgtaatctgtgtgtagaaatagttttacttattaggctggcacagtggctcatgcatggaatcctagcactttgggaagtcgaggtgggaggatcgcttgagcccagaagtttgagaccagcctggacaacatacacaatgtctttacgaaaaagaaaagggaaagaaattagccaggcatggtgtcaggcctctgagcccaagccaagccatcgcatcccctgtgacttgcacatatatgcccagatggcctgaagtaactgaagaatcacaaaagaagtgaatatgccctgccccaccttaactgatgacattgcaccacaaaagaagtgtaaatggctggtccttgccttaagtgatgacattaccttgtgaaagtccttttcctggctcatcctggctcaaaaagctcccccactgagcaccttgcgacccccactcctgcccgctagagaacaaaccccctttgactgtaattttcctttacctacccaaatcctataaaacagccccacccttatctcccttcgctgactctcttttcggactgagcccgcttgcacccaggtgaaataaacagccatgttgctcacacaaagcctgtttggtggtctcttcacacggacgcgcatgaaatttggtgctgtgacttggatcgggggacctcccttgggaggtcaatcccctgtcctcctgttctttgctccatgagaaagatccacctacgaccccaggtcctcagaccgaccagcccaaggaacatctcaccaattttaaatcaggtaagcggcctcttcttactctcttctccaacctctctcactgtccctcaaccactttctcctttctactcttcaatctctcccttctcttaattttaattcctttcattttctgggagagacaaaggagacacattttaaccatggactcaaaactcggcgctggtcacggactgggaaggcagacttcccttggtgtttcatcattgcagggacgcctctctgatcattcacccacatttcaaaggtgtcagaccatgcagggacgcccaccttggtccttcacccttagcggcaagtcccgcttttctgggaaaggggcaagtaccccaaccccttctctccttgtctctaccccttctctgcttttctgggggaggggcaagtacccctcaaccccttctccttcacccttagtggcaagtcctgcttttctagaggaggggcaagtaccccaatctcgtatctctgtgccccaatcccttatttccgtgccccaacctcttatatctctgcgccccaatcccttatttccgtgccccgaccccttatttctgtgctctgaccccttatttctgcaccccatcccttatttccacaccccgacctcttatctctgtgccccaaccccttttcccacttttctggaaggtaagaacccccaaacttcccttcatttctctactctctcttttctccaggcttgcttccttcactataggcaaccttccaccctccattcctccttctactcccttggcctgtgttctcaaaaacttaaaacctcttcaactcacacctgacctcaaacctaaatgccttattttctactgcaatgctgcttgaccccaatacaaacttgacagtagttccaaatagccagaaaatggcacttcgaatttttccatcctgcaaaatccaaatacttcttgtcgtaaaataggcaaacggtctgaggtgcctgacatccaggcattcttttacacatcagtcccttcctagtctctgtgcccagtgcaacttgtcccaaatcttccttctttccctcccacctgtcccctcagtaccaaccccaagcatcgctgagtctttctaatcttccttttctacagacctatctgacctctcccttcctccccagcctgctcctcaccaggccaagctaggtcccaattattcctcggcctccactcctccaccctataatctttttatcgcctcccctcctcacacccggtctggcttacagtttcgttccgtgactagccctcccccacctgcccagcaatttactcttaaaaaggtggctggagccaaagtcataatcaaggtgaatgctcctttttctttatcccaaatcagatagcgtttaggctctttttcatcaaatataaaaatccagcccagttcatgacttgtttggcagcaaccctgagacgctttacagccctggaccctaaaaggtcaaaaggctgtcttattctcaatatacgttttattacccaatctgcttccgacattaaataaaactccaaaaattggaatctggccctcaaaccccacaacaggacttaattaacctcaccttcaaggtgtacaataacagaaaaaagttgcaattccttgcctcctctgtgagacaaaccccagccacatctccagcacacaagaacttccaaacgcctgaaccgcagcagccaggcgttcctccagaacctcctcccccaggagcttgctacacgtgccggaaatctggccaccgggccaaggaatgcccgcagcccgggattcctcctaagccgcgtcccatctgtgtgggaccccactgaaaatcggactgttcaactcacctggcagccactcccagagcccctggaactccggcccaaggctctctgactgactccttcccagatcttctcagcttagcggctgaagactgacactgcccgatcgcctcggaagccccctagaccatcacggacgctgagcttcgggtaactctcacagtagaaggtaagcccgtccctttcttaatcaatacggaggctacccactccacattaccttcttttcaagggcctgtttcccttgcctccataactgttgtagatattgacagccaggcttctaaacctcttaaaacttcccaactctggtgccaacttagacgatactcttttaagcactcctttttagttatccccacctgcccagttcccttattaggctgagacactttaactaaattatctgcttccctgactattcctggactacagctgaatctcattgccgcccttcttcccaatccaaagcctcctttgcgtcctcctcttgtatccccccaccttaacccacaagtataagatacctctactccctccttggtgaccgatcatgcaccccttaccatctcattaaaacctaatcacccttaccccactcaacgccaatatcccatcccgcagcacgctttaaaaagattaaagcctgttatcgcttgcctgctacagcatggccttttaaagcctataaactctccttacaattcccccattttacctgtcctaaaaccagacaagccttacaagttagttcaggatctgcgccttatcaaccaaattgttttgcctatccaccctgtggtgccaaatccatatactctcctatcctcaatacctgcctctacaacccattattctgttctagatctcaaacatgctttctttactattcctttgcacccttcatcccagcctctctttgctttcacttggactgaccctgacacccatcaagctcagcaaattacctgggctgtactgccgcaaagcttcacagacagcccccattacttcaatcaagcccaaatttcttcctcatctgttacctatctcggcataattctcataaaaacacacgtgctctccctgccaatcgtgtccgactgatctctcaaaccccagcaccttctacaaaacaacaactcctttccttcctaggcatggttagtgcagtcagaattcttacacaagagccgggaccacaccctgtagcctttctgtccaaacaacttgaccttactgttttagcctagcgctcatgtctgcgtgcagcggctgccactgctttaatattttagaggccctcagaatcacaaactatgctcaactcactctctacagttctcataacttccaaaatctattttcttcctcatacctgacgcatatactttctgctccccggctccttcagctgtgctcactctttgttgagtctcccacaattaccgttgttcctggcccagacttcaatctggcctcccacattattcctgataccacacctgacccccatgactgtatctctctgatccacctgacattcaccccatttccgcaaatttccttctttcctgttcctcaccctgatcacgcttgatttattgctggcggttccaccaggcctaatcgccacacaccagcaaaggcaggttatactatagtacaagccactagcccgcctcttagaacctctcatttcctttccatcgtggaaatctatcctcaaggaaataacttctcagtgttccatctgctattctactactcctcagggattcttcaggccccctcccttccctacacatcaagcttgaggatttgtccccacccaggactggcggattagctttactcaacaggcccgagtcagaaaactaaaatacctcttagtctaaatagacactttcactgaataagtaaaggcctttcctacagggtctgagaaggccaccggagtcatttcttcccttctgtcaggcataattcctcagtttagccttcccacctctatacagtctgataacagatgagcctttattagtcaaatcagccaagcaggttttcaggctcttagtattcagtgaaacctttatatcccttacggtcctccgtcttcaagaaaagtagaacggactaaaggtcttttaaaaacatacctcaccaagctcagccaccaacttaaaaaggactggacaatacttttaccactttcccttctcagaattcaggcctgtcctgggaatgctacagggtacagcccatttgagctcctgtatggacgctcctttttattaggccccagtctcattccggacaccagaccaacttagactgtgcccccccgcccaaaaaaaaacttgtcatccctactattttctgtctagtcataatactcctattcaccgttctcaagtactcatacatgccctgctcttgtttacactgccggtttacactgtttttccaagccgtcacagctgatatctcctggtgctatccccaaactgccactcttaactcttgaagtaaataaataatctttgctggcaggactatgctgaatctccttaggcactctctaatcagatgtcctaggtcctcccaattcttagaccttttatacctgtttttctccttctgttattccatttagtttttcaattcatacaaaaccgtatccaggccatcaccaatcattctatacgacaaacatttcttctaacatccccacaatatcaccccttaccacaagacctcccttcagcttaatctctcccactctaggttcccacgccgcccctaatcccgcttgaagcagccctgagaaacattgcccattctctctccataccaccccccaaaaattttcgccgccccaacacttcaacactattttgttttatttttcttattaatataagaaggcaggaatgtcaggcctctgagcccaagtcaagccatcgcatcccctgtgacttgcacatatatgcccagatggcctgaagtaactgaagaatcacaaaagaagtgaatatgccctgccccaccttaactgatgacattgcaccacaaaagaagtgtaaatggctggtccttgccttaagtgatgacattaccttgtgaaagtccttttcctggctcatcctggctcaaaaagcacccccactgagcaccttgcgacccccactcctgcccgccagagaacaaaccccctttgactgtaattttcctttacctacccaaatcctataaaacgaccccacccttatctcccttcgctgactctcttttcggactcagccctcctgcacccaggtgaaataaacagccatgttgctcacacaaagcctgtttggtggtctcttcacacggacgcgcatgaaacatggtgacacacacctgtggtcccagctactctggaagttaaagtgggaggatcacttgagcctgggaggttgaggatgcagtgagctgtgattgtgccactgcactccagcctgagtgacagagtaagaacctgtctaaggaaaaaaatagttttacttctttctttctaatttggatgccttttatttttttatgtttaattgctctgcgtaggggttttagtgcaatgttgtacagcagtggtgaaagcagacattcttgttttgttcctgaacttaaggggaaagatttcagtctttaaccatagaatctgatattatctgtaggtttttcatagggaaattcccttctgtttctagctttctgagtgtttttatgatgaaaggtagcagattttgtcaaatgtctttttctgcatcaatcgagatgatcaagcatttttcctccctttattaatgtgttgtattacattgttccttttgttgttgttgctgttgtcattgtttttggtggtggtgttgaatcactcttgcattcctggaataactaccgcttggttgtagtgcataatctatttaatgtgctgctgaattcaatttgttagtacttttgttttacaaaggatgttgatctgtaattttctttttttttttttcttgttattttcttttcttgtgatttcttttcatcacaagaaacctgactttggtatcaggttaatgctagcctcatggaatgaatcaggaagtgttctcctctctttcatttctggaaagagtttgagaagaatgggtgttcattcttccttaaatgcttggtagaatccccagtgaagccatctgtccctgaactgttctttgttgagaggtttattactgattcagtgttttcatttgttataattctgctcagattttatatttcttcttgagtcagttttgataatttgtttttttctgggaatttgttcatttcgtttacattatctaatttgctggcgtataactgtttatagtatttgtttaaattctttttgtttctgtaaggtcagtaataatgtcttccacttttattttacttatttgtgtcctctttctttgttgtcaatctagctaaagatttgtcagtttttaagatcaatttttagttacattgattctattgattttctattctttattgcgtttatctctgctctaatcttcattattttcttcctttgctagttttaggtttatcttattcttctttttctagttccttgaggtgtaaagttaggttattgatttgagacttttcatcttttgtaatgtagatgtttacctgttataaatttccctctgaatactacctttgctgcatcccatacattttggtatgttgtgtttctcttttcaattgtttctaagtattttctaatttcccttgtcatttcaactatgaccccctgttgcttaagagtgtgtcatttaacttgcacatatttgtgaattttctagttttctttctgttattgatttatatctttattccattgtggtcaaagaagatactttttattatttcaattcttttaaatttattgagacttgttttgtacctaatgcatggtccatcctagagaattttctatgtgcacttgagaagaatgtgtattttgctgttgttgcatatgatattctatatatgtctgtttctagttgtttatacaattgttaatactctctattttcttgctgatcttttgtccagatgttttatccattattgaaagttgtatattcaagtttccagctgttattatagaattatctatttctccctttactttagtcggtgttagcttcatatattttgggactctgttgtttggtacatatctgtttataaatgttaaatctttttgatgagttaaccctttaatcaatatgtaatgcccttctgtgtcttttttgacagtttttgactgatgtctattttgcctgatacctatagctgctccagctgtcttttggttactgtttgcatggcatatatttttctatcgtttcactttaaatttatttgtgtctgtttggatctaaagtgggtcatttggagacagcatatagttggatcatttttaaaatatctattctttcaaactctgccttttgattggagattttaatccatttaattttgaggcagttaaggaagaacttacttttgctctttttctatatgttttctgcatgttttattactgttgtgatgctcattttctccattactgcctcctttgtggttagttgattttttttttcacaccgttttgatgccctgcttgctgagttctgtgtatactttttaaacacagtctcagggattgccagggggattatatttaccatcttaagtttgtagtgatatggttagaacggacacctatttaacttcaatagcaaacaaaaactcttcttctatacagctctatccccttttatgttattgttattgttacaaattatatcttcatatattgtgtgcctaacataaaatataaagatactgtgaaccctgaaaatctgagagaggtcttagttaatttagaaagtttattttgccaagattgaggatgtatgcccatgacacaacctcaggcggtcctgatgacatgtgcccaaggtattaggggcacagcttggttttatacattctagggagacatgagacttcaataaatgtgtgtaagatgtagattggttcagtccagaaaggtgggaaaacccgaggcaatggcaggacaactcgaagcagggagggggcttccaggtcataggtagataagagaaaaatggttacagtcttttgagtttctgattagcctctccaaatgagataatcagatatgcatttacctcagtgagcagaggggtgactgaatagaacgggaggcagatttgccctaagcagttccccacttgacttttccctttagtttagtgatttgggggccccaagatttcttttcctttcataatacatattatctttatgtagtatgatatatatatatacagataacatagatttgcaatgattttcatgcaattatctttaaatcatgtaggaaataaaaagtgtagttacaaacaaaaaatgcaataacactggttttaatatttacctatttagtaaactttattgtagatatttatttcttcttatagcttcaggttattgcctggtgtccttctgtttcatcctgaaggactgcccttaacattccttgaagggcaggtttacaggtaacgaattttctcagctttaaaaaatctgcatatatcctaatattttcacctttggaagatagttttaaagtccttagttgacagtttttttgtcagcactttaagtatgtcatcccactgccttgtggcctccatgccttctgatgagtcatcagctattatccttgttgaggatgtcttctgcatgacgagtcatttctttcttgctgattcaaaattctgtatatgggtttgacagtttgattgtaacatgtttcagtgggattctctttgagtttattgtatgggagtttgttgagcttcttgaatctgtaaattcttgtcattaatcaaatttagcaaagattttggccattattttttcaaatattctttctaccccatctctctttctgttctccttctgggactccataatgcatagctggtccacttgatggaggcccataggttcttatgttctggttacttttcttcattctttttttctttctgctcctagactggatacttttaattgttctctctttaagttcacttagtctctttttggcttgctctaatctgctgttgaaaaactctactgcattttttatttcaattattttactttacagctttaaaatttctatataggtcctttttctaatttctgtatctttattgatatcatcattttgctcatatatttttctagttttttttagttcttatgtggttttctatagctatttgaaaataattaaaacagttgatttaagattgttgtagagtaatgctaatgacttcacttcttcagggattgtttctgtgaatttgtttttttcttgaaaatgaaccagagttctttgtttctttttatgccttacaatttttttgttgaaacacggacatttgaatattacaatagtttaactctggaaaacagattattccccttccccaggatgtgctctttttgattgttgaaggctacacacatctgtttctttagtgactcttttaggctgtttttccaaagactgtgtattcttcattgtgtgtccctgaaacttctattcctttaccttgtgttcagttgttgttctgatacagatttccttgaacatcaagagctaacaatattaaacaagtcaaaatataaaataaaacaaaaaactccaaaccccacctcttccatctctgtggatgactctatgttaatgtactccttcttcaacacttcagcacttagtcaggctctttacaaccctgcctcaatctttctttcctgcttgcactgagtctagagataaaaagtgaaagtttagggtcttcccagatgttttctgagaatgcattcttccttgggcatccatgtgtctttctagattttccagtatacacaggtgcttttgaatgcccaaatttccaaaagaaactatcgtcattttttctcccaggctttaggtgttctattgtaaaccttgactgtaatattttgctcaaggcagctgtgagtttctcatttatcttgcattgattttgagcaatgcctgccacttttttgtcttgagtaagctccacattaggcaaaacagagatgagcaccttgcatcagttcttcaggtagccctcaacaagttagagcagacaaacagaatgatttacacataagtcttgctgtgttctctctggaaccagggatcagcatcccaccctggggatgcaggctgccatcctaaagacctcttctcagttggggaggggttggggcaagtgcaaataaaagaatgccacaaaacttttctaccattcttaacttgcctttttttgctgttgtttggattcagcttccacttggttctgtaaagctttgactgttttagagagtcctgtaagttggttctggcaattctgcttgtttttctatgtttctttggagggacatgagcttggagctgtttactctcctctgtcattttgctgatgtaactctgtgatacttctcttgataagatttttctgtgctccacatgctgatactgataggcaaactataatattttatgatgtccctggtaacttacccatacgattttttaagtgcttgaaaagaattccactaacaaactaaatactgaactgtgaagtaattttctgatttatattttcaacttattgctataaaaaataagcaatcacaaatgaagccaggagaataaaagaatttaaacaacaaaatgcagattatgatagttgcttgggtgtaaaagactatagaaaactcaagcgatgatggatagtttataataaactaaaaattgagaaccctagggcaggattctagttcttcctttaaccagctgagtaacctgaggcacatcccagtgaggtctttctggctgtttccttgtatagaaaatgaatgggatagacttcatcagtgacttccaaactgggttccagggagattaggcattaggaagcagttcatggggataaagggagaattgatggattttgcatatatttgcaatatgattctgctatgttaaacatttaaaatcattgcattagatcatctctagtttttttctgataaaaaaatattatttgtaattttacgaagtatatagccctaatttaggagagaactgggaattagaaaacacagattccaggccggctcttttgtttatagccctgagattttaataatgcttatcattatctctgccttttttgtcttcatctacaaaagggagctagtaataattctctatgcacttctaggagctatagagcaaatagtaggtagaaatagatgtgaagtactttgagaagttgaaagtgttaggcaaaggaaagatattaccagttgctacagcccatgactatcccaactacaagatttctgggaccttgaaaaattagacagaatctggtagggaatgacctaaattcttattttccaagagtgaatcagcataatgtccttcatgagactagctctggagtataattgcccaggtgaccttcctgtgccaggtcaacccacctggcttaattatccaagccgtttgagagcatgtccataggtgagagaagaaaaagagaaaaaccaaaaaagaagccttgaggtggaagtgtttgaccttcaaaatgctatttgagactcttcaaaatgctgggactcttttgcctacaccttgggcacacacagctcttggctgaccttgactctcattctctgtccatcttgactgatcatgccccacactttctggccttgcttcgggccttaaatccagactgctgacctcactcatcggctgaatgttcccctgagcttccataatcagctgttcccctccatctattcctggttgaactttttcttctcttgggggtagtcacacttcataatcatatttataacacgtaaatagagtgaccaagtcatcctggtttgcctggaactttcacagttttaaaacataaaattctagctggggggggtgatgtgctactgtagtcccagttacttgggaaactgaggcaggaagatagtttgagcccaagagtttaaggccagtctgggcaacatagggaaatcttttctcttaaaaacaacaataagaaaaacattggaaattccatgtcctagtgaaaggagttagccagcttgctttaggcaaacagtagggaaggggccccagagaacctcttacccgccccacaagtgcttacatcagatgttttgttcagataaggaaacttgcacagggtgcttgcctaaacatgcctgcagtggaaagttgaattcctgaacacatgcacagtaagggaattaaatcaatatagagaagtttagtctaagggcctgcatgttcactagaaggatggggtggagccgccaggaattcgtgccttaagcccaggtattaaaccgtgaggggggcacttgcctgcctgcatcccctttttttgctgagagctttccatttgcttggtaaattctactccactcactctttgatgtctgcatgcctaattcttcctggccatgagacaagaacccacacctagctgagctaagaagcaaaacaatcctgcatcactaggaaactcttcagtcccaggcaaaccaggacagttggtcactttattgtgaaggtattaaaaaacaaacatacatatatataaagatagagacctatagatcaaaggcttctggaccatgttataaatatcctgctttttaatataagctctctggttggatctaattgatgaagacatatataccaaaaatgtcattgagtctgattcactccaaatattatacctatttcttttgggggccagaagttagaagaaccaatactattgctttggggatgccctttctgggccatggtgtagcatacccacagcatttttcaccacacttttgaggctgctagactgtatacatatagctatgtgtatcaccagaacaccaagcaaaggtcctgtggaatacataatgatcacagcatatcagacacaaagaagtccaaataggaagaagcagagagaagacattgtggaaatcataccagaccagctatggcacccagtgtctgcaatgtgcagtttatagccaattcctctccagggacctgagggcaggccaggcaaaccacagatggcactgtttcagcagagcactacgtctgtgattttctatacacagatttatatctgtgctccctggataattaagaattttctagacaccataagctactttttaaaaatgtgatttttttttacatagaaagaaaattcatcttttagaatgcttaacagatttcccatgtatcatactgtgaaatatatatatttggtctttgtccccatctcctggcatacaactcctaaaattcttggaatctccaaagtgataagtgtctttttgtatgctaatgagttgactgatggctgacagcccctgggcagcttcaggatggggtctgttcacaaaaaaaaagccaaggcatgattataggattgagattttcagctttactcccaacctccagagaggggagaggggctgaacattaaattgatcaccaatagccaatgttttaatcaatcatacctatgaaatgaagcctccataaaaacctgaaaggacagggttcagagggctctcatatagttgaacacaaggtttctggagggtggtgcacccaggaagggcatggaagctctgtgctccttcccccatgcatctcttgccctgtgcatctcttcatctgtaccctttgtaacaccctttataataacgaactggtcaacataagcaagcgtttccctgagttctgtaagctgcactagcaaattaattgaatccaaataagaaatcctgggatttatagctggtctgtcagaagcacaggcaaaacaaccttgggtttgcaattgcactggaagagagacaggcttgttgaataaatcttcaacctgtgggatctgatgctgtttttaggtagattgcatcagaattgaattggaggacacccagctggtatccactcagtcattgattgttcacttgtcctctgtattgattgttgtggtatgagagaagaaaaaaggaacagtttatttttttcattcagaaccatctaataagttgtaggcacttgaaggattccaaaagtactcatttttttctggggctttcttctgagagtcttgtcagttatttaatgaatacaaagtgtaaaataaacttaaaatttgaagaaattataatctgttaagattttttaatattaaaaactattttaaaattatatatatttgttcactttgaatgaattttaaaatcttccactacaatggaaagatatccaatttaagagttaggagaattacattagagagcagttacaatttctaaaatgttggaacccaaaagtaactcacatatatatatatatattttaaatgtccctatatttttggctcagtgagtgatgactaagtgatcaataggtaaaaatcccattaggtacttcttttctgattggaaaaagagcattttaggattgctatacttttaaaagaaatactacctttgttttcttcatggttgccttaagcatgacgataggtaggaataaggcagaaagcctcaaagggcgatttaagggcatggatgaagagttaaacaagccacacagtgagagccataaaggtatgatgtctcaaagcccagagtggccaatgtggtcacagctatacaatggggtttttacagaagcttccagaagggaatctctactaaacagttgtgtatagttacaagaatcaggtcctgtgactgctagatttgacagagaatggaaaagtaaggattttccattagaaaagatggaaagctaaaccggcgaagtggttatgggtaagagttggaggcaatgacacagatatcctacacctcaaaccttacagggcactatatcttgtaagtttacataataaaaggtagtcgtaataactggttaatgttttctgtcagtattttaataaaactttggacatttaccaaaaatatttgcttccctctcttttctaaaaatgttggaggcctacctaacagtcttcttcaaatagatatgtaccttgcagcaatttcttggagaaaaaaacaatgggcataacccatttggagggcaagttgacagtgtttacttaaatttaaaacatgcataatttcaggcccagaaaactctagttctgtgaatgtactcaagaaaacgctagtatgtctgcctgagaggcacatgcaggagtattcattgcagaatcagaagaggactggctgaataaatgtggtacattcatacagtgatgtagacagatacatctaaaaaattaagcaaagtacagaatactgtttatagcatgaaaccatctatataaaatttaaagcacaataatacttatcttgcttatggatttatgtatatgtaatgcagagttacaaaaagtgaactagaacatatatcaagttggtaagagtaaatagttttcagaaaaaaagagggtgacagacctgggcatagcagacaaaggcatatgcagttttgaggcaggagaatagggtctggggacagggaaccccaggccttcctagaactaaatcaatgggaaagaccctgactttctaagaccaagtaaataactttgtaactctacttcagctatgacaagaaacatcctcttcatttgcataggtgtaaagaactctgtaacctcacttcatcctcttcatttacatatggcatacaccaaataaccagtgggaaacctctagagggtatttcaaccccagaaaattctgtaactaaccaggcccttgagccacttgcttgggcttctcccaccctgtggagtgtgctttcgttttcagtaaatctctgctcttgttgcttcatttcttccttgctttgtttgtgcgttttgttcaattttttgttcaaaatggtaagaacctggccatcctccaccagtaacagttttacttggaaatgtttcattttttttatttaaaaaagtgtaaacatgacaaacaataatttctaatctgggaagtggacacacatgtatttattttaggatttttatactttttaaaatgtttagttttcaaaattaaaaaaaatgttggaaagaaaggaggattttggtttttttaagattgaataatattccgctgtgtatatatgtcacattttccttatccaatcatccattgattctatgataaatacatacaatttttatttgacaattaaaaataaattaattaactgaaaaagagattgcagtacctagggatgggaactggagacactaagtgctgaggacaattcccccagctgctctaaagctcaggtagctgggaagctacagacagaaaaagcacacctcaagatctcgaataccagcccaagaaagaaacattacatctccagtgttgtggaagataaatggatctgcaggcaaatattaaccaagaagtcccagtttctacaagagtgaacacatttaattacttgcatattgctacacaatacttttgctaattatgctatctaataaaaatttattattatttaaaaaagaaagaaaaaagagaaaggaaaggagaactgaattaaaaaagaagaaaagaaaatcctcgacagggctggttttgcaaatctgaagatcacagtaagaaagccatggcgaacaccatgggagcacccaagtttacttaaagacacccaaagcaaccataattaaccaaaaaacaaacctatagaaggaaatttgaaaataataattttaaaaatgttttttgtaatttttttgtggggagcccagggctgtttagagcaggttggacaccatgaataaaacatgggtcctacagcagaacaacagtacctcccacagcactgggtcctgatgtgcatgacctgttcaccctgggccccttctgagtgctgggccctgtttatttcttgtttttcttcactcagtgttggacatctggagacctagattttaaactaagacacactgagatcagatccagctcttgtagaatccctgcagtggtcttcagcgacactctttggctgaaatttgtttgagactatagtatattaaggccaacagatcaggcaatgactgatgactgccattgaaaagttagtaaccaagcagccacttttcatagcaactttgaaatcccactaggcaggcattctaaagagtccttactctggaaatagagaaggttccttgattagaccagattctgttcattagaaggaatgcatgtgtccattatttcttcatgacaacatctgcaatgggtattgataaatctgtctacctgggctattaagaaaatatagggtgttagtagaaaatttgatatgcagaataaggccatgcttaccatggaaaagatgtttattactcacagttcctggacacgggacctggggctggggtggggaattgagatgaggggtgaggaagtatgccgtgccatggtaggggcacacgggaaagcactggggttggcaggaggcagagggagaggggagagttgtgggcaagagcttttattgtggtttatgcaggaaggagcaggcgaggcagggctatgagtttacaatgggtttgagtaattttagcaagttctgggccataatggctgcccctcattgtttgtatctggtcttggggcaattaggatggaggacagtggccctgagtgtgagagccagctagaggaggtggtgtggatacgggctctggattggttggtttgcatatgggaaagttggttgctgtctctaggaattacctagccctgggatggaggcgagggagggacagtccctccagggtcagcaagcccccagaagtcaaagcatcaaaatacaggaaatgaaagacatgtctaatacaatattctgagatgcaaataaaatcctgaaaggaaaagttaagaaaactttatcaccatttagaaggtctctgttgtccttactgggttcctgagcacctacaccgggccaattttccaaattccagaattccaaattcaccttgtcctggaggagggtcagtcaacatagagggcttgtagctcctgccccggtgagtgctgctatcttgaggagtccagttctgaaaggcccagcacagccaagccttacttccctcctgcttggctaaacctaactcctataagggggcaagaagtgcagaagccctgagtgctgcgctgtatccctggtgcattgaatgaaagtcaaattttccattatctaggggaaaagaggaggcaccaggcagaaattgacctactgtgccagcagcctagattagcttgtttccctccaaggaactgcaccatagtcactgtcactggggatgccatgctatgctctctcttgaatgagctcttacctcccaaacctgctattttcagccctccctattgagagcagtgtctaatcattataatttgatcacttgggccaccgtgtttgtttttcctcatgctggcctggaagggagaagacctttccttgcattctgttgtttctccatctcccggggagtgcaaacttaagcagggtctaaggaagacaagagggagcaaaacttacatccaaacagaagcaagtgcagcacactgtgggttgtatgtgaacaaacacttttccttcttgctgagatgtagctgaagtcttcacactggaagaactggagagagtccaaagttaaaactcctgcagtgaaggacccaggattgaaggaaagcacctcccctccaatgacctcccagtggacactgcgtctgctcacagcccttctgcccagcgttctcagtggtacagcacctgctttctttgtggctcatggttccccaaagattgccactatagagacaaaagaatacctgcttgtttaatgtcattatttcatttcttatttttgccttaatgcctgatccatctacgatgtatataaaaaataagactatgagtcaacttttcgtaattgcctttagatgttcagctactcaaaaaaaatttagttgccttaaaatgtaggcaaaatgaaatagatacagaagctggcctttcctatttctcttttctgtcattgtttttgtgaccattccataaccaccaaagatcagccagctgggccatctctgaattgccacagagggactggagggaggaaaattctactaaattggtgttccgcaaagctcttctgttttgggcacttggcttaggagcaggtttacagaatcccaggcacacttctctgcatcctgcccctgtcccttcccccaactcctgcttcaattctgagttttggggataatgtttctggggctactttggaaagccgtggccaatatccaaagtcacatagggactgtgtatgtgcacctgtgtgcagacgcactgagcaggggcggggattggctgatccgtgtttgatttgtggcatcgggcagattcacatttagtaattttgtcttctttctgcctacctcacgctagccaaccccaggacacctgtgcaccttaaaaaccattttcctcagaatttctggatttattttctacccatgtttttaaataaatccttcctaatttcatccaggaagttcttaatttcctttggcctgtaccttttaaaacatattacactttgtttatttccctgaaagaagggctatcatcttttctgggaaaacgttataataagggactaaaatggcaactagaaacaaaacaaaatgaaacaggaactcttctgtgagcaaatgtgatgcaattgtgtatcactgttgacactagctctgtttctggaaaaagttgtatgtaaactacaacaagtaatgttgttaacgccctaggaggttcatttctttttttgttttttgttctttgttttttttttttttttttttttttgagacggagtcccactttgtcgcccaggctggagtgcagtggcgtgatctcggctcactgcaagctctgcctcccaggttcacgccattgtcctgcctcagcctcccgagtagctgggactacaggcgcccgccaccacgcccagctaatttttttttttttttttttttttgtatttttagtagagacagggtttcaccgtgttagccaggatggtctggatctcctgacaggaggctcatttctataaacactttttataaactggttttaatcaaatattgtaactaccccaagtgttctgttttggcaaaatacatatgtatgaaagcctgtggctttaaatataaagattcgtagagaacggtgggataagtaacttttatggtttgtaatatgacttgttgtgtgtttcactcttctctccagcaaccaattatctagtgcctgccaatgatacggcttcgatgactggaggaacactagggtttttggtattgcgccgattaagataaaatgacacggacacacatggagtgattttaaggagcagagaatttagtaggcaagaaagaagaaaacagctcccctgtacagagacagagggagtggggatttgagcaaagagaaaccccctgtgctgcagaaaagtggtcgctaatattgggatgctagaggaggtggtgtttggcttgcatagcgcccaggggattggtttgaccaggtgtgttatttacatagccagagaaaaacctgggcttcccaccttattcctttaatatgcaaatgcgggttgtcatgatgttccgaacacaaggtggtgttatttggaggcggccatgacacttggcacaggtggtgacaaggagaagactgagggaattgccattttggccatgttgggtggacctagcttttagtcgcctgcatttgcatattaaagcttgctggcctggctctttaagcctagaaaataaatggtttgagggttgtttctcataggaaaatttccactgagaacctttacccttactatttgcctaaaaattattttttaataagtcccgtattatcgactctagaccaggtgctacccaaagcccggttgttctcccaccctgtgcaccttgtctacgtcagggtgctgttgaaagattattgaggccatgtctgtaggaaagccagagcttcaagaacaacaaaaacaatgtaaacaggactcctttcctattctattaattctattgaaattattgaaaaataattgtccttgctttattttaaaattacatgtattggttttcatcacccagcagccagaatacatttgtaatttgttttccatctcactttttgccttttactagtcttgtcatgagatgaaattggtagttttggggcagtaattgagaataaatcaagattctgtgttttataagtattttggaggaaagtttcattaaaaagaaaattaacttaggttcttcagacaaaatgccagggaaattttgacaaagtgagctccccaaatctaacccgtctaagtcatgtggtagcagaaacccacagactctcacaaagacatgcaatgggctctaaacttaagtgcagatactttgattacatttcttaaatttctccatgaagtttcatgagaaaaaagaaccgtacaaaaacacaatggcagaacaatcacattcttcagtgacctcctcttgtgtgttaacaatgcctacgatgcatccctccgatgagcagcagggctgcacctgccacgaggggctgggctgcaggctgagccctctggctttgctgagaagggtggtgatggcatcgcctgtacaaagatttccagaggtacttgcagaggaggagggcagaccatcagtgcctcttcacctataaagtcatgcagtgggaccttagagttatgatggactcatatatgtgtgttttcctcaaatttcctgattttaaattagacaattgaaggatcagaaaatttgcaactaagtgaatattaaaatatattaaacaagtgtttttctatggatgaatggataaataaaatgtggtatatctatacaatggaatattattcagccttgaaaaggaaggaaattctaatacatgctacaccatggatgaaccctgaggacatcatgctaagtaaaattagccaatcatgaagagacagacactatatggtcccactcctatgaggctcctaaagaatcaaatccatagagacagaaagtagaatagtggtcaccaggggctgtggagagggggaagagggagttagtgttaacaggaacattgggagggctggggtgggtggatcacctgaggtcaggagttcgagaccagcctgaccaacatggtgaaaccctgtctctactaaaaatgcaaaaattagctgggcatggtggtgcatgcctgtaatcccagctactcgaagctgaggcaggagaatcacctgaacccgggaggcagaggttttagtgacccgagatcgcgccattgcactccaggatgggcaacaagagagaaactctgtcatgaaaaaaaaccaaaaccaaaacaaaacaacaaaacaagaaaaacaaaacaaaaaaataggaacagagtttcagtttgggaagataaaaagaattctgtggatggatgatgctggtgcttgcaaaaccataagaatgtataatactaaagccactgaactatacactttaaaatgtttaagaaggctaattctgtgttatgtgcattttgctgcaacttaaaaaacttaaaaatacattaaaagaattctcaattctgacagcaatgatgattggtggcactgttaaggtgaaattttctccaaatgcaactgcattctatttagtcaatttataattaacatattaaagatctcatgtctagaaattgaccaatttactaagattgttaagtgtgaggatgttgggtgcaccacactgtcatagtaaaaacctggagcaagctgaattcccattcatatggagcaattaaataaattatgatgattccataaaagaagtgccgtgcaacaattataaaggcaattgtgccaatgtaaaaagaagtgcaaaataaaacatgcaaaacaggaaatgatgatcagtatacatagcatcatcccagtgaaaacagaaaaatctaaataaaaatagtaaatacaaaaatatatgtgtatgcttgcatttacttggaaaatgctggcagcatatctaacaaaatggtaatgatagttacctaatctatcttaaatatggtataataaattcatatataaatagtgaagtaagacaaaccaaaatagtgattaattctgccaaatgaagaaggggttgtgagttggggtcttttacttttcattttccatactttcgtattatttgagattttttatttttactaaatgtgaaaagcaaataaaaataattagaacatttaaaaaccaaaaaattttatgcatacttcactattttgtaaaataatatagagtaaaaataaaaaacagaaaaaagtaatgcaagccaatgtggaaataagtataatccagaaaacaaccatgaagaaaggatcccatccagactacagggaacagactgagagacctcagtggcttccagttgctaatgtgtgtgattcccacactgggtaacacaggagtgtttgaccaacaatcaactgaatactggttcttgtttctcattgtcatggaatttgccgaatctcacttttggcttcacagaggactttgtgagctccaagcatgaaaagtggcatttataactccccctggaatttccatgtacccaggacactgccaggccaaaggatgaatcacagcttcttagaattgtggaagccattttggaaacagctgccaagtaactaatgctattaaaaatagctccctaaaaaatgaattgcttattttaagaagacaagagtggcttgaatctgtgctgctcacatttttcatctactgggcacagtgcccgtggatccaagaaagccctgcttgtcagatgggaataccatctgtacagatgatgccccgcacatgcaagagcctggcatttttgggccagggctaaccagggtaaagtctgaatcaccccatgtggaatccgtctcctacggggtgtggactgtggggcatgaattccaattgcgctttccttacataactttgctcttcagatccctggttccgaatgtggggtgtatgcagtatggcccactggaagtacatgaaaatgctagaaggtgaatctacatgtattttttgatctaatgaaaacaagcaggaaaataagttgtactgacaggtaatgtgcagactgatactgctgtcttgactcagactgtgttgggcaattgtctttccctgtgaattccgtgaagaaatgaacccatccagacccatcccatggcaataggattgatggtgccaacctcccatgtttgttttatgccccctgtgttgtgacgtggggcagttaacctatttctggcttaaacagtgtcaaaaataaacaaagccaggcactagttaaagtggtaagaagagacttcaatcagcactttgatttgtgcagcagtgactaggcattttaaaggaagaataagggaatgaggagaggtgtgagtggggactcaggagagtcagggaagtgaaaaatcatcaaaggcgggagggaggaagcttggtccatgtggaaactatctggattttctaagtgctccttctcaaagcgctgcccttctggaggctgggagacagggtacttatcttcaggttttggctgaaacaaacagtaaattccttgggcagccctgcatttctcaggcaggcactttaaggagattaggggcatgctaaggatgtggccttgagctgctagaaactgtgtttgtgtttgttcaagcctttataggccaaggatgaggcctagtggagaagggggctcagtggagcctgactagaatttggtcaagaagagagtctttgtcagtagccctgcagatatcatctgtctaagaatataggatgattgtcacattttgtaatgaggtgaaggaatgatcatacaaataatttgtgcctcttagaggctcctaagttatctcagggcaaataaagtacagttataaagtttaaggatgaattagaaatttttcatttacaaaaagacaagtgtgccaaatttggaaaatatttaataaggacattcttgtcactagaacacggatgtttttgaaaacgaaggaaaagatatacacaggaacacacacattcatgtacaatgtggaggtgacaagttaacagtaacaacgaaagtacttttcagaagcaactcatgtgacgtagagagcagtttgcaaatatttccattggttatgtgatatatttttccaaaaattttgtatttctcctcccaaaacaaataaatctatgataataccggacctggttaaatgcatctgccttgagtcattcggcacccctttgggcccacccctcattcctaaactcccccagctgttcttcctatcctagaattcaggggccagacttcagaccacccagcacaataggagccccagcagagcccaggtccagcccagtggcactcacaaaagccatggcttccacagtctctgcctgcaggcagggaatataacccagaaggcaggaaagctacagtggttcatctttgcaggatattataaaaataatatcaaaatcatcaaaaaagtgagaaatttttccaatttattacactgtattttaattatagatgagaggagaggatggtctgccaacttattttctgtgtataggaactacacagaaaataagtaatgtctcattctgttaaattttctgcttttgagcaaatgtgtataatgtaatatattaatttgtaacaatacataaggaacacatgctcaaaagtttttaactaatagggcttcacattcagaaaagttgggagtcgactgcttcagactcatgtgccctgaagtacacgcagcccctgggtggaggcaggataaggaagtacagctgacaggctgaacacctgtaggccagagagcagctttttggggcctggaaggcgtggatgggacaacctggccttgatgtcaagtctttagagcatccagtccataatattaaatattacccagaatgtgatctgacggggatccttccgttagatgtgatgccatattaggacgtagcacactcagggccttgataactatcgttttagggtcataataccctcccaagtattcaccaacaatttgctctgccattctgttgattccgtgttcttttcattctctttagggccagaagaagcctctaggtctcacacatagaaaataagttgggaaggctgggcgcggtgcctcacgcctgtaatcccagcactttgggaggctgaggcaggcagatcacctgaggtcaggagttcaagaccagcctgaccaacatggtgaaaccctgtctctactaaaaatacaaaaattagctgggcgtggtgggcgcacctgtaatcccatctactcaggaagctgaggcaggagaatcacttgaaccctggaggcggaggttgcagtaagctgaaatcacgccactgcactccagcctgggcaacagagcgagactccgactcaaaaaaaaagaaaaaaaaaaagaaaagaagttggcagaacaccctctcctcccaattgtaattaaaatatagtgtaataaattgatcaaaattctgactttttgatgactttaatgtttttttaatatcctgcatcaaattttatcccaagaatattgactcagtgggtgtgtgtgcatacctgcgcatgtgtgttcacccctgatttgctgtaaacattgctggctctgcctctggttaatctagcacagattctccttgccatgttgtagctttggttcaagaaagatgatggggtggggagcagtcatgagatcctggcaccaccgcttcctgcttctcctcttctgcccactggttttactcaacatttcctggtaattcattaggtgatgctgtccttattgctgccaaggtttttctcacccatgtgtactctactctatttattgcatggatactcatttagttgggttcagtgatgacaatgccttgacactgggaagattaatgactcaataaccgtcaagacaagataaatgtgaggttaggttgattgtatgaattgtttctttggaggctggtggagtgtcttgttatgcttcccccagaacctgaaccttgggtgactgcatcagggtggtccagtgtcccactatgtttgcagtcattggcacattaccatggtttcttctttccctctcatattttctctaagatgcaaactaaaaagtaattcttctagattgctggaaccagtgcttaatgaatgagttattaataaaaaggagttacaaaaggatgtatatgctcatctaatgagtagacactctgcttacacagccattcaaagactttaaccacatatttctctgactatatgaactagatacatttcttctccacagtgggatgtactgcatgatatttttaactgacgggaacttaggtagaaaacacatttcaattttgaatgcaaacatgtaaaatacaataaggaaaaggtgacccaaagagaaattgaaatatgcatctgtggctaagtactctagggagatattcagaattctgaatacgaacttcactcttggggggattccacttaggcagaagctgggaatggtggggggagagcactgcatttggagggagaagacgtatctccttgctctgattttaccctttgctactttgatcagttcactaaagtggtgagccccacttctccagcagtggtgatggaaggttctatttaccatgtgcccagaactgtcctgctaaccagacaagtaacctgtcaaagcatcttgtttttactgatgaataaacagaggcacagagaaattgaacaatctgcctcaaatcacacagctgaccgttggaggaggcaggattttgaatctaagcatttgagccccagaatctatttgtagtcagtgtcctatacattttttaaagcaagcgttttcaaatattttctcctccttttatgtcttctctatttaaaaatgtccccacctcccttccaaatctctccaattgaagaagtgaaaggaagggctaaaggtctttagtggccaatggggcaactgagaatgaagcgataaagtcagggaaatgaataaaactcattcacatgaagaattccctcaagactctatacctcacctcttgacctctctacttgatcttttttaggtaatttttggaatagtttggttgagaacatagcagttgaatgttttcaagtaggagaaaacattaaaacaccatacttttgaataaacttaaggaaagagagaaagatggaaagagaaaaaaggaagaaaagaagggaagaagggcgagaggaaagaaggaaggaagggagggaagaaaggaaggaagaaagaaaagagggaagaaggaaaagaatgaagggatgaagaaagaagaaagtaaagaaggaggaagtgaaggaagaagggaagaaaggaaggagggaaagaaggaagaaagaagggccctttgacatttgttcgagtttaggaaagctgataaaaggtaaattgaaagggtctgtctagtttacatttgtaggtactcagtagtacttgtcaagcaaatgactccctccaaaagccaacttttgcatattagctataaagttttgcagtttttgccacacatcaactgcctaactttgaatttttcttacaaaatctcaaattcaacatgaaaatgtttccgaacttggaattgtattccctctctttctccttggctaaatgtgactgccttcttttgtgtaggaccttgcaacacctccttgctttctcaggaagctaaactgcaaagaagaaaaacctcactcttaaggacagttttttttgacctggggaatgaggtggaaaagtcaagctaagaaaagctgaggcactttccgatctctgtcttatcatgtgtctcagaaaataaacacgaggacatgctcatgggaagctgataatattaaacatgttaagtccttataggcatgacgaagtcatggacatttcagtgagtggacacaaggctattctcataaagaagccatgtgaacaatgagctttgtttgaactctcagggacagggggcttattgaatttctggttagagtgagagtgacctctgtgtaggaactcccagttaccttctccctgtggctacttcctgctgtcccatgatgggctctgctctggtctcctcccctcatttgtcttgagctcatctctccatggaccttcaaggattttaacccaaatttctaaagtttctctagtctagatcaacttcctacattcactcttggacaccttcagttcatttaccatgctgccactggagatcctgctgaaaggcaattttgaacatgtttctccctttatcaaaatcactgttagggtggtaaaacaactctttatgatactacaatgatagatatatgtcctctgcatagaatgtacaaaacgcatagaacatacgacaccaagagtgagccctaatggaaactatgggtattgggtgacgatgatgtgtcaatgctggttcattgactgtgtaacaaatgttccactctggtgcaggatgtcaatggtcaagaaggctaatggaggacattagggggtatatgaaaactctctgtactttctgctgtcatttgttgtgaacctagaactgctttaaaaaaatgaaagctactaaaaagctactaacactcaatgacttcccattgcattagacataaatgcattactgttgttagcaccacagtgggcaagatactgagcccctagacatgctgcttcctttgcttggtatgttttcttctctcctcccgctgccatctgtaattcttactcagctcagcatacaccaacacaagaaagctttctttgactccccagactgagccaggataggtccctttgataaaggcttcagagccaattaaactatacattgtgtaatgaattgttgaatgtctgtcttccatcagaagggagagtccatcagagcaggacaatatctgacctatttatggctgtgtccccagcatttaatgcagaggcactcaatacatatttgaggaatacctgaatgaagcaatttaatatttacaaaaagtggccacattcattttctgtttaatctgctcgtatttggaagataggcatatttacttcattttataaataaaaaacccctgagacttagaaaagttagatgactctgtaacaggtggtcgagctaggattaggatttgtatattttaaatttaagtcgaacattctttccactaccctggacagtgccaatctccaacatttaaaatgtatcagtcacttaaatgtattatgcacatttcttctaactgaagcatttgtgggtggtcagagattttacttatatttattagctaacacatcatgattttagcaaggtctccacctcctccatgcaagcttcaaccacttcattcttagctatatgcctagaaacacacagaattgcatgcagagtgtatatgtgcatgagtgaatacacatggtatattggctatatggtttataatatacaaacgtattctaaacatcctgtgtatatcctatagattaacatttgccctgcagacctcgttaagtatactcagcatagcagagggcttcttttttataagataaaaaatgatattctgagtatgtttagacatactggagaaggagggaatgtctggaaccctagtcccacccacgagggttcaagaagaggccagagcaataggagctttgccatgggcccctttatggagattgcaacaatgaaagactatcgaaagtgaagataatgaactcttagatttaaaaataagctagtactggagatgagttagttatttattccaaagaggacacgcaaaccaaagaagatattcctccatgccgtgcaaaaaaagacaatgcataggcaaatattctaaaacaaataaactttgaggataaacaaatattaaatcatttaaaaatctgttagggaaccttttatgagtcaagttccgtgctcaatgtcatgagtaaagtatgagtcattaaagtcatttccactcaagaatttaatatacatattgctgtttcactaattttgcgtgttattacaagtgcctgaattcagaaaacattttctcatgctgagaagagcgcttattgttcataatgtaaatttaaccagtgcctgaaatccaaatattccttagttcagatattaccaagtattcagaccatagcatccaagttgcaaaaaagaaaaacaaacaactgatagctcatcaaaatagctgcattaattgtgcatttcaatataaccttgaaatatataatgtcacaagtggtttttttggtagctgaagatggtagcaaaaatgtttttagcacacatcttttaaatatatattttaaattaaaaagtactctgttttctttccttctttctttt

SEQ ID NO: 1569 - DNA, 4972 bp, Homo sapiens
ctggcggccccggcggcggcggcaggtgtggatggggcgaaggtgcgggaacgtccactcccgcgcgcccctctcggggaccagggcggcctcccaggaggagcttggtgagcagctgcgacctgtgcataacttggggcgccgccaggggctcgcaggttccacgtccggcgcctggagaaggaagacgcgcgtccccggccgcggcgccgaagccggctgggggaccgcctggtcccgggccagagctgggaggcggtgttccgtgagccgcctggtctggggtgcggggggcgggaagcggccccttcgtgtgcgcttgggcgaggccgggcggcgcttctgtcctcctactcggacccgcaggtttctggtcctcataccgtgtggttgagtgaaatcaaaacttccacgatagcaatgctgattggacaaagaatgtgttgtggacacaaaaccaaactctggaggacagaggattcattccaagggtctgcttgtattcaatgactggtctacgtgggggtgtgaagtccccttactccacctgtgaagagtcttcccagtttcagaccaccctcccagcctcctgttattggctaaggccattttgtgactacactgcaggtagagatggattcctggaaatacctcctcaaggccagtgtagagccctcaatcacccactgcccccagcttctccttctcccatctcctgcaccaagcaggtctccaggtgttccagctgctgatgacgtaaagtgtggagttggtccaggaaggtcatgttccatgcagcagaggagcgctttgtgtgagaagttgaagacctgctgtaacacatcatagaggaaagacatagcctgggccttctgcaactggctgacttccaccttctcctgggggaatctgaagtcacttctgtcctttagacacaagaagggagagattctcctcatttggcccaaaagcaccaaggtgttcctgcctagcaggccatggttctgaggtcttcatagaaccttggatcctaggttctatgaagacattctatctatgcatggctttaatggagcacaaatagttttcatttttctgagcatttctctaaatttttaattccatttattgttttcatttacatgtcttctatatcagcatccacaaccttttggccaccagtttggtggaagataatttttccacgaaaaatggggtcagggagggaatgctttcagaggcattagattctcattaggagaccacaacctagatccttcgcatctgcacttcacaatagggttcctgctcttttgagaatccaatgccactgctgatctgacaggaggcagagctcaggcgttaatgcttgttggttggcctgcttgcctcctgctgtgcggccctgttcctaccaggccaggaccagtaccccggtccatggatgggggttgaaaaaccttgttctatatgacctaaaaggaggtcatcactctacactcttgatttttgcaatggatgttcaatattcccagtaaacttaagatatatcaatccaaatgaatattgatcaatcagatgagaaacatctttgtgctactgttagaagtatatacttttagcccagatcctagcctccagttttaccctccattttgcataggaaatcaggatccctgggccctatgggtttctgtattcagttaggaaattacctatctctggaaattaaactttttaggactatctttgtttgatatttgattcacagaagacgttgatggttattagtgaaagaacttctctggtgcttccctccttctagaatatattcattcaggttcatgtggttatgcttccctgggggctcaagcttagatcaatgaacattgccttttttgcattattttcttactggagaaatatagcactcctcaggctgcgccaatacccctaaaagaaattctgttggtttgtttttttttcttttttaagatgcatatgggtgtggaaattttaatcttaaaataatgttatttcctcagcagtgatgattcacaaggtatttatcacatcaagtcactccctaaatgcaggctcaccacatcctgatgactttagaactccttttccagggaggttcttgcttctttgttgccaaaacaataaatcctttgtgacctttgtccttgctcctagaatatttgggtgaaggagtatatgctgtcagtggtgacctcctcttcttctgacccatgccctaggtatcaaagtctcaacagccctagaacgctgataacaaaggtttgttttgtctaagtaggtaaaggaattatccaattgtaatcattttatcttcagtagttaaataatttttatttcaccaagtacagcttttattctttctttaactcttttgctatctttaattcttttaaactattaacagtttttatgcttaaaatttatgagctatgcacaggagagtcaaagatgctgctgcctctctttagaggctcatattacagaaactggcgaccctcagttgttcactagttcagtgtgatctgttgaagtttcttacatctctgtctacatgaaactttgacggtgcagggcagtgagccccatgctatcacattaaatagtcatagccatctttcctttactgatttgtgattcttcattttaaatttaaagctcaacaacaaatgaatttttagaacacctttttaacatagtggtttactgggcagtttgtcttgctgctaccacattatattctaattcatgatgaagtaacacaaacaaaggaaagtaaaagaaaggcaaaagagctacactgcttttctctataatttccaaaattcgtgtttttcttgtttctcatttaaacttttgtagaaagtactacttgacagttgtttgtagggagaaagaaaacagaagcaattctgattgtcatgaaattgaaataaggggagtgactttccccttactaactgcaaagtgtaagttagcaaacttcaatgcagcaaaaattggggactagagagttttcgaagatcagctacttgactttctttcacttaatccacatgtgatcagctctggagagaaggcagaagtcacaccaaccaactcccaaaagattgacaaccaggctgcagttgctagaacaccaacaatgctctctggcagggtgttagacattaagcttgtctgaagactctacctagttaataaatccacccaggcaatgataagataggcttgaggaacctggaattaatagaaatagaattggatgatcccaaaagtttctattttaatctggatgatgataataataatactaatattaaaaatgataacaccaacatttattgcatgcctaataggaaccatccactgttttaagattttcttttttgagacagggtcttactgtgtcacctaggctgcagtacagtggtgcgatcacggttcactgcaatctgaccttctgggctcaagcagtccttttacctcagtctcttgagtaactgggaccacaagcatgcacgaccatgcttggctaatttttcaaattttttgtagagacagggtttcaacatgtgcccagcctggtctggtgctcctgggctcaagcgatcatcctgcctcagtgttccaaagtgctgggattacaggcatcagccaccatgccaggctgttttaagatatttttaaaatactaactctgtcttctcagtaacactatttggattacacccttttatacaactgtttggagagaaatataaatctggagggatgaactattctgaccacaccaattgtgcaaggtgaaaactttagggagaatcaatataatggcttttctggaagggtcctttaaaggaagtgggggatagatatgaacatagaaagtaaagaagaggacatcaaatcaatggagcagggagagtgagatgactaggattctgagatgcattttgaatgtcaaatggttgctgtctattgctttacagagcaacagggggtgtagtgtaaatgaattgaactgactgccttaagttcagtggaaaagtagatgaaatacattccttttttttttttttttttttttttttgagagagagtcttgctttgtcacccaaactggagtgcagtggcgcaatttcagctaactgcaacctccacctcctgggttcaagtgattctcgtgccttagcctctggagtagctgggactatcagtgcacaccactatgcccggctaacttttgtatttctagtaaagacagggcttcaccatgttggccaggctggtcttgaacccctggccctaaatgatccgcctgcctcagcctcccaaagtgccaggattacaggtgtgagcctctgcacccagccaatgaaatatcttttaagtagtaaaatgaagtagatttgtctgccaattaaaaaaataaatcataacatttaattagtgatttcttcaaaaatatactaaaacaactctattaacctatcaactgcaaactcctagaagccaatttattttttactcttgagttttcttgtgtatttaagaataaagagaaaacaactaataatttctgggacagcccagccatatggactctgactttctcctccttcaggactcacaggtcagcctgctgctcttattgccaaggagaaggatatttctatccccagcccattcaggacttaatcttgtgtactgattgtgtccagtgaagaatctcttcccctctttctctttcggtccattggttgagttgtgagtgctgaaaagatcattcatatgaccaagattgtgatgcttagatgtttatccccagcaaacatgtaaactatagaaatctcagttgtctccaccaaacatctaaactgtatagcatctaagcagcctgaggctgcttagatgctatacagtttag

SEQ ID NO: 1570 - DNA, 1795 bp, Homo sapiens
ctcccagtactcctacatcagctactctggcccccctgccccaaccaatcaacgtccttgctgttcctggctcactctcaccctgtggtctctctctcctgaggaaccaggaccccagcaggaaatgcagctgagcacagagggatggaacaagccctgtctactgctttattaagccccagcagaaaatatactgaagccaggttctcagtcacttcagcgtttcatttgggcttcaaactctgatgaagtgagccccacgaatcccctgtggacaggcatgacacaacgctggcaggcatgtgccaggcagggagagggtaggatggctggtggaccctcagaaagacccgacctgagctttccctgtagggactgagcagagtggagaattgagccccctaaagtgagcagcacagagccatggggggcaggggcatccctggctgcatagtgggaaggcaatggcctggccgccagggacaggcacagggatgcccagccaggcccgctgtcttcccgtgtgaggagtgaggcgccagggtatgcggtgggcaggaagctacatcctgaatgtcaaggggcagcccaggctgctcctccttccctcccctgcagttcagctgcagctccttggggtctccactgaggaggggccatccttccagccgtcgcgccagcgctcatccacttttgagcagtcgaagtcaggcttgcccagcttgcggttcacttcattgtgcaggtggcacagccactgtgtgaagcatgcccgggtgcgggtgtctgggtggttcctgcacagcctgtgtagggagagcaggtaaagaatgagaggacgcagcggctccactgcccctgccagttccctgtctgctgtcaaggaaggagagctggggcactgctgtgaactacacctgggagtgcccttatgctccaaggtacaggcactcccagaacagggctgaccctgcagctccccgggtgtgatgaactcccagggctgcgcaaacacccacctggacagcttggcaaactccaacgaggcctcaaggcaacacattacagcacagacctggcaattttataagctcctaacacccaggaagcggcatccagtgtccctggcctcaggcagagtgtggcctgggtggggctgggcacagccttgtaactgaaaactggacttgtttcttagcatctgagggcaggccctggtgcgtcagttcagcaagagacttcattctaactgaccagccttatagcaacaatggcggctctaccctatacatctggcctagaaacacctgcaagggccagtgctggctcttggatccctcagtgaggaagagatggctcttgggagcaaaagcagtggatttccaagattttaaaaccagaagtcctactctagaagtcaggcaaagtggagtcttccctaacttgcgggaaaccgccttcagtgccagacaaggcagggaatcccttcctggaagccctgtggctgtggcaggagcagtacccagcagcagatcccgacagcttggcttctgagacgagaggaggaggctcagatagccccagtcctcacctgttggaggtccctgctcctcagcaaacttctgccacctctgcatccgtttctctacgttccccgctataacgtcagccaggagccccaggcccaggctccagtgcaaagctctgctgcgtgcaaacacatcttacctttttcttaggtcttcagcacactcctcacaggggtaaaacttagaaaataaatgtatgaactggg

SEQ ID NO: 1571 - DNA, 1795 bp, Homo sapiens; identical to SEQ ID NO: 1570

SEQ ID NO: 1572 - DNA, 9419 bp, Homo sapiens
ttggtataggggcagcgctttttgcgggtgcgttggccacctgtggagggagaaaaggcatggggtgagccaggtgtgggggctgcaatccaccccagagcccatagctgaggagaagggctgccatggggactggtggtccagcccaagccccgtcaaagtctgcccaggcccctgcctttaacgctccgactgcatgcttggaacggccgcagttggaggctcagccacagataaaagccagctccctaaataggcccccggggaagctgctcccgctgcccccagaacagaaaggagagcttcgcacagcaacaggcgagtttgcgctgcctaagcctctttgaaagcagccaagtgggggttgccggctgcctctcgcaggccagactaaacaaacagccgcctgcggacatttcaccttccagcacctgggctgccccttcccaaggcagtaaaggcggctccagtcccagtctttcccggctgcggccaagactgggcagtccttaacatctggggcggctgccgggtctttgtcagcctgagtcctggccaccagcttctgcctccccggccagccttccggctccgccgaggtggggaggtggcggcggaagccccctaccctaggccttcgctgagcaccacggccacacggccatcctgcacacggcagagcagcggctctatcttaggtagggtgaagggaaagggggcttcccgaagctgcgggcaggctctacttgctccccctttaaaaaaaaaaaaaaaaaaaaaaaaaagacccacaagacaaaaaaaaaatcgcttttgacagattgaataacaattgtgaataacatgcagttgggcagaaggaggcacgtaattgccaccacgccagaggaaaatggcttcctttggacaaaaaggccaactttgggttaatttgttcttttaatatattgctagagctaagcgggctactttatctgttaaacgcgctcctagcgccgtcgttaaacagcgacgcctttgaatcccggccgggactggagtcccggcgcaacacatggcttttataaaaatctccggattacctcgctatcaaaagctcccgaagcccttgcagggggaatttacaggcgcccacctccggctccccagcctggagctggccccgagcggggtcgagctgctgggcttgggagctgagaagggaaaaaagggaaaaggggagttgtttttttttgcaggcatgccttggccggtgggtatttcacggccaatttcagcactcgccacgtgatcccgccttttataacaaagttttgttgggggaaacctaaaggcccttcataaaccttatatgcttataaaacagcatataaaaatttaacagcggtgctgcgctagatttccaactcccctttcataaagcgcagggcgctgcctttatacgtactggagccgccggccttgtcctcagtgtggccggaagacgactcggggctgctgctgctctcggggcgccgccgccgctctttctcctctgctgccgccgccgtctcccggcagccgccgccgccgccgctgtccgaacttgaagttgccggcgcgcccgttgcagccgccgccgccgccgcggaggtcgccgtggccgccgggggccccttctcggcgctcttgtccccggggtagtcggaggaggcgaggttttccggggtgccgtaggctgtctcgaaaaactggtcgaaagcctgtggcaggacgccgttcctgcccacggtgctatagaaattggacgagactgcgggggtggggtggtggtagacgttggccgagctcttggccagcacgtcgccaggcacgccggccgcgctgggcgcctgcaggcagtctctgtgcacgagctcctccgcggagtagcagtgggccagattgccgcgggggtgccatttagtggcgggctcaatggcgtactctctgaaggtcacttcgcgcacgggttggacctggggcaggttggaggagtaggagtatgtcattgggcgcgaagacggggtctggggcagaaaagaagggaggctggagaaatctggacccgagacgtagtaagtacaacttggcaaatacatgttagaggagcagggaccacgctcatcaaaatccattattgggctaccttgggctctccgcagtagccgagcttaacatgattctccactgcagctgcctctttgaagcggatccgtgaagtagaaatttggagacccacctcaggggaagcaacagatcgtcactcggtgttctcaccgaaagcacgtaatcgccggtgtaactcatgttggctggggggcctcccggcgcgcgcggagaggctggggtgcgcccccatgcagcatgcttgtgctcaattgcagggtcctcgttctcgagtgtgcagagggcggtgagagctcaactctcgtccccacctcccacccgcagctccccggacttgctctgggaagcgcctctgcctccgaccctagccggaaccccttcggggccagagtttgaagccgtggatgtgcctgcctggtggcttgtccgatttgcacggtgacttgattacactctctcattcatggtcacttccgaagcgctttagtgccttccgtccctaaaccgccaacagccagaacggcttctccccgcggtttgtcactgatccgcagggcccggaagggccttcgtcttacccgggatccacctctcccctcatcttccctgcctacctcttcatcccaccttctgtccttggagaaactccctcctcctcgctgcctgccgggcttcggagtgactcggcagagacagaggcacaggggctgccctgctgctcaccggtccacccatctgcctggtcttctggagctgaggactcgggaaaccatgcaattgaggcaagccttgggctgctttagaggcgctgacatccgaggagacttctcctgggattgaaggagcaatgtttggaggaagcgaaagaaaggagaggacacagagcacagagcagccaggcagagccaggagctgagaagggcccagacctgaggcctcccaacaactctcttcttggaaggatctgggatgttgctgaaggaaaataaaaaaatatgtaaaaagataaccttttgtttttccctctccaggaaatagccaaagttatttacatatcttggggagatttagagtataaactctaagatctttggtatttaagtgtcaacatcgatttatttatttattgctgagctgactgtaactgactcaataacaaatctaatcgtgtattgcactggaaaagaaatattcttattatgtattttctccaaataatggcctaccattgcatttgaatacctgctgtaaatatcaataatatgaagtaattactctgtagtcgagtaaactaatttattagcattaatgtttatgtggctctccacctccccccaccaccacctttacaaggattgcttatcacaaatcaagctacttggacacattggtttaatgaactctttattcaagatttgctacaagaattttcatgtcctttgaatccctgagaactgaacttgaaattatttgtgcatcttcagcttgacatatttgtccactgtggcttgtccagagggcagcagtgctgtgagtgagaaggtccagtgggaaggaaggttattggagaagagtagcctcagacctcctaaagctgggaagcacatttacagaattgccctgcagcgaaaaaacttctatttccagcagtgaccaacaaggcaaaatgtttgtttctccacagcatctcttttttagagacagaatataaaagacagaaggagaggtttcaaacagcggtattcgagctgttccctggcttgattttggctatcccaagctctctctctgcagcccacccagtccacgccacccctaccttcgaacaaaaggaatgcatgaagggtttcagtgactttgccataacaaaggcgccaccattgcggggctcgccccgcccctgggtgaaggcaaacaaattcttgcacttgtattagggcttttaagaccataattgaacccgggggcgtctaggaaaaccgaaaacagttctagacagacctgcggttttatagcagttttggcagtcaacttcagcttgtgcctgagcagacggggttgtggtggcccgccagcgggggatgccaggccacctcccccagcggcacgcagcccctctcttaattagatcggttttcccctggtgtccgggagagcggtcccggcagaaaggtcggtatgggggtgtgcgctgttccgcataaccactgcctcccatgtcctcctcgagggccgaaccgagagggtgctggcagggctggatcccacgggtgtccgcaggagacaaaggcgaattccggagaaaaggctggggctgagaaaggcgctccgggagcggctggcagggcaattcggcaggctgcaccgaagccgagtgcccggagggacttgccgcccggaagggggtgtgtgggggcgctgccgtgaagatggatgagggaaaaggtttttgatatcagcagaagggaaaacgcctggagtggccgaacacttttagttgcccagcaggaataggagacgggtactcagctccccaaggctgcgcaatatcccagctttgcccgctcctgccctcgtgttcggaatatgctggcggtgtgaatgtgaaggaccttcgggtccttggttttgactttgctctgagcctatgattgactcttccgctttgcaggaggtccaacagccgagcttagcccaccgggctctgggaaagacccgactgaggctaaagccgccccggaaggccaagtccgagttccatttcttgaagaggccggcgcgcgtaaggctgtgacattggccctggcgactggcttcccaggagctgttctttctcaggagctccacagcgcgggccatctccagaaaactgtcttcagagtgtatttccttttatcgtcaacccagagccccaccgcggctaatgcaagaggccaaaaaatgtttggaggaagaaaaacaaaggcaggaagtggcggcggcctgacggtgcgtgtgtgtctgcagagaagggagggagccggctcagtctcttcttgtttttccaaacttcaaggtccaggcagccctctgcagggccgggccccattgctccccgcgcggcattggaggtggccgcccggagaggagaaggccaacgcctgcgccaggcttgtcaggcggaaacggctaacaaggagatttggtcagcaaaacagacccagcctttccgaggcttcgtctgacttggcccgaaaggttggggagggggggcttgcgcagagcctcagggaccctcctctctggggactaccatccctgagccttacgcttctttccacagcctttgcaggcggaatatcggaataaagtgggtccaggcgcctctgccgcctccgcttcttcttgcagcctgaatggtccgggaggcagcgggagggcgccggcgggcagtgcccaggcggggtcgcctcgaggccgtcggtgagcaccgggcaatgcgaggccttgttaccgaggttgttgtgctgggggcgtttccagcacagtcattcaagggacgtgagctgcaaggatcgtcacttgacaggcggcttaacaccctctcactccaagggaggatacagctgggtggccgggagcacctccacactccaggcttcccagctccaactggcaaagctgctgggccaccctcttctctccctggggctggcttgggaggcagcagctgctccttgtcccagaaatctgagaattcgaagtccccagtacttgcacatgcagccctttaaatgcccagcatttgtccacagtctcaatgtcaatgccaagctgccccagtcaccactgtccttctcaagggggtcctgtccctctacagttcctgatcctgctcctgtcccccctacagttcctgtctcctgccctgcctccttccagccattctcacctgctgggacctcctgtctcttccctacctcttttgatgcctctgctagactgagcaacagctgaggtgccactggagggcatccaatactcaggcgcagagaagaggggctgttaggtccctgactctcccccaacttcgggcttccaccagagcctgaactgagtctcccacctccttcttaggaatactccacctcaaggccccaccaagtctggcttatctcccttcctctcccctcccttctctaccctcctttcttccccaacacttcctccttctcttctgcggacccagctgctgcttttctaggctgggcaacccagatgggataggcctgggaggggtcaggacccacttgacagactgaatctcactcccagatggctacagttaagtttctctcttggtggattgcttagggcaccatcattattttgcctcctcctgcttgcctaatcccttactttcctctgtccacaaatgtcacactgtttctagaaagctacacagaagagtatttcaaccctggtgaccatactgcacacaggtgcaagaactggcccggaggccccgggtagaaatggcaacagagctcttctccattacaggaatatctccttccaaatcaaagggttcctgtgggcacatctgtcttatgtggtgagctaggggagatgggttgtctgggaaggcccaggagatctccacgtatttgttctcagggcatggcttattgccagatcatagacaatccatcacattttccaggcgctgcccagaggcagcactgaagcttcaattaaaaaatcaagagatcacctctatcactaccaggtggaggcaggggttaatttgtccctttgttgagacacctcaccctccccgaaggtccccaacacttcctaaaagctcagaaacaggtaatgccctgaagtggacctcataattctgcttggtctgactggcagtttcagtcatccttcaaagcccctaaatatctgaaaaggcccatacccttcccctggccactgcagagtggggcacagggctcagctgagggtctcaagtacctaagcaatctagttatcatttactttagtggatcccaaactgaagggagaagagaagattacttcctttaataactatttttatttttattgttgccaattattagacttctttttcctatagcatgggaacaaatggggtgggggagactttgaagggcgaagccctagttctcagtgtctgccttccattccccatgcagctttggcccaaacaggtttcccagcagagtgtgtctgagataaagaagacaaaagggggtggcccaacccgaaggttggctctggtccttgggtctcggtctctacagccgtagctcacaggaagcccccacgccacaaagctccaactgcttcctagggcagctccatttccactcagtgctcatgttggctcacattccaggcttgagaagagccatcaccccatccagccctcctcccctacacacccttccaggcagttctgcgatgggacccattcacagatcattgtttctgctatatatgcccccacagcccagcccagcccatccacgcagccctaggggtacaatccagatttttggcttccgcgaaaagaaatcctttgcatgtcctctttggttcacctggagagataggctcagcggcagatcacgcttaagctaacgtttaccgcagggcctgatgctctgatctgctggaggcaggctataggcagggggtaaggggctctctccctcgcagagcgcagtgaaggattcttgggggctgggagtcaggagtttttaccttggaagagtgcgcctcacatctgtgtggattttaggcaggagaagagcatcaagggtctcaccaaaggcttgccactcactgagggagaggcctggattctgggaccccaggagagtctctccagcagggtcttggctcccctatcctcttccctgccaagtcggccctatgttcctaccaggacccagaactccgatccagccacgtcctttcccctgggcttgcaggcgctccctctcgcccccgctaggccttagcgggctccgaagtctgctggactggggcaaaccccgctcttctgggacggggacacggcctgggccacccgtggctgccgggactcctttccaacagggctggggatgggagagttggaaatcaagaaagaacctctgcctccagtgcacgagcccagagcccaggctaccagaacccgcttgcagcaaggtaactgtgcgtcctgtgccttcttgaggcggcggcagcgatcggccctgaccatagaggcggccgtggcgcggaggacttgacctttacggcacgagaggagggcgctggctgagccgcagggagggggacgctgctctctccagcctcctccacccaatagcagtccgctcgacccacgccagctgcgcgctcaccccctttccccctccattttgtgcagtgtccgcagacccgcggccggaaacaaagcccccagccctgctctcaccacccttcttgcaagctgctgtcgccaaccccccagaccagaggctcagagctaacgctaagccccttaaggccctctccagggccctcttctctcgccagccgccctcagccagctcctgaccccagccgccctcagccagctcctgggtaccactctgggtgccaaccgggacctgccggtgccacggtcccgtgcgccgggtcccggcctcgggctgcgggcggcttcggggcctacagcccagcggcgcggagcgtggcagaggcgcggggcgcagcgcagcccgaggctgcctcccgcccgggcggacggcgcggccgctggggtgcacagcgtagccccgcgtgcccggctcgctctccgttccctcggatagctcccaccgctcggctccgggctcagaaagcggaagtatttggtagagaaaaacacggtttcttttcagctcgtctcaaaatcccttttagagaaaatgctcctgtcaagttttatttcccgttgcaaaccaccttccacgctgccaagaattaagaccgggagagattaaatacccgattattctcctggggagggcggggcggggccgggaagtgggcacccacaccaaacattccttgaagtaggcttgtcctgatccagccgcgcccggggagccccacgaaggcccgcgcggcctgcggtgacgtcagcctgcagttgcggggccactcacccgcacagacacggcccttgctgttccgcgccgggacctccgccagccgtcctgccg

SEQ ID NO: 1573 - DNA, 9419 bp, Homo sapiens; identical to SEQ ID NO: 1572

SEQ ID NO: 1574 - DNA, 7671 bp, Homo sapiens
aagaactcccgttccagctctcggatctggtacttggtataggggcagcgctttttgcgggtgcgttggccacctgtggagggagaaaaggcatggggtgagccaggtgtgggggctgcaatccaccccagagcccatagctgaggagaagggctgccatggggactggtggtccagcccaagccccgtcaaagtctgcccaggcccctgcctttaacgctccgactgcatgcttggaacggccgcagttggaggctcagccacagataaaagccagctccctaaataggcccccggggaagctgctcccgctgcccccagaacagaaaggagagcttcgcacagcaacaggcgagtttgcgctgcctaagcctctttgaaagcagccaagtgggggttgccggctgcctctcgcaggccagactaaacaaacagccgcctgcggacatttcaccttccagcacctgggctgccccttcccaaggcagtaaaggcggctccagtcccagtctttcccggctgcggccaagactgggcagtccttaacatctggggcggctgccgggtctttgtcagcctgagtcctggccaccagcttctgcctccccggccagccttccggctccgccgaggtggggaggtggcggcggaagccccctaccctaggccttcgctgagcaccacggccacacggccatcctgcacacggcagagcagcggctctatcttaggtagggtgaagggaaagggggcttcccgaagctgcgggcaggctctacttgctccccctttaaaaaaaaaaaaaaaaaaaaaaaaaagacccacaagacaaaaaaaaaatcgcttttgacagattgaataacaattgtgaataacatgcagttgggcagaaggaggcacgtaattgccaccacgccagaggaaaatggcttcctttggacaaaaaggccaactttgggttaatttgttcttttaatatattgctagagctaagcgggctactttatctgttaaacgcgctcctagcgccgtcgttaaacagcgacgcctttgaatcccggccgggactggagtcccggcgcaacacatggcttttataaaaatctccggattacctcgctatcaaaagctcccgaagcccttgcagggggaatttacaggcgcccacctccggctccccagcctggagctggccccgagcggggtcgagctgctgggcttgggagctgagaagggaaaaaagggaaaaggggagttgtttttttttgcaggcatgccttggccggtgggtatttcacggccaatttcagcactcgccacgtgatcccgccttttataacaaagttttgttgggggaaacctaaaggcccttcataaaccttatatgcttataaaacagcatataaaaatttaacagcggtgctgcgctagatttccaactcccctttcataaagcgcagggcgctgcctttatacgtactggagccgccggccttgtcctcagtgtggccggaagacgactcggggctgctgctgctctcggggcgccgccgccgctctttctcctctgctgccgccgccgtctcccggcagtcgccgtggccgccgggggccccttctcggcgctcttgtccccggggtagtcggaggaggcgaggttttccggggtgccgtaggctgtctcgaaaaactggtcgaaagcctgtggcaggacgccgttcctgcccacggtgctatagaaattggacgagactgcgggggtggggtggtggtagacgttggccgagctcttggccagcacgtcgccaggcacgccggccgcgctgggcgcctgcaggcagtctctgtgcacgagctcctccgcggagtagcagtgggccagattgccgcgggggtgccatttagtggcgggctcaatggcgtactctctgaaggtcacttcgcgcacgggttggacctggggcaggttggaggagtaggagtatgtcattgggcgcgaagacggggtctggggcagaaaagaagggaggctggagaaatctggacccgagacgtagtaagtacaacttggcaaatacatgttagaggagcagggaccacgctcatcaaaatccattattgggctaccttgggctctccgcagtagccgagcttaacatgattctccactgcagctgcctctttgaagcggatccgtgaagtagaaatttggagacccacctcaggggaagcaacagatcgtcactcggtgttctcaccgaaagcacgtaatcgccggtgtaactcatgttggctggggggcctcccggcgcgcgcggagaggctggggtgcgcccccatgcagcatgcttgtgctcaattgcagggtcctcgttctcgagtgtgcagagggcggtgagagctcaactctcgtccccacctcccacccgcagctccccgggtgggtgagggatgccctggactggggatagccaggtgggagtccgtcgctgtgtggcctgtggtctcggagtctgttctcctggagtctcgcatttgcacccccttcttcgcagtccccctcccatagacttgctctgggaagcgcctctgcctccgaccctagccggaaccccttcggggccagagtttgaagccgtggatgtgcctgcctggtggcttgtccgatttgcacggtgacttgattacactctctcattcatggtcacttccgaagcgctttagtgccttccgtccctaaaccgccaacagccagaacggcttctccccgcggtttgtcactgatccgcagggcccggaagggccttcgtcttacccgggatccacctctcccctcatcttccctgcctacctcttcatcccaccttctgtccttggagaaactccctcctcctcgctgcctgccgggcttcggagtgactcggcagagacagaggcacaggggctgccctgctgctcaccggtccacccatctgcctggtcttctggagctgaggactcgggaaaccatgcaattgaggcaagccttgggctgctttagaggcgctgacatccgaggagacttctcctgggaggtccaacagccgagcttagcccaccgggctctgggaaagacccgactgaggctaaagccgccccggaaggccaagtccgagttccatttcttgaagaggccggcgcgcgtaaggctgtgacattggccctggcgactggcttcccaggagctgttctttctcaggagctccacagcgcgggccatctccagaaaactgtcttcagagtgtatttccttttatcgtcaacccagagccccaccgcggctaatgcaagaggccaaaaaatgtttggaggaagaaaaacaaaggcaggaagtggcggcggcctgacggtgcgtgtgtgtctgcagagaagggagggagccggctcagtctcttcttgtttttccaaacttcaaggtccaggcagccctctgcagggccgggccccattgctccccgcgcggcattggaggtggccgcccggagaggagaaggccaacgcctgcgccaggcttgtcaggcggaaacggctaacaaggagatttggtcagcaaaacagacccagcctttccgaggcttcgtctgacttggcccgaaaggttggggagggggggcttgcgcagagcctcagggaccctcctctctggggactaccatccctgagccttacgcttctttccacagcctttgcaggcggaatatcggaataaagtgggtccaggcgcctctgccgcctccgcttcttcttgcagcctgaatggtccgggaggcagcgggagggcgccggcgggcagtgcccaggcggggtcgcctcgaggccgtcggtgagcaccgggcaatgcgaggccttgttaccgaggttgttgtgctgggggcgtttccagcacagtcattcaagggacgtgagctgcaaggatcgtcacttgacaggcggcttaacaccctctcactccaagggaggatacagctgggtggccgggagcacctccacactccaggcttcccagctccaactggcaaagctgctgggccaccctcttctctccctggggctggcttgggaggcagcagctgctccttgtcccagaaatctgagaattcgaagtccccagtacttgcacatgcagccctttaaatgcccagcatttgtccacagtctcaatgtcaatgccaagctgccccagtcaccactgtccttctcaagggggtcctgtccctctacagttcctgatcctgctcctgtcccccctacagttcctgtctcctgccctgcctccttccagccattctcacctgctgggacctcctgtctcttccctacctcttttgatgcctctgctagactgagcaacagctgaggtgccactggagggcatccaatactcaggcgcagagaagaggggctgttaggtccctgactctcccccaacttcgggcttccaccagagcctgaactgagtctcccacctccttcttaggaatactccacctcaaggccccaccaagtctggcttatctcccttcctctcccctcccttctctaccctcctttcttccccaacacttcctccttctcttctgcggacccagctgctgcttttctaggctgggcaacccagatgggataggcctgggaggggtcaggacccacttgacagactgaatctcactcccagatggctacagttaagtttctctcttggtggattgcttagggcaccatcattattttgcctcctcctgcttgcctaatcccttactttcctctgtccacaaatgtcacactgtttctagaaagctacacagaagagtatttcaaccctggtgaccatactgcacacaggtgcaagaactggcccggaggccccgggtagaaatggcaacagagctcttctccattacaggaatatctccttccaaatcaaagggttcctgtgggcacatctgtcttatgtggtgagctaggggagatgggttgtctgggaaggcccaggagatctccacgtatttgttctcagggcatggcttattgccagatcatagacaatccatcacattttccaggcgctgcccagaggcagcactgaagcttcaattaaaaaatcaagagatcacctctatcactaccaggtggaggcaggggttaatttgtccctttgttgagacacctcaccctccccgaaggtccccaacacttcctaaaagctcagaaacaggtaatgccctgaagtggacctcataattctgcttggtctgactggcagtttcagtcatccttcaaagcccctaaatatctgaaaaggcccatacccttcccctggccactgcagagtggggcacagggctcagctgagggtctcaagtacctaagcaatctagttatcatttactttagtggatcccaaactgaagggagaagagaagattacttcctttaataactatttttatttttattgttgccaattattagacttctttttcctatagcatgggaacaaatggggtgggggagactttgaagggcgaagccctagttctcagtgtctgccttccattccccatgcagctttggcccaaacaggtttcccagcagagtgtgtctgagataaagaagacaaaagggggtggcccaacccgaaggttggctctggtccttgggtctcggtctctacagccgtagctcacaggaagcccccacgccacaaagctccaactgcttcctagggcagctccatttccactcagtgctcatgttggctcacattccaggcttgagaagagccatcaccccatccagccctcctcccctacacacccttccaggcagttctgcgatgggacccattcacagatcattgtttctgctatatatgcccccacagcccagcccagcccatccacgcagccctaggggtacaatccagatttttggcttccgcgaaaagaaatcctttgcatgtcctctttggttcacctggagagataggctcagcggcagatcacgcttaagctaacgtttaccgcagggcctgatgctctgatctgctggaggcaggctataggcagggggtaaggggctctctccctcgcagagcgcagtgaaggattcttgggggctgggagtcaggagtttttaccttggaagagtgcgcctcacatctgtgtggattttaggcaggagaagagcatcaagggtctcaccaaaggcttgccactcactgagggagaggcctggattctgggaccccaggagagtctctccagcagggtcttggctcccctatcctcttccctgccaagtcggccctatgttcctaccaggacccagaactccgatccagccacgtcctttcccctgggcttgcaggcgctccctctcgcccccgctaggccttagcgggctccgaagtctgctggactggggcaaaccccgctcttctgggacggggacacggcctgggccacccgtggctgccgggactcctttccaacagggctggggatgggagagttggaaatcaagaaagaacctctgcctccagtgcacgagcccagagcccaggctaccagaacccgcttgcagcaaggtaactgtgcgtcctgtgccttcttgaggcggcggcagcgatcggccctgaccatagaggcggccgtggcgcggaggacttgacctttacggcacgagaggagggcgctggctgagccgcagggagggggacgctgctctctccagcctcctccacccaatagcagtccgctcgacccacgccagctgcgcgctcaccccctttccccctccattttgtgcagtgtccgcagacccgcggccggaaacaaagcccccagccctgctctcaccacccttcttgcaagctgctgtcgccaaccccccagaccagaggctcagagctaacgctaagccccttaaggccctctccagggccctcttctctcgccagccgccctcagccagctcctgaccccagccgccctcagccagctcctgggtaccactctgggtgccaaccgggacctgccggtgccacggtcccgtgcgccgggtcccggcctcgggctgcgggcggcttcggggcctacagcccagcggcgcggagcgtggcagaggcgcggggcgcagcgcagcccgaggctgcctcccgcccgggcggacggcgcggccgctggggtgcacagcgtagccccgcgtgcccggctcgctctccgttccctcggatagctcccaccgctcggctccgggctcagaaagcggaagtatttggtagagaaaaacacggtttcttttcagctcgtctcaaaatcccttttagagaaaatgctcctgtcaagttttatttcccgttgcaaaccaccttccacgctgccaagaattaagaccgggagagattaaatacccgattattctcctggggagggcggggcggggccgggaagtgggcacccacaccaaacattccttgaagtaggcttgtcctgatccagccgcgcccggggagccccacgaaggcccgcgcggcctgcggtgacgtcagcctgcagttgcggggccactcacccgcacagacacggcccttgctgttccgcgccgggacctccgccagccgtcctgccg

SEQ ID NO: 1575 - DNA, 7195 bp, Homo sapiens
gccgtctcccggcagccgccgccgccgccgctgtccgaacttgaagttgccggcgcgcccgttgcagccgccgccgccgccgcggaggtcgccgtggccgccgggggccccttctcggcgctcttgtccccggggtagtcggaggaggcgaggttttccggggtgccgtaggctgtctcgaaaaactggtcgaaagcctgtggcaggacgccgttcctgcccacggtgctatagaaattggacgagactgcgggggtggggtggtggtagacgttggccgagctcttggccagcacgtcgccaggcacgccggccgcgctgggcgcctgcaggcagtctctgtgcacgagctcctccgcggagtagcagtgggccagattgccgcgggggtgccatttagtggcgggctcaatggcgtactctctgaaggtcacttcgcgcacgggttggacctggggcaggttggaggagtaggagtatgtcattgggcgcgaagacggggtctggggcagaaaagaagggaggctggagaaatctggacccgagacgtaggtcctcgttctcgagtgtgcagagggcggtgagagctcaactctcgtccccacctcccacccgcagctccccgggtgggtgagggatgccctggactggggatagccaggtgggagtccgtcgctgtgtggcctgtggtctcggagtctgttctcctggagtctcgcatttgcacccccttcttcgcagtccccctcccatagacttgctctgggaagcgcctctgcctccgaccctagccggaaccccttcggggccagagtttgaagccgtggatgtgcctgcctggtggcttgtccgatttgcacggtgacttgattacactctctcattcatggtcacttccgaagcgctttagtgccttccgtccctaaaccgccaacagccagaacggcttctccccgcggtttgtcactgatccgcagggcccggaagggccttcgtcttacccgggatccacctctcccctcatcttccctgcctacctcttcatcccaccttctgtccttggagaaactccctcctcctcgctgcctgccgggcttcggagtgactcggcagagacagaggcacaggggctgccctgctgctcaccggtccacccatctgcctggtcttctggagctgaggactcgggaaaccatgcaattgaggcaagccttgggctgctttagaggcgctgacatccgaggagacttctcctgggattgaaggagcaatgtttggaggaagcgaaagaaaggagaggacacagagcacagagcagccaggcagagccaggagctgagaagggcccagacctgaggcctcccaacaactctcttcttggaaggatctgggatgttgctgaaggaaaataaaaaaatatgtaaaaagataaccttttgtttttccctctccaggaaatagccaaagttatttacatatcttggggagatttagagtataaactctaagatctttggtatttaagtgtcaacatcgatttatttatttattgctgagctgactgtaactgactcaataacaaatctaatcgtgtattgcactggaaaagaaatattcttattatgtattttctccaaataatggcctaccattgcatttgaatacctgctgtaaatatcaataatatgaagtaattactctgtagtcgagtaaactaatttattagcattaatgtttatgtggctctccacctccccccaccaccacctttacaaggattgcttatcacaaatcaagctacttggacacattggtttaatgaactctttattcaagatttgctacaagaattttcatgtcctttgaatccctgagaactgaacttgaaattatttgtgcatcttcagcttgacatatttgtccactgtggcttgtccagagggcagcagtgctgtgagtgagaaggtccagtgggaaggaaggttattggagaagagtagcctcagacctcctaaagctgggaagcacatttacagaattgccctgcagcgaaaaaacttctatttccagcagtgaccaacaaggcaaaatgtttgtttctccacagcatctcttttttagagacagaatataaaagacagaaggagaggtttcaaacagcggtattcgagctgttccctggcttgattttggctatcccaagctctctctctgcagcccacccagtccacgccacccctaccttcgaacaaaaggaatgcatgaagggtttcagtgactttgccataacaaaggcgccaccattgcggggctcgccccgcccctgggtgaaggcaaacaaattcttgcacttgtattagggcttttaagaccataattgaacccgggggcgtctaggaaaaccgaaaacagttctagacagacctgcggttttatagcagttttggcagtcaacttcagcttgtgcctgagcagacggggttgtggtggcccgccagcgggggatgccaggccacctcccccagcggcacgcagcccctctcttaattagatcggttttcccctggtgtccgggagagcggtcccggcagaaaggaggtccaacagccgagcttagcccaccgggctctgggaaagacccgactgaggctaaagccgccccggaaggccaagtccgagttccatttcttgaagaggccggcgcgcgtaaggctgtgacattggccctggcgactggcttcccaggagctgttctttctcaggagctccacagcgcgggccatctccagaaaactgtcttcagagtgtatttccttttatcgtcaacccagagccccaccgcggctaatgcaagaggccaaaaaatgtttggaggaagaaaaacaaaggcaggaagtggcggcggcctgacggtgcgtgtgtgtctgcagagaagggagggagccggctcagtctcttcttgtttttccaaacttcaaggtccaggcagccctctgcagggccgggccccattgctccccgcgcggcattggaggtggccgcccggagaggagaaggccaacgcctgcgccaggcttgtcaggcggaaacggctaacaaggagatttggtcagcaaaacagacccagcctttccgaggcttcgtctgacttggcccgaaaggttggggagggggggcttgcgcagagcctcagggaccctcctctctggggactaccatccctgagccttacgcttctttccacagcctttgcaggcggaatatcggaataaagtgggtccaggcgcctctgccgcctccgcttcttcttgcagcctgaatggtccgggaggcagcgggagggcgccggcgggcagtgcccaggcggggtcgcctcgaggccgtcggtgagcaccgggcaatgcgaggccttgttaccgaggttgttgtgctgggggcgtttccagcacagtcattcaagggacgtgagctgcaaggatcgtcacttgacaggcggcttaacaccctctcactccaagggaggatacagctgggtggccgggagcacctccacactccaggcttcccagctccaactggcaaagctgctgggccaccctcttctctccctggggctggcttgggaggcagcagctgctccttgtcccagaaatctgagaattcgaagtccccagtacttgcacatgcagccctttaaatgcccagcatttgtccacagtctcaatgtcaatgccaagctgccccagtcaccactgtccttctcaagggggtcctgtccctctacagttcctgatcctgctcctgtcccccctacagttcctgtctcctgccctgcctccttccagccattctcacctgctgggacctcctgtctcttccctacctcttttgatgcctctgctagactgagcaacagctgaggtgccactggagggcatccaatactcaggcgcagagaagaggggctgttaggtccctgactctcccccaacttcgggcttccaccagagcctgaactgagtctcccacctccttcttaggaatactccacctcaaggccccaccaagtctggcttatctcccttcctctcccctcccttctctaccctcctttcttccccaacacttcctccttctcttctgcggacccagctgctgcttttctaggctgggcaacccagatgggataggcctgggaggggtcaggacccacttgacagactgaatctcactcccagatggctacagttaagtttctctcttggtggattgcttagggcaccatcattattttgcctcctcctgcttgcctaatcccttactttcctctgtccacaaatgtcacactgtttctagaaagctacacagaagagtatttcaaccctggtgaccatactgcacacaggtgcaagaactggcccggaggccccgggtagaaatggcaacagagctcttctccattacaggaatatctccttccaaatcaaagggttcctgtgggcacatctgtcttatgtggtgagctaggggagatgggttgtctgggaaggcccaggagatctccacgtatttgttctcagggcatggcttattgccagatcatagacaatccatcacattttccaggcgctgcccagaggcagcactgaagcttcaattaaaaaatcaagagatcacctctatcactaccaggtggaggcaggggttaatttgtccctttgttgagacacctcaccctccccgaaggtccccaacacttcctaaaagctcagaaacaggtaatgccctgaagtggacctcataattctgcttggtctgactggcagtttcagtcatccttcaaagcccctaaatatctgaaaaggcccatacccttcccctggccactgcagagtggggcacagggctcagctgagggtctcaagtacctaagcaatctagttatcatttactttagtggatcccaaactgaagggagaagagaagattacttcctttaataactatttttatttttattgttgccaattattagacttctttttcctatagcatgggaacaaatggggtgggggagactttgaagggcgaagccctagttctcagtgtctgccttccattccccatgcagctttggcccaaacaggtttcccagcagagtgtgtctgagataaagaagacaaaagggggtggcccaacccgaaggttggctctggtccttgggtctcggtctctacagccgtagctcacaggaagcccccacgccacaaagctccaactgcttcctagggcagctccatttccactcagtgctcatgttggctcacattccaggcttgagaagagccatcaccccatccagccctcctcccctacacacccttccaggcagttctgcgatgggacccattcacagatcattgtttctgctatatatgcccccacagcccagcccagcccatccacgcagccctaggggtacaatccagatttttggcttccgcgaaaagaaatcctttgcatgtcctctttggttcacctggagagataggctcagcggcagatcacgcttaagctaacgtttaccgcagggcctgatgctctgatctgctggaggcaggctataggcagggggtaaggggctctctccctcgcagagcgcagtgaaggattcttgggggctgggagtcaggagtttttaccttggaagagtgcgcctcacatctgtgtggattttaggcaggagaagagcatcaagggtctcaccaaaggcttgccactcactgagggagaggcctggattctgggaccccaggagagtctctccagcagggtcttggctcccctatcctcttccctgccaagtcggccctatgttcctaccaggacccagaactccgatccagccacgtcctttcccctgggcttgcaggcgctccctctcgcccccgctaggccttagcgggctccgaagtctgctggactggggcaaaccccgctcttctgggacggggacacggcctgggccacccgtggctgccgggactcctttccaacagggctggggatgggagagttggaaatcaagaaagaacctctgcctccagtgcacgagcccagagcccaggctaccagaacccgcttgcagcaaggtaactgtgcgtcctgtgccttcttgaggcggcggcagcgatcggccctgaccatagaggcggccgtggcgcggaggacttgacctttacggcacgagaggagggcgctggctgagccgcagggagggggacgctgctctctccagcctcctccacccaatagcagtccgctcgacccacgccagctgcgcgctcaccccctttccccctccattttgtgcagtgtccgcagacccgcggccggaaacaaagcccccagccctgctctcaccacccttcttgcaagctgctgtcgccaaccccccagaccagaggctcagagctaacgctaagccccttaaggccctctccagggccctcttctctcgccagccgccctcagccagctcctgaccccagccgccctcagccagctcctgggtaccactctgggtgccaaccgggacctgccggtgccacggtcccgtgcgccgggtcccggcctcgggctgcgggcggcttcggggcctacagcccagcggcgcggagcgtggcagaggcgcggggcgcagcgcagcccgaggctgcctcccgcccgggcggacggcgcggccgctggggtgcacagcgtagccccgcgtgcccggctcgctctccgttccctcggatagctcccaccgctcggctccgggctcagaaagcggaagtatttggtagagaaaaacacggtttcttttcagctcgtctcaaaatcccttttagagaaaatgctcctgtcaagttttatttcccgttgcaaaccaccttccacgctgccaagaattaagaccgggagagattaaatacccgattattctcctggggagggcggggcggggccgggaagtgggcacccacaccaaacattccttgaagtaggcttgtcctgatccagccgcgcccggggagccccacgaaggcccgcgcggcctgcggtgacgtcagcctgcagttgcggggccactcacccgcacagacacggcccttgctgttccgcgccgggacctccgccagccgtcctgccg

SEQ ID NO: 1576 - DNA, 5769 bp, Homo sapiens
cccagcttgactaaaaggacgatcaccaggcgcatgggctgctgggaagatacaatgttggcaaacagggagctggttccaggaaagaagggcacatgagcaaacatgatggcccctttatgagaggtaatttactgaaatgcacagcgattacctgctcacccagccctgatgtaattaaaaatggcaggctaggggctctgtttcccccggctctggcagagaaacctgggtttcgacttgtgaagcttgaggttggatgtgggaattggcttggagtcataggcgatgagagggacattaggatattatgaagcccgtgaactcaactcctgagaaggacgcagcagagcgagagaaaagatggaataaaaaggcctacctcattgggctcgtgtgggtgaggagaactgaagagtctgagagcgcggcacgagccagaggctacggaaaacactgccctcctacactccaccttggagagacccagaaaagaacaagcttcatttgtaaaaaaggaaaacaactcaggcaatgggggtggcttaaaggcactctacagtgtgcagatgccttccacttcttccatctgccctgtctctccaagaacccctatggccccggtctcagaacagagctgagtgcagaaatgaaaatctatggctctgtgttccaaaacgatgaagaatttcaagatggtggcagtggtaaaatctttctccaggaaaaatctgtccttggcccaatgtgtaaacacttgctgagtattgtgaaaccagcaacttgttcacaattcttctgaatttcttgggaaatttgaagtggagtacctgtaccaacatgaaatgacacgaatttaagtgacgctcaacaacgaaaagcaaaaagaaccaaagaggaagcaactgaaacaacatctggatgtatttaaaaatatacaatgcctccaaaatcaggtgtcattaatgaaaattctgaagaaatgccaccggacatagccaacgcacctacgctgttgttattcatttcctgcttttcacagaaaacaattttgttgcatggaagatcgtgaacttcaaagggcagaggggaaactgtcccttggcctctacccctccaaggccccacttttttgtcaacactccttggacgcagcagaagtatgaacataatatggtcctgaatgaggctgagtctttgggcgcagaagacccgggttaataaaaataggaaggtaagaaaagaaaagaaaaatcaagacacatcataggactaaattcctattatttatccactcaggattgaccacccctttgggccagatagttgtacccccatgtaccaggtgggcacatgaagacacaagaagtgctgtgatggttcattttgcacgtcaccttgcgtggagtatgccaactcattgtttggtcaaacactagtctggacatggtggtaaaggtattttttagatgagattaacacttaaatcagtaaagcaggttacccaccatactacgggtgggccctgtccaatcagttgaaggcattaagaacaaagattgaggtttcctaaagaagatggaattctccttgagactacaacatagaaaccctatctgagtttccagcctgttgccctgtggaattcaaactcaggactccggtctatgacattaaccctcacttaacttttcagcctgccagcctgccctatggatttcggacttgccagccacacaattccttaaaataaatctctccgtctctgtctgtttctctctgtctatatacacacctgcatgcatatatacatatatatatgtatgcatctatatatttatatctaatctcgtattgcttattggttctgtttctctgtagaactctgcctaatacagctgaagatgtattctctttagaaagcttgcaattactggggaacaatcagtacagaagtcgacaattacagaaaggggactagggtaatatggtggccaatgtccttgtgagtagtggtgacagagggcaacaagttagagactgccaagggaaagtcaagagcaagggaaacagagatgaagtaggttcagccaggccccaccacctacccagactaaacctggagagtctcttttccctttagtcttttaaaaatattttatttctgtacttcaatggatgcaagcccctaagtcctgaaggatctgttgtttgttgtgttactccaagcaagtattagcctagaagggacctcacctcccaacaatgaaatgcaactcttacattttatagattgggaaaccaagtctctgagagctttctattaaagtgacaaaggtactggatcatggtaagcaggaatatgtacccaaaggagtaatagcagctgttcatatgcattttattctaatgcgccttcctgtgatcatgttaaatgaattcctgggtttttaccaaacttgactcttttgagaaagaaccaaaggagctaaaccaaacaactcttggggatggatctgcaaatgttactcctgagctatgggggctccaggtccacctcacattgccccctgcagtcaccctcatccagccctagcccccaggcagattgtccctgcagactggcaaagtcatttccaggtgtggtctcagagaacctctctctggaatggtagaagggtttgtagccataagagctgatatcaagggggcttctagaaatctagaaaatttaattccccagaatgtgcctgagagttagtttctcctctagagtccttttcttaggaagcaccggagtccatgcttgctcttatatttttatccaaatatcacctctattaaggcatcaaagtcccgtgagaaacaccagctcatgccctcttgtcctccccgactcctactggatagtagggacagaaaagtggagattattccgcattttatagaaagagaaaccaaggtgcagaggagggtggaactagcttctgatcctaggctacacccctggcaaactgggaaaggtgtgtcaggaggagttgccacaggcattggccccaggaaagccctgctttgtcactttgagaggacagggcaccacctaggctggccttgccaattagaaccagctctgctgctccaaagacacccaggccagtgaggggtccacatgtggacaagctttaaaatcataattcttccctctgacagttccctgaggtccaagacaacctgtttggtagtgatgctctgtgaccctctggctccctatcccagggatgtggggtagagctgcaccctaagtctcttcttactgtgggcgataaggattgcagccattagccagagtaggggggagagacatcatctgctaaagtaggaagggcatgtggtctgaatacctgaaatttaatcccaatcctttttttttttttttttttttttgagatggaatcttgctctgtggcccaggctggagtgcagtggcagaatcttggctcactgcaatctccacctcctgggttcaagtgattctcctgcctcagcctcccaagtagctgggattacaggcatacaccaccatgcccagctaatttttgtatttttagcagggacagggtttcaccatgttggccaggctggtcttgaactcctgacctcaggtgatctgcctgcctcggcgtcccaaagtgctgggattacaggtgtgagccaccatgcctggccatttctttttttcttctttaaactagctgtgtgaccttagataagttactgaacccctctgagtctcagtttgtgcctctgcctctgtaaaacagaaatagtaagaataactacccccaggggctatcagtgacttcacacaaagtcatgaatgtgctcatattctgtagactgtaaagcactctaccaacattcactgccattctttcttgatatgctttaaaggagatgggggaaagaaaggatccagagctgggaaattctgctttctcaaatcctttcttgttacagtgaggccgtagtccagagagtttaagcagacagctctaagtcacagagggcaggaggcagggtttgcattgagcagtgagggtgggtagggaatgaggggactgtgctagcgcccagagactggaccacgatgagaccctggaggaaccctgcaggagggtattagggcaggggcagcgaggtagggggagccaggtgggcagtgggctaaggacacagtgctgtcgagtggggatatgccagccctggttaccaaaacccacgtgggggtttctgagttcaaaggcatgtggatggtgcagccccctgctgagatatgactgcagctttggaaacatgataaaataaacacacgacgtgggtcttcagaccacccccgattagcagctaaagaggtggatgggtagaagaaaaagcagaggttttcaaagaacaaaaatacaacaaggcagcacatccgtccccgaggttgagaaatgtgggctgcactagtttccgcatcatcagaactgtgcccgagtcagcacagttctgagcacagggagaatgtagagcacgtggggcagggaggcagggtgcatgtacctacgaagtgctgcccccacacacatcccttaaaggagagttaccctagaaatgatctgaggattctggtaacaagagttgtcattcaagataggcctgactcatttcttccatgaaggaggaactgaacagtcagcagcagagattagaattcttatccaggcagatcttgagtgcttccctccctcctaccaaagtattctctcttttggcatctccctgccttatattttgccattacgggttgatcctgttggcttgtcagtctccaacagttctctatacagacgcaaatgttctggagaggcaggccacaggtcagccccagactgtgaacccagctcaggcagccaggacccaggactggttccatcaggggcatgagggcccacaggagtgagcgagggagaaggatgaggacagtgattattgttccccctgtatggatgaggaaactgagactcagaggagtaaagaaagcaatgagcagtctgaggttggggaaggccaaacctcacttcctcctcccaaatcatgtgtcttcagagtacattcaagggcaactccacgctctgtgtttcagagaaaacaatccttcatggctgtgcccacgctctcctcccacaccaccagatgtgcaggcagcgtggggtctctccagcatcccctgttcagacggcccgttcggaaactggacataactgtgacttgtgtgcctggctctgaataatcagttaggccagtgaaatgggagtctctctgtgtgtctggaatttgaactgagaccctaagttgggaccactcagaagtctgggagactcaagagtgaggtggccattacagagccacacacagcacaaggtattaagtcaggagaaactgaggcagccagacagacggggaagggagcagggcacagaaaaaaccaatgaggagagatacccaggggagaggccagagctgcctgatcaaggacgatgcccacctccaggacagggactcttaaagtctgcccagggatggcagggctgccatggagcagtatcccctgagatatggctctcatttttctgctttcctactggtgtgtttttttgccactctctagccctggctgtaccactgaggactgaattttaacaggcagcaggaaactgggattcttag

SEQ ID NO: 1577 - DNA, 5769 bp, Homo sapiens; identical to SEQ ID NO: 1576

SEQ ID NO: 1578 - DNA, 4744 bp, Homo sapiens
cccagcttgactaaaaggacgatcaccaggcgcatgggctgctgggaagatacaatgttggcaaacagggagctggttccaggaaagaagggcacatgagcaaacatgatggcccctttatgagagatggaataaaaaggcctacctcattgggctcgtgtgggtgaggagaactgaagagtctgagagcgcggcacgagccagaggctacggaaaacactgccctcctacactccaccttggagagacccagaaaagaacaagcttcatttgtaaaaaaggaaaacaactcaggcaatgggggtggcttaaaggcactctacagtgtgcagatgccttccacttcttccatctgccctgtctctccaagaacccctatggccccggtctcagaacagagctgagtgcagaaatgaaaatctatggctctgtgttccaaaacgatgaagaatttcaagatggtggcagtggtaaaatctttctccaggaaaaatctgtccttggcccaatgtgtaaacacttgctgaggaacttggaataacttgcagtgtcttgcagtattgtgaaaccagcaacttgttcacaattcttctgaatttcttgggaaatttgaagtggagtacctgtaccaacatgaaatgacacgaatttaagtgacgctcaacaacgaaaagcaaaaagaaccaaagaggaagcaactgaaacaacatctggatgtatttaaaaatatacaatgcctccaaaatcaggtgtcattaatgaaaattctgaagaaatgccaccggacatagccaacgcacctacgctgttgttattcatttcctgcttttcacagaaaacaattttgttgcatggaagatcgtgaacttcaaagggcagaggggaaactgtcccttggcctctacccctccaaggccccacttttttgtcaacactccttggacgcagcagaagtatgaacataatatggtcctgaatgaggctgagtctttgggcgcagaagacccgggttaataaaaataggaagaggaggctggcctttgccccacggccttggctgcagcaccatcacatgcctccacgcctctccatctcctcatgaagatctctctccagatagagaccatttcctccctagaggaatccttgtactatccgtaggtgagaacacttcacctcattacctggatgtggagtgttgaagctggaagggatcccagagatctggaaactccccaggagtttggatgcttcatctctgctgagacccagtgcctggcactgaaggtgctcaggaaataccttctgaatgatcggaagcccctgccatctgctaaactggatctatgatgacagaagccgaggaatgtgaggttcatctagagagttcttgtgaattttccaagggaggcacctgttgaattcaggcatcggcatgtgacttgatttggtcaatgaaatgtgagagaagtgacatccactttgaggcaggcactttccgaatgccatcaagctgagatgtgaagcggaagtgaggcagaggctcccttccttttgtttggcgcagttttctgtgagagagcagaggtgggagatgaggggacctctgccccagtgtttctgcatccaagctccagccttgttgaaggccaagatggagtctctgcaattccaaatacatcctgctctacctggatcactgccttgagctgggtggaaaggtcagtagacaaatgtatccacctggctttctaacgtagacccaggttgttgatggcatccgttcacctggctggatgcaggaccctggggaggtcatggctgaagccagtgctgcaggttagtcttgtctcgctgcatggatcctgttggtagtaaccttaattaaatgctataggagactaactaaatcgattttgtccccccttctattggtcaaattaatcagagtggctgatagagtgatgcattcatgggaggatttgccagaagctaaggctataaaaaccagggctagagttggtttgagacaattctccgtgggtctttcaagtttctgcatggtttgtgagcagagctactgactgcctttgttccagatgatctttccaaggatgttgtactacaagtatgagagatagtatctctctctgaaaccaagagcaggcaggcttagtgttccttaggaaagattcaccttccctccacttggggtttctctcctgtagtgcaggtgtgtgcaggagccttgtggcccttcctatgctgctctgtaagatttggagcttagggagccaatgcaaaaaagcactgcttctggatcctgctacttctgtgagtcatgaaatctttgatctctgacccaggagtcttgtgtcttctgctagcctccaagcagggtaaagtcatctcagacacctcacagttcttgatcaccatgtctggccagaaccatgcttgagtgtggcatgtctgtgaacatcatccatcgtgtatgcatcataggaagataaaagtcagccgctcttgacatcaccagaccatactggatgataggtgtgggggtcaccacccaccactttccatgcaggcgatcagttctacataaagatccaggaggctggctggagagggctggaggggcctcaggagtcagaccatgtgggtttctatcatgatcctccataccctacagcctctgttttcccatctttcaagcagggataacaacagcacctactttggaggggttttgtggggattcaatagtatggctccgcccaggaaagccctgatgaaggtagaacctgttatttgtgtttaccattgttattatcatccatatcattattctgcccacctggacttattctttgtaaggcttgcctctccctctgaacagcctgtatataatctaagtctatcttttctgcaccaaaattggccaatttatgtggcacccctcaccaccatcactggatgtgcctctaatctaattagactaatttcaatttcctggatttaattacttttaatttaattaatttagaatgcagtatactaggtgattaattaggagacgttactgagggattcggaaggggaattgcagtatgtaagtgtttaaatattattgtggccatagccaccagttgtcactttacacaggaggccgctgaggccctgggaggggcagagcttggagaactgggatgggacagggactcaaacagaagtctcctggcagcaagcacagagctctttcctttcactgcttttggcaactcccaggggaggcaaagaagaggcagctgattccagtgaccagcaagttggaactaagtcatgaattgtgggaggtgagaacacacttggtcttttaatagagtgatattttactgggtttttcatgtacatagtaaataaccataggtctccctctgagctatcacacacttctgttatttttcttttttgctacacacatttactgagtacctggaataatgaatagtcatcaccatcatcatcatcttaacaaacatgtatgtggtgctacatgccagatgttgttctgagtgcttttatattgattagctcatttaattgtcatcggagttaagtactgtaagtgaagtactgttgcttccattgtactattgcttccattgtctagaggactattgcttccattgtctacagtactattgcttccattgtctagaggagggatctgaggcacagagttagctctgtcaggaatatctattatttgtgttgtacaaagggacaagtcctagtgaatttcaggcttgtgccaggcaggtgggggagacagtctagggctgggccctttaggtcacacaggtttacctactccacctctgagaggtaataataacaccagcaaacacctgcagagccctgactgtgtgccaggtctgcttctaaatcatgttgtgtattgactctggacacacctgccctactcactactccctgagggtagattgagctatggctttctccatatctctgtttgtcaatcaggacttgagactacagttctgatggacccttggaggcagagctgggccagaccctctatcctgagcgaatcctgcagcatgagctagatccttcactctgaaatccagctccaattccaaggttactcatttaccaaatgagcccattgggcattttcagggctttgacccctgttctcttggaatgttgggttaggattcaggtaagaagcctgtgtggtgtaggacttcactctgatgcatgagcaatgcctgctaggccgggaccctcttgcaaggagaagtaaagacacaagagctggcttcaatatattccctgtgtggggactaggaccacagtgagactttcctctttataaatgaattttctaatagtctgagctgtcttagctgcaatgggcttgtcaacaggccatcactgggggtatccaaacagaaaccgattgacaacaatttgctcacttggtcttctcttcctggaaggctcatctctatcctttttgtcagttaactcctattcaacttttaagactcagtccaggtgtcacttcttctggaaaggcttccctgtaaaccccaacccagccccagactgggccagatgtcctttgtgttcccataatgtctcaggcatatctttatcattacacccactatatattgcaatgacctgcttatgagtttgtctcctctag

SEQ ID NO: 1579 - DNA, 2141 bp, Homo sapiens
ctttgcaataaatcttgctgctgctcactctttgggtccacactgcttttatgagctgtaacactcaccacaaaagtctgcagcttcagtcctgaagccagcgagaccacgagcccaccaggaagaacaaacaaactccagacacgccaccttaagagctgtgacactcaccacgagggtccgcggcttcattcttgaagtcagttgagaccgagaacccaccaattccggacacactgggattacagggccttggaagaaattttgtacctgtttgcctctgctggatgacgcactctgaacacagctacctaaaagtggaaggaaggaggccgggcagggtggctcacgcccataatcccagcaccttgggagactgagtcaggtggatcacttgagctcaggagtttgagaccagcctaggcaacatggcgaaatcctgtctctacaaaaaaaatttaaaacttaggcatggtggcacgtgcctgtagtcccagctactcaggagtctgaggtgggaggattgcttgagcctaggaggtggaggctgcagtgagccgaaatcacatcactgccctccagcctgagcaacagagcaagacccaatctcaaaaaaaaaaaaaaaaaaaaaaaggctaaaaggaaggactgttttgagctgaggcaaccccaaggactggtgacattccctgggtctcccctgccagcctcgtgtcataccccaagagaggctgggacacatctgtgaaacaggatgctgaacagcggaacacagcggacttgagccagcctaagtgggtttctgctccttgcaacaagaggcctgaatagaagccccttcttcaggggagtgggcatcagctcagaaagaggatcccatgggaactgactttgctggtgaccaaggccctaccaccagggcaccctgcccatgtatcccaagcagagggagcagaaccagcggtgtaactactgtgcttgacacccagggcaggtctttttttaactcaccgatcttccatgcaacaaaattgttttctgtgaaaagcaggaaatgaataacaacagcgtaggtactccacttcaaatttcccaagaaattcagaagaattgtgaacaagttgctggtttcacaatactgcaagacactgcaagttattccaagttcctacaggacaacgatgcacaattatttacttacttatgtttaaatatacctatcagtttgactttcatcctttggtgacattctaataatttatgtaaataattattcagagaccaatgagaggattttaataagtgcaaaatgttagcagacggtacaacattgataaatctatggtctgtattttgttctgccatttcaaaataattaaaaagtaagtttcaatttaaaaacattattgaaattcagtaaaatatttcaagcatgaactaaaatatacacttactaaacacaaatattacacctcacatttcatactctgtttcattgttttaaattttaaacagaaataactccaccggccacctagaatgatcaaatcaggcaactcaagttactttgtttcatcttcacaatcactgtgctatcattgttcattttgaatctactttttaaaagcaagaatatttgataccagataccagacacaaattatacctgaaaaggatgtcattttaggatttgtgtcccacctaaaggatacaattctgtaccctgacaatgttattctagaaataaatgcctatgagtgagtcttgtttcaagagccaactctacaactaggagttcccccaaagtaacttccatgtgcaataaagtttttattaaaggataagtattaaaattgtcctaagcagaaaaccaaacactgcatgttctcactcataggtgggaattgaacaatgagaacacttggacacagggtggggaacatcacacaccagggcctgtcgtggggtgggggtagcggggagggatagcattgggagatatacctaatgtaaatgacgagttaatgggtgcagcacaccaacatggcacatgaatacatatgtaacaaacctgcacgttgtgcacatgtaccctagaacttaaagtataattaaaaaaataaataaataaaaatttttaa

SEQ ID NO: 1580 - DNA, 6441 bp, Homo sapiens
gttcatacttctgctgcgtccaaggagtgttgacaaaaaagtggggccttggaggggtagaggccaagggacagtttcccctctgccctttgaagttcactgaaaatgaatttacaataggcagattaataagaggaaaaggcatacaaattcatttaatgtgcataagcacacaggaattgcaagaacatgatgacctaaacccaatgaggtccagatgctcatacgcctttcttcatcagggaagaggagatggaggagaaagtggctgttttgaggggtagaaaataatttttttttttttttgagacggaatctcactctttcgccaggctggagtgcagtggcatgatctcggctcactgcaacctccacctcctgggttcaagcaattctcctgcctcagtctcccgagtagctgagactacaggcatgtgccactacacccagctaatttttgtatttttagtagagacagggtttcaccatgttggccaggatggtctcgatctcttgacctcgtgatcctcccgcttcggcctcccagtgctgggattacaggcgtaagccaccactcctggcccagcaaatgatttttaagaggaatgaatgggcccaatgctccagacaatggttagtaaataattatctttggaaatggaatgggacttaaaaatagacaatttgggtcagtgctccgaagtatgggttgtaggtgtgatgtttaattttcaatctcttcctctgtgatatgggttttaatcctctagataatgaaatttcaggaaggggatggaaggcaattgtgttcctcttcggccatctggtttctaggtggatgagggaacttcagagaacagccttgtcctgtgttttgggagagacaagggattgagaaacaggaaggtaggaggggtagggaaggtcaagagaccttgaggcttcttctttagtccagcacgtcaaagcaccatattggggagtatcattttctgagccccaacagaggttgacacacctgggcctaagtcccagctcccccattcattagcaaggagttgaacccctcagaacgtgagttctgtctgtgcagtgaaggcatggggtgcccacatggtgggtgtagtgaggctgagttctaggcccagcacagtgcctgccatgaaggaggcaccccatcattttcataatgatgatttcattgctcttttacacgcaattaaaactcactaattcagacctatcagagagggcagtcaatggctggaaagtccacattaaaaaataattttaaaataatgtagttttattgctttaaaatatattactcggtccaggctaataaagtgttgcatagcaagcccttgggggacttgcattaatgaacaaataagaacaatttgaggttagtccatccattattggcatggaacagggtgtctcagaaagtatttgcaaatgcctcaaaacaaggtattatcttccacagattaagtgtttcccctgcaatcatcatgatgcattttcttcattcaccagtttctctctacctggaaagtgctccaggcaagttcagcacaggactgaccagattttaacagattctcactcagtgaagattgagcataagacatttcattgagttaggtcgaggcccttattttatattctttcctttcagagaaacctgtttcagggtgcacatcttggcctgcacctcccagagctagaattgtttccatcaaacagcaaagaggctgtgcttaggagcttgggctctgaacgcagacagaactgggttcaaatcccagccatccctaagataacttccctcacaaggttgctataggattaaattaggtatacagctcaagtacctgagagacacgaaagtcatgaatggcagtgaaagagcaaaagctctcctgcagcacagggaccaccatatctagaggtgagtcagaaaggcacgcacacagacctagtgaacctctgaggcataaggaatgctgaaattattattcctggtgctgggccagtccttgggtgatgatgaaatttgcctccagataggctatgattccaaggcaggagcctaggaattactgtcattattattattagcaacaaaaatgacggtttatattttacaagagctatctagcttctctcaaaagctccactgagacagtgtatatttgaggaaggttgtgcaagggccacggtatctgttcctctgggaattccaagtgtggactgggttctctcatcagagaaccacatcccagaattagcccagcacctgcagaaaggccttttctgagtgaaggtctgagttaagtccttgattctactctgcctcagggtagagaaccaccagcgaaggggaagttcctgggacaccctgagaacctgccatcagtcaccgtttattaagcacttaactctggatgggggctggcgctctgtgattgcctgactttatcctcattacattcagcccataatgtcaatgtcagaccattggccctcccaccccgcttcatcagaggagggagctgtgtcccagaaggcaggggggacttgctcaaagtcacagagctggtataaataaacacagcatgccagtcttcattttttcttttctttttttttttttttttttgagacaggatcttgctctgtcgcccaggctggagggcagtggtgcaatctcagctcactgcaacctccgcctcccgggttcaaacgattctgctgcctcagcctcccaagtagctgggactacaggtgtgtgccaccacgcccagctgaattttttatttttagtagagtcggggtttccctacattggccaggctgctatccaactcctggcctcaagtcatccacctgcctcggcctcccaaagtgctggtgagaggtgacagagtgctggcactcctcagagccctcgcttgctctcggcacctcctctgcctgggctccaactttggcggcacttgaggagcacttcagcccaccgctgcactgtggtagcccctttctgggctggccaaggccagagccggctccctcagcttgcagggaggtgtggagggagaggcacgagcaggaacccgggctgcgcgcggcgcttgtgggccagctggagttccgggtgggcgtgggcttggcgggccgcactcggagcagccagctggccctgccggccccaggcaatgaaggacttagcacacgggccagcggctgcagagggtgtactgggtcccccagcagtgccagcccacaggcgctgtgctcgatttctcaccgggccttagctgccttcccgcggggcagggctggggacctgcagcccgccatgcctgagcctcccacctgctccatgggctcctatgcagcccgagcctccccgatgagtgccgccccctgctccacagcgcccagtcccatcgatcacccaagggctgaggagtgcgagcgcactgcgcgggactggcaggcagctccacctgcagccctggtgcgggatccactgggtgaagccagctgggctcctgagtctggtggggcggtggagaacctttatgtctagctcagggattgtaaatacaccaatcggcactctgtatctagctcaaggtttgtaaacacaccagtcagcaccctgtgtctagctcagggtttgtgaatgcaccaattgacactctgtatctagctgctctggtggggccttggagaacctttgtgtccatactctgtatctaactaatctgatggggatgtggagaacctttatgtctagctcagggattgtaaacgcaccaatcagcgccctgtccgcacagaccactcggctctaccaatcagcgggatgtgggtggggccagataagagaataaaagcaggctgcccgagccagcagtggcaacccgctcgggtccccttccacactgtggaagctttgttcttttgctctttgcaataaatcttgctgctgctcactctttgggtccacactgcttttatgagctgtaacactcaccacaaaagtctgcagcttcagtcctgaagccagcgagaccacgagcccaccaggaagaacaaacaaactccagacacgccaccttaagagctgtgacactcaccacgagggtccgcggcttcattcttgaagtcagttgagaccgagaacccaccaattccggacacactgggattacaggtgtgagccactgcgcccagccaagcatgccattctttagaagatgttctctcctggcacatctcagtttctacaaaggcccccagcccttcctggagacccctggggcgaagttctctcacccttcttcacatgcccataacaactcacctccctctctcttagagcccccgtcctgcccttccttgaattctggtcatgctcatgtttgccatagctccccaaggaagacagcctctgagtcaggtctgacattgtctgtccttaaagaaggcacttaacacatatttgtcaactgaattaataaaaatttcccacagggccttggaagaaattttgtacctgtttgcctctgctggatgacgcactctgaacacagctacctaaaagtggaaggaaggaggccgggcagggtggctcacgcccataatcccagcaccttgggagactgagtcaggtggatcacttgagctcaggagtttgagaccagcctaggcaacatggcgaaatcctgtctctacaaaaaaaatttaaaacttaggcatggtggcacgtgcctgtagtcccagctactcaggagtctgaggtgggaggattgcttgagcctaggaggtggaggctgcagtgagccgaaatcacatcactgccctccagcctgagcaacagagcaagacccaatctcaaaaaaaaaaaaaaaaaaaaaaaggctaaaaggaaggactgttttgagctgaggcaaccccaaggactggtgacattccctgggtctcccctgccagcctcgtgtcataccccaagagaggctgggacacatctgtgaaacaggatgctgaacagcggaacacagcggacttgagccagcctaagtgggtttctgctccttgcaacaagaggcctgaatagaagccccttcttcaggggagtgggcatcagctcagaaagaggatcccatgggaactgactttgctggtgaccaaggccctaccaccagggcaccctgcccatgtatcccaagcagagggagcagaaccagcggtgtaactactgtgcttgacacccagggcaggtctttttttaactcaccgatcttccatgcaacaaaattgttttctgtgaaaagcaggaaatgaataacaacagcgtaggtactccacttcaaatttcccaagaaattcagaagaattgtgaacaagttgctggtttcacaatactgcaagacactgcaagttattccaagttcctacaggacaacgatgcacaattatttacttacttatgtttaaatatacctatcagtttgactttcatcctttggtgacattctaataatttatgtaaataattattcagagaccaatgagaggattttaataagtgcaaaatgttagcagacggtacaacattgataaatctatggtctgtattttgttctgccatttcaaaataattaaaaagtaagtttcaatttaaaaacattattgaaattcagtaaaatatttcaagcatgaactaaaatatacacttactaaacacaaatattacacctcacatttcatactctgtttcattgttttaaattttaaacagaaataactccaccggccacctagaatgatcaaatcaggcaactcaagttactttgtttcatcttcacaatcactgtgctatcattgttcattttgaatctactttttaaaagcaagaatatttgataccagataccagacacaaattatacctgaaaaggatgtcattttaggatttgtgtcccacctaaaggatacaattctgtaccctgacaatgttattctagaaataaatgcctatgagtgagtcttgtttcaagagccaactctacaactaggagttcccccaaagtaacttccatgtgcaataaagtttttattaaaggataagtattaaaattgtcctaagcagaaaaccaaacactgcatgttctcactcataggtgggaattgaacaatgagaacacttggacacagggtggggaacatcacacaccagggcctgtcgtggggtgggggtagcggggagggatagcattgggagatatacctaatgtaaatgacgagttaatgggtgcagcacaccaacatggcacatgaatacatatgtaacaaacctgcacgttgtgcacatgtaccctagaacttaaagtataattaaaaaaataaataaataaaaatttttaa

SEQ ID NO: 1581 - DNA, 1706 bp, Homo sapiens
tacaagtataattaaagtgatgataacaatgaatcttttaaacacaatgagaacttatttgccatattagtaacaagattctagggattccactgttttcagttcagaaaatgatgtcctctacatttagtttttaaacaaacaagcaagttgaaaaatcaaaagaaaatcatgcaaagggtaattttcattacaaactaattaagatgagagtataggcatgtaggaccatacatcaaaatatctagcacaggtggcatatactaggcgctcaataaatgcatgctgaatctgatttgcaacaattaaagttcctttgtactaaagttagtccatggcgtgagacagaggtaacagacaaaagtcaagacataatagtatcctctgggaagttatctaaccccacctgatgcttaaaattccctccctcctgcctccctgaacccctttctctttctgaattgtggattaccagttcacaggcattccctacattcccccttcccaaatcggcatacctgcaatatagaccccagagctgcgcccagcttccttttcaaggaatgacttgatgtgggagtgcaggtagtggacctcctccagccttcagctatttcaggccctgccctggctgcagagacattctccacctgaggtcacactcttgccttcagctatttcaggccatgtcctggctgcagagagacattctccacctgaggtcacactcttcccgggatagcccacaaccttgactgagggagatgcccacagggaaaccaggtggatgggcaatattcaatctggcattcccgaccagcttggccaaggccttttcaggctcgtatcacagtctaatgcaaccatggagactgtatgaagatgttgcttccctacctgcacctctggcccgatttacacataagcacactcacaaagatatgtctacaggctgcatggctctgttattgactactgaatggtttccaggctgtctttgtctcaaggtcaatcagactcaagttccacttttttttttcctcttgtaggaagatttctttattggtaagctgatttaaattcctttgcagatattgaaccaaatctgctcaggctgcagcctcctgggacctttcactctgggctaaatataaataaatacccatataggacagcttttgatgaaacattaaagatcactctggttatatggcttctagattttctattttctgtatgaaaaacccatggcggtaaaaagaaccttcgccacggaaaggaatagatttgtaaattgctgcctatggacctcctgggacttaatggcacagggcaaagaagcagctgagcttggcaaaggaagcaagataaataaaattagccaccaaatcagctcctttaaaaataccagctgtcaactccctccagcgtttatgaatttgggggcatgttactgtcacattgtgtctcacccaggaccaagcagcattgctcttttcaactgggaaagggtccctaactcccctcacagggaaagctaatgcaaaaatttgccctttctctttcactctgtctcccttgtcatgtgtgcaaggaagaaaccaatccaggccaaccaagagttattgctataatgattatacttgtcattgtttgttcttaaactattcaccaagtaatccctttaaagggtagggctactggct

SEQ ID NO: 1582 - DNA, 1706 bp, Homo sapiens; identical to SEQ ID NO: 1581

SEQ ID NO: 1583 - DNA, 3119 bp, Homo sapiens
tgagattcagcatttcaccagcccaagttgtaggaaaaactccaagtggcagggttatacctggttctcttcatcctgcgtctttcctccaccaggtaaccccagatcccatgaggtggcagtgtcaccattgccccagcccagagtcatttcaaggaggagcaggtcacttcctgattcccaaagcatctgcctgtaccattgaaaacttattcctgctcagtggtctaaaaagcgatgctgtccattctcagaaatggagcagaaaggcaagagaaaggaagctgatattttgaatgtccactacctggcaagtactggaccagccacttgcatatacattttctcaattattcctcacaaaacctggatgagatgggtgctagcatctccattttgctgatgaaggaacggagcccacacactgaggaaaggccatatgagcacacaggaagaagactgccatctgcaaatcaggaagacaatcatcatcaagaacttaccatgctggcaccccgaacttgggcttctgttgtttaagccacccagtctgatattttcttatagcagcccaagctgactaagacaggcagtcaagaattaaaatctgcttggaggagcaccaacatacccattttaaaaaccttattatgtgaaatggctacagttatttaaactcaagaagaacatggaacaagaaagagaaataaagtcagtgagatgaatggactaaaataacctagcagttaatggaataaataggaatgaagccccttttccagtgttagggtcagcctgggatttatcaaggctctaaacaaaaggaattgatcatgagaggttagcagagacatacgggaagcactgcgagagtattcagcactagttggagatttgaattctaactttaaaattctgagacttttgatctattaatttatccattttcattgttcttttgctttgactataaagaaacaaaataaggcacaatcaagtgaaatctcttgtccaaggttcattcatttaagacatgttaaggtatgagagaatttgaagacataggagttcctgctcacaaggacatagaatgtggtaggaatgatgttcagaaaatccaagcagtgaaaacctgggtttgaaaagacattgggtaaataactgttataagattgaatgaatgggtggatgtattgatggatggacagatggatgggtgaatgaatgaataatacagtggttgttacagaggttcacagaaggcttgggtcctaaagtggcagcctctggccaggttgaacctatttgaccataggcattgaccattctctgacaaactggtagcaccctgtgcctgatggctccactatgagcaccagataaatatagacaatactgtatctgcctttgctttcctaacagcacagcctcagctccagaaatcaggaccctgactgtcccattgactcttggtgaacattctgagctccattctattccccttgtcattactaggggcctgtttaatttaccgatttattcacttatttattcaagaaatattaagtgcttactatatgccaggcactgttctaccctccgaggatacattagaaagcaaatgtgcttcagcttctgctgagtacagacagaaaataaaccaacaaacaaagtaagtacctcagtagtaagcactatgcacaaaaggcaggagagagggatagagtagggtgaagctgagagcgcaaggtttaaaggtgtggctggggaagattccacaggaaggagacctttgagcagagatctgaaggaattggcagagaggcccatgcagctacctggagggaaggtgctccagccagagggaggagcaaggttctgaggtgggagtgtgcctgggatgatggggaaagcagtcggtggaccatcacatcaggaccaagggagtgacggaggaggaggacatgatgaagagggaagaggggaaggacagacccgtgtaggaccctggaggccctaggaaggatgtgagcttttaccttcagccattaagtcttgataggattgctctggctgctggattgagatactgagaagtgggggaggcccaagcagaagcaaggaagccaggtgttgatctgatgagcctctcgctttggaaactcgggctcagcatctgctctgaagagacaatctgagacagctgtttcacatttcagtctctatgggattaccgccaaatgaccaatctgaccaatacatccagtctaatgcaaccatggagactgtatgaagatgttgcttccctacctgcacctctggcccgatttacacataagcacactcacaaagatatgtctacaggctgcatggctctgttattgactactgaatggtttccaggctgtctttgtctcaaggtcaatcagactcaagttccacttttttttttcctcttgtaggaagatttctttattggtaagctgatttaaattcctttgcagatattgaaccaaatctgctcaggctgcagcctcctgggacctttcactctgggctaaatataaataaatacccatataggacagcttttgatgaaacattaaagatcactctggttatatggcttctagattttctattttctgtatgaaaaacccatggcggtaaaaagaaccttcgccacggaaaggaatagatttgtaaattgctgcctatggacctcctgggacttaatggcacagggcaaagaagcagctgagcttggcaaaggaagcaagataaataaaattagccaccaaatcagctcctttaaaaataccagctgtcaactccctccagcgtttatgaatttgggggcatgttactgtcacattgtgtctcacccaggaccaagcagcattgctcttttcaactgggaaagggtccctaactcccctcacagggaaagctaatgcaaaaatttgccctttctctttcactctgtctcccttgtcatgtgtgcaaggaagaaaccaatccaggccaaccaagagttattgctataatgattatacttgtcattgtttgttcttaaactattcaccaagtaatccctttaaagggtagggctactggct

SEQ ID NO: 1584 - DNA, 3119 bp, Homo sapiens; identical to SEQ ID NO: 1583

SEQ ID NO: 1585 - DNA, 3119 bp, Homo sapiens; identical to SEQ ID NO: 1583

SEQ ID NO: 1586 - DNA, 1252 bp, Homo sapiens
cgcgttttggggaaaggcagagcagcgggagcgcggcgcaagggcaaaatggatcgttggtacccggaagcccgttcaaactgtataagggtgatcagctatcacggagaaggctttagcaagtcggggccagtggcgcaatggataacgcgtctgactacggatcagaagattctagaagcccatggaaacaaggcgatgacggcgcttgagggtgaccagacctcctcaatcattccatcagccacccaggactcaacagcagaacctcagaggactcagctgaaagaggttttcactcgagcactaaccacagagaaatgggaagtgccatcctgctgtcatacgcagccgatggctgggtaggactaaatgcccttctgtggtgagatgaaccaagacggcagatgggggaataacatcagtgagagagagattacgaatggatccttgtattgcagatcaaactgggttgtctcttctcaaaccacccaggcagtttctgaatgtcccaagataggggtaggagaaaagaaaaaaaagacaaaacaggagacggtgggtaagaaaacctaaaaggcacaatgaggcaaaggcctaagatggaggctggctttgggatctgaaatccggccacaatcctccttgttttacctcaagtccaagaattgtcaaaaagaaaacccagaagggctattcattctaaattttaaaatcttttcttcctggcctaccaagtccttgtgttttctttctaggcgcccataaatacaaccccattacagttctatttggctaataatttacagaacatttaaaataccgggtaggtgaacatctcttcatggcttttgtgtaagggcctgaagcgaagagaaaaacaactgattggagattcctatctggcgccttctccagggaaactgacaaccagagaaatctgttgctaggatttctaggacatctggaaattccctttttgttctttctcaacaatataaaatggtatattcgcaaacctatctgaatcacctcaatctaggccactttgaaaatttcatttaaaaatgtaatcacagatttttaaactaattacccaatttgcaaacaaatcccagctacttctggtcttgaacatggagcaaaggtgtgtcagtaaggccaacattcttaggttgacagagacaggttaacacattggctggcttcatttacccccctgccactgtgtggccctccctcagctcctgcc

SEQ ID NO: 1587 - DNA, 1252 bp, Homo sapiens; identical to SEQ ID NO: 1586

SEQ ID NO: 1588 - DNA, 1252 bp, Homo sapiens; identical to SEQ ID NO: 1586

SEQ ID NO: 1589 - DNA, 12650 bp, Homo sapiens
gttattcgtagattccggacattgtatagaagaacactgtgaaactccctgccctgttctgtttctctctgaccactggtgcatgcagcccctgtcacgtattccttgcttgctgaaatcaatcacaaccctttcatgtgaaatccttagtgttgtgagctcttaaaagggacagaaattgtgcacttggggtgctcggattttaaggcagcagcttgccgatcctcccagctgaataaagcccttccttctacaacttggtgtctgagaggttttgtctgcggctcgtccttctacatttcttggtcccctgaccgggaatcgaggtaactgagggatggccgaggtagccccttaggcagcttaggcctgccctgtggagcatccctgcaggggactctggccagcctgagtgacgtgatccaaagagcactcctgggtagaaaattgcctgggtggaacgcctcaccagaacagcacgtagcaggcccctgtggaggattaacacagtggctgaacaccgggaaggaactggcacttggagtccggacatctgaaacttggactgtgaatgcagcccgtgaaaaagagggttttcggaagcttgacatttatgagggtgaggaattgacaagccgacatcagtctccagagtgaatccaaggagtggacccaagacatttgtgttctgtgatgtggtggcatgttacctgtcatctccgatgcataactcctaaagtgcgtctggggcagttgtacagattgcagaggataatactcaagatgttctccaaggccaactagtcatcagtttattcatgtttctgggattggattcatgaactcatcctttgaactatttcaacaagctttttcatgtaactaatctgcggaaggtagaaaggggaaaactgttgggtgctaaaatgacaactggttcaagagctcccaagatggtggtgggccacttccaagatggtggcaagagtcgtattctctgacctggggttcttggtctcatggattccaaggaatggaatcttgcgccatgtggagaagcgtcagataattaggcagcagtccaacaattaggttttgtggaacttttactatgtcatctatttattggaattccccctggataccaggaccccctccagcagagcttaaagttatagttacaggaagtacaaattccttatgtggatccctggaagtgtgatgagaagaaccactgtttccaagatctatttattctatttatcaggcctataaaatcatgtaatggccatggcttcaactagactccacatcttgaatcacagaactcaacgaatggcatcaactacaagctggtattctgctatacatttaagaggccattttaatattctattagtctagcagcttctaagtgatgagggatatggggggactggaggatcccgtgctcacttccttttctgtaaaaggagctctttgatccaaggtgacatggtatgggatccaatgacaataaatcagttattctgtgaaccctgatcaaaacttgactaaacttttgacagttaggttttttcctgaccacagactcctcacctttcttttcttagaaaatttacattggaaaacagatgtaaattttctccagcctcttgcaaggtttacagtccaggactttgaggtcctgggagtcatccttttgaaatacaatcatcaaagaagatagtgctccaatctcctagtctctgtgggagggttggaacctaacttcagtaaactaatcaccaattagcaaacacagaggggctgatcatactgacccactttcccactaaaatgtctagtactttccaccagctcaccacagtgcttaaaaactctcctgtcttttgttttactagagttgagtccaatctctttcatctattgcaatagtgttgaataaagtcttccttgcctaacttgtcatgtgtattttttctctgactgccttcagagagtgttattgtccaagacactgaaaaatagaaacacaaccttcatctagaaaatgcaagaatctcagtaaagatgaatcattgttctgccaccatggaaggcagctagttgtagtcaattagccaaaaagtacctggttggtttccttgaggggatggcatgcgtattaatctggatccagtcaggacatagaaatcatagcaacaatttaaacaagaaaaattaatgtaaggtattattaactactaacaggagtgaaagagtgttgtacatgtaagactgagagagcaagaacaaggaaggaataagaacttagaagagacaccatcccccagcctgagaatcagatcttattagaaagagtgttgctaccccaaaaatatgcaaaagatcagtggggaagaagtttgctggaacatgtgggcttggattgttgggtagaaaagtcgtgtggggtggtcaaaaaattactacagagtgtttgccactaggtctctggcacactaatttcctagtagctacatcacaggaaaacaaaagtacaccagtaccaaggagagaagccccttcctcttactataacctttcaatgtccttccattgccccctgttgacaaagcttaacattgcaccagctggcaaaggagaaatgttcacgggattaagggccagtatcacagatcaggtcaaagaaaggtgaactaggagtttacagacaataaattaataaccagtgtcatatcaaggggtcagtgttggtctaaatttctgactggtcacacattcagtagcagcactggccgcttagtgagaaggagcccatagtgaaggtcccacttgtggcctgactttctccaatgctggcaactacaattgtgggattatatgcaagcactggagtggctgaagtcaaagggtggctagccactgttagatgagtctttctaacctagttgtctgtgctttctctgtgatgaatgttggtgggcaccgccatgagacacaaaaatcctcacattttatttactttctcatagtaaaatctgcatacttttcttcaaatgtctgctcttccagtcttactctgtactgtttttttttttctttttgactgagtctcattctctcataaggctggagtgcagtggtgcaatctcagttcacagcaacctctgcctcctgggttcaagtgattctcctacctcagcctcccaagtagctgggactacgggcatgtgccaccacgcccagctaatttttttgtatttttagtagagacggggtttcaccatgttggccaggatggtcccgatctcctgaccttgtgatctgtccacctcggcctcccaaagtgctgggattacaggcatgagccaccgcacccagctggttcttgacgaagaaactaggtctttcatctctgccccaaaatttattaataccctcagtgcaagcgtcttcttctacgtcaaagtgataacctaaagctttgttcaaaattctgtccattagtaagattttccctcaatgctgttttctgaagccatttctatttttggctggtatcaatacattggtttatagtaactagcctcttcataaatctgggccagatttacgtccacaggctggacataaggaattccatatgaagtcatagctgtgagctgaggatgagatactggaacaacagaatttggtacttggagtcttggtcacctctttttgtaacttacttgtcatctctgaattcatgtctctgaattctgattaggctgtaggcctaatttttgtcattgctatcatatggtggatttatattgtgcctatacaacttcattatttgataggttgataattcccaatttataattagtagcaccaataatatccttaatagtcacttgatatactggcactggacacttagtccctttgaggttaagctataagttaataaccaaatacttatcagtcaacttttttttaaactgtgattatgaagataagctccataaagagaaaagctaagtctgtctcatatactaagcctagtcatcatgaatattaaagttaggcacatagtaggtgttcagtaaatatttgttgagtaaatacatcctagagtaacttcatggaattatttgatgatgagagatttaaatcagtgccataagtcagccgataacaggtaatactttttcaattagacaatataagcatagctcagaattcaggttgtcctattttgcagcagcatcaggagaagaggaggaacaaggaaatgaggaagaagaggaaaaggaggaagaggaaaaggagaagatagtatttttcgtatctaaaactaagatttcaacatgccgtattcacagtgttcaaagggtgataccagtcagtgtgggagaaggaggagtgtgcttattattttatctagatgtcactgctattttttatgaatcaacttgctactttattagaatatgaaatatttcttttgtcttaaatttatatatgctggtgcaaaacttcttgagaattataaaatggctatgaccaactgtagagtcattttcagaatctatagcttgcgattccagaaatgaaatgctattaaacattagcaattaaagatgcagttgtcgttactgacctaaattcaccagttgtagtgatactaacataaagatttacaacatttttatgaaacattaataatctgtgactatgtcaaggtggggctgggagataaaaggcaaataccctttccatttcacttatgaagctgctttacaaggtttcaattagatctttctttttacccctgagagaaactaacaaatctattgcattaattatggtttcaagacaggatcatgacagccaaaattataaaattacagtcattgcagttgtgtaggctctacttctctcattctgtgtgcctgtagagttggaatgtaactttacaactgatatcttaagaggcagtgcaaatgcagaacaaatatgctgtgcagagcgagagaaagagaagtgataaagccaaagaacattgtctgattaatcaaacaaatcattgaatgtggcttataatatttaaaatgcaagactttaatccatcgattaccatttgaagtatattcatgtttttaaagaacagaacacgattatatttcaatatataatttctgtacagccaaaaaataaaacaccacagtaaaataatgggagaaacataatatttaaaatgcttgacaaaatgttaacatccttaatcataaatgagctcttagtaacaaagagattaactttacaagggaaatgaaaaagaaaaagaggaaaatgaaatagcacaaatgacttataaggttatgtaaagatgatatagcctaatgttaatagataaaaggcaatttcattataaattatattatcaatgcttacaaatattgatacctaatgtttgtatggctgtaggaaatgaggaattctcaaatactgggaaaatttactcctgtcatgagaaatttagtcaaaatatagattttgcatattctttgccctggcagtttcaatccataggaatcattccaacaaagtagttggatgaatttatatatatatatatatatatataatatatatatttttatataatataatatatattatataaaaatatttttatataatataaaattatattttatataatataaaattatatatatatatacacatgaatgtttactacatagaaaatgtgtaagtgatatatcatctgccgagtaaccacttaagtatcaactggtttataaaataagagattgggaggtggaattagaaagaaaaaaggcacttaagtaaaaatactagatttcacaacattctatgtcctttgaattcttaaaaaagatcatgttttaatgaatcagttttatgtttaccctgcgataagtaaaaattataaatatatgcattttatacttaggaaagcactgagatgaaacccttttaattccaccatcctgtctcctttgttcaataatgtatattcatgcttctatcaaattcagttttagtttttcatgtgtatgcatatatgcttgtatacacacatgcatacatagagtgggaaagagctatctctgaatatatattgttgtatttgtgtgtgtttatatgtgtgtttgcatatgaatgtttgtatgtgtgtgtgcatgtaggtgtagctagaaagaaagaaatgggaacttttaactatgagtccacagaactgtcccaaatcacaatacagctatttgaaaatagaaaggattggcatggtcatttattatttcccttaacatttttttaatctaaaaactaattgaatgcctcttctgaaaaatatattatgccaataatataccttatgactaaggcagtcagcagggtaaatttccagattattatttaaaaagctattgtctgtagaaaagaaaagccatgcataaaaatcttatctcttttgatatgggtagtatgttaaagaacactgtcacagcatttcctaaatctagaaaataaaatttgttggaaatatccgtattttaggatattgtctaaaaacatgattaaagttttaaaatggaatgtatcaagtgatccagagccacttaggtaactagctaatgccatagatgaaaagcacttgcaggcagagataactagttgtgagctgattttatatattcaaaaggaatgattttatttttgatgaaataaaatttaaaaaataatgtgcaatcaattaaaaatcataatatgcaggagacagacttagtagtattacatttaataatcaaggcaatgctttctgaaatacctaacttgtagaataaatcatatttatagcatgaataaattaggaaataggtgactgaaagagtaggttaattaaaattagtgcattttctgaactggaaaaggaaataccgtggtgagctagtctatcagagtctggcagtgatttcagccaaagtaatcaaagcagatgggcattcagaaatgaccccaaaagactttatttttatggtcatatactgagtcacagagcttaccatattatctttattcaaaacattattatcacatgaatatttgtgcagactaaatataattgcataacttcttgagaattaggcaagttatctattatacctttctttcaactcatttgcctcacttatgaaataaagataataataatactcatctcctatgatttttttaaagattgaatcaaataatatataagatagaacattggcacagactaaagctttcaataaatgaaaactagtacgttttaaaatattagctgtgctttgacgtttttggtatagcccccattaaagacgtttacaatttacaattatgtaaatttttgtttcattttatggtgtttgggtttataacagctttgcaagcagttaaatagattacaactaagtagactatgctaatctaatcaaagaggcgaccgaattaggcttctgtttttgtttttctttagcagttttatctatatgaaaattatcctcttcaagatctttcaggaaagcttttccactgttggagcacttttaataaatagggttttggttaagggaagaaaattaacaagagacctcaaagaaaattcacttcataaaggatatagacttttagatgacatagcaccttacagcgagtttggagatggagaagagtcagctgggaaataaaaagtcagctggggaaaaaaaaaaaagagtcagctgggaaaaaaaataaaataagattcaggggctaaaaatgaaatctgtaattggaaaaggtctacaagatcattatgtcttttgaattgcaaacaccaggtattataacttatgagaaagatgttttggagtatgcagacaacaggtgatctaatgcttctatttgttcctatacgatcagaggtcctagttcacattgcttattaatcagaaagaaggttttcaatttattggccttactcctgacctttcattccgttgaaactaaagaatcccacatgttggtattgcaaaatgagacaacttcatttacagttagatctgattttatatagcatattatatatagcatattgtgttttaattttgtttttagtagggggagtgggagaaggatgctgtaacattcacaaagatcaagaatacatgttatagacaaacaggtttaattcctacaagtgacatatgctatgtgactctgggcacacattctttaatgttaaggcctgttccttatttgttatttaatcaatagcacccaccacagagtgtgtatgaaacaatcacacaagaaatgcatattgaaaaagcaaatggtattttttaacttcatgttctctttcctatttaaaatgggaataaaaattctttataaattcgtgggaattaaataacgtccactaaacactggatagagaaagtacctgatgtatagtaagtcctcaatcaatagtagcttttattatttgtattaaaaatattcaactgcatgacaagattttttttggacagagagaactattactgctttaaacatcaggcctgtcaggaatttatatcatttactattattttatttatatacaaatttgtcaattattttgatacacattagaaaataaatttttttatcactggataattatgacagagttttaggttagcatttttatagttcggttggatttggaacagatttgatacagataaatcttgaaaacctaaattaagtgagaaagaagtttaatcccaggaaacatttttgtccctttttttacttttccttccttaaatacagtgggaatttagatggaagtgccaaatgcagttccctatatggggataaaattgcctggtaagaagttgtttttcttcctaccaatcgtttgtttcctggattttaatctatgaaagtcatcccaactgtcccttcttattattatcatacttttttaatcaaagtactcactagatttgatacactttaatttcaaaccttaatcaagcattgggttcatttctatgccatccttttgattgtcaacatggcttctaagtgtcattgagaactgtattgggaaaagccagccatttctgaagtctccttataagaattttctttatctgtttattatataaagtgcaatttgtaactaagctgtcctgtatttcttttgctgacagcacttgcagccagcgaaacagttcaggtccatgacttcatccgatacccactgattacccagtacaggatgatgatttttaactccaaatcagcactagctccctgatgactctaattccagtaatagcaatattgcttcaacaaaaagagaaggaccatctgagaccttctacatttattcttatacattagcttatcctgaagtgttcaaaaacctttggtggaggagatagtggaggaaagggataatattttatttttattaaactaaaggtatattcagaggcactcctgttggcttaatggaaaaggatatgactcattagtagctttttttattggtaattttgggtactagcagaggaacagtatcacttctattctctaagagccgaagttgatctatgctccttttgccaagagaactgctcccagggaggaaagtcttttctaccatgcctgttggcattattgctctgtcaatacagacctactttctccacatagcctctaatagccccgaacttacagatctgatagccaggttctatcacctgagacaactttggatcttttgaacttctgagtccacaatcctaaagaaaaaactattattctagggaaaaattaggtctagtcccttgggtctatcaattttagctaaagtaatatgattatataaaatcataatatctccaataggaaccagatgaatataagggggagaggagaagtcttttggcagtttgtcatgttttctacagtgtctcacttccacaccctcttcccaattagaattatccatttctgcacagaatggtaaaataatctattttgggctaccagaaaactatcaccaaacctcagcttgaccttgtttgttaatgtctcgttattgagtctagaaagtggtggtatctgagtccttaatcattcaaatttctctgctgtgtattaaattgcagaacttacaaaacatgtcaactagttttcaaatcctgatccaatgaatttctggtattgattctaggtttaaaattgcaccgtttctctagatcccattttacagttgatctttaagtgacaatttgatatatagtagcttttcatataatctatgttcatattacttcctagtcttttgtaacggtggtaggagaaatcattgtcaaccatttcaatgaactacaaagaaatagatgtacagaaaaagttaaggaaaaaatataccagaaatcttccattaaaaaacaggcagatgaatctgtacaagattgtagtacaaaactagcatgaacattgggaatcctaaatcaaaagctcttcacttagtttaagttcttgggacttaccactaatgagacttgaaattccttcaaaatttagtatagaataaaaatcagatttccaggaagacttgtcaaaaatatctaagcaattgaatcagaaacctattggattattttctcttaagtagaatacatcattttctttccataaatagacaacataaacaccacctgttaacaatgattcaattaattcaatcaatagagtcagtcttgctttgaggatcaaaactaagccaaaaccaaacaaagctcaaaacaatgttttccccacaataatagaatatttgtaccttagcttgttataaacatactaaaagtaatatgccatattaattagtctatgatgtcacaattgttgatgactcattactttttaattttttttttactttggcctcatctttattcttacaagtctaaaactcaaaattaataagatagtggtaaatcaatgataaaaagaccaaaattataattgtttcttacatcatatacaaaaatcaactcaagatggatttaagacctaaatgtaaagcctaaactataaaaaccctggatgataacctaggacattctggacataagacctggcaaacatttcatgatgaaaatgccaaaagcaactgcaacaaaaacaaaaaaaattgacaaatgggacctaattaaagagcttctgcaccataaaagtaactattaagagagtaaacagacaacctacagaatgggaaaaaatattttcaagctatgcatctaacaaacgtctaatatacaggatctataaggaacttaaatctacaagcgaaaacaacccccttaaaaagtgaccaagcacatgaacagacacttttcaaaagaagacatagaagtggccaacaagcatatgaaaagctcaacatcaccaatcgttagagaaatgcaaatcaaaaccacaaggagataccatctcacactagtcacaatggctattactaaaatgtaaaaaattaacagatgctggagaggttgtgcaaaaaagggaatgcttatacactgctgattgaaatgtaaattagttcagtcactttggaaagcagtttaaggatttctcaaaaaactaaaacagaattaccatatgacccagcaatcccattatagagaaatataaattattctaccgtaaagtcacatatatgtgtacattcatcacagcactgttcacaataacaaaatcacggaattaacctaaatgcctatcaatagtacaatggacaaataaaataatgtggtacatatataccatggaatactatgcagccataaaaaatgagatcatgtcctttgtgggaacatggatgaagctggaggctgttattgtacaccaactaatacagggacagaaacacaaatactgtatgttcttacttgtaagtgggagctaaacaatgagtacatatgaacacaagggaacaacacacatcaaggcctacttgagggtgaagggtgggatgagggtgatgatcaaaaactatgtatcaggtactgattaccggggtgacaaatgatccctacacaaaactgctgcaacatgcaatttacctatataaggacatgcacatgtacccctgaacctaaaataatagtaaagaaaaagaaaatagttacaataagttccataatattaatgagttagttaagtggatgctttacctattggttccatcatgtgtgcttgtttaattatttttttgtatgacagtttattagaagcatgattaatttttgaataaaaaactccctgaagctttctagagaaaagaataatattttactgttttaagcagtatttaatctaaacaaactttttatttatttagacacagggtcttgctgtcatccaggctggaatgcagtggtgtgatcattgctcactgcagcctcaaattcctaggctcaagcaatcttcccacttcagcttcccaagtagctgggaccaaaggagtgcaccaccacatctggctaatttattattattattactattatttgtag

SEQ ID NO: 1590 - DNA, 11959 bp, Homo sapiens
gacagagccagactctgtctcaaaaaaaaaagatttaatagagattgaagaattatagtgttattactttatgaaagagctacctcttggtgccattgcctctgccattggtttgtttggaatacaatttcaaataacttttaggttttcgttttgaaatgaaacgattttcaaaacaggtacttacagaagttcctcattttatttaaaagccataaaaactataccttcaatacacagtgcttctagcctctgaaaataatattttatgtgacatgtgacttaaccttatttatctaacaaaactttattgaggaaacaccacaggaaaatactatgctaagaagtttttatataaatactaaatgggaagttttaggtaaatataagcccttttcctttagagcaaacaaaatttgttatgttctaatatcataacttttggcatatttaaatgagctgaaagtttaacagtaatgttgtgaaacatgtaaaaattaattgacatctttcaaaatattaacatgcataagaaatatgttaaataaattttaacaaagtaaacaaagcctcacgataataattctttatattttaagaaaagcgattattttcttctagtgtcaatgcagattattttacttgatttttggttacaggtcaatttttccttctaaaattcagcaaatagtgaatgagtagcatctacgcaaatattagaaaatgcttagtgacatctactgtagatgactggagacatctgtgaacttagacaaatttctgcttgccttctaacacttcaggtttaaaagggatagcgttgactgggaagcttctcactttcatttctgaaataaaacattaagacttctttgaaactaaaataatttctgctaaccagttgcaaagtacaactgtgttccaaaatattttggaactttatttattgtttgcatgttcagaaattaattatgtatgcatacatttatgtattcattacaggctttgttgctgcccagtcttttgaaagatatttgaaaattcaggatacatgtttacagaagagacaaacttgacttcattatctagagccagaacacatagtatctgtatatccacggtgattgggactaatgccaagatttgaaataatacctcagacagttcagcttcagagagagaatagcttttgaaaaatctaaaatctaccttaggaacgtacatttctctaagcaaagtgagtatgtaaacaaaatgttttattatcagggatttctccctttccccttcaatgttccctttctctttcaccaggctcccaggctcttgacactcctggttcctcccagtccccttgtgattcctttaatatctatgcctatttctgagatatcccttcctcactctgccccctgcatacccgtcagttgccttgtaatgtccctttccctgaaagcctcgttatttacctacatttaaaatatagattatattaggcttataccctaaccattccacatgagatctacactgtaattgaggcttctaaaaagtgatgtggtatggaggaccatgatcagatcagtggaggcctttgggagacgggggagctttggaaatcacatcagtgaaaggtgtggacaaaaacggccttttgttgttccacatcattttttaatcgtattttttaaagaaaaaaatgaaaagattccctcaagtaagtatattattctggtttcctcagaccatctcactaacatgtttcattcactattccagtatttcactcgcgttggtgagaagagaccaccaaacaggctttgtgtgagcaataaagctttttaatcacctgggtgcaggcgagctgagtctgaaaagtgagtcagcgaagggagataggggtggggccgatttataggatttgggtaggtaaaggaaaattacagtcaaagggggatgttctctggtggggaggggtggggtcacaaggttctcagtgggggagcttttgagccaggatgagccaggaaaaggaatttcacagtttgccagtcctgggcgggggcaaatcctcgagcttgatgtgtaggaaagggagggggcctgagcaatccttgaggggtagtagaatagcagatggaacattgagaagtgatttctttgaggatagatttccacgatggaaaggaaatgagaggttctaagaggcaggctagtggcttgtactatagcatagcctgcctttgctagtgtgtggtgattaggcctggtggaactgccatcagtaaaccaagtgtgatcagggtgaggaacaggaaagaaggaaatatggggaaatggggtgaatgtcaggtggatcagagagatacagtcatgaggttcaggtgtggtatcaggaataatgtgggaggccggattgaagtctgggccaggaacaatggtaattgtgggagactcaacaaagagtgagtacagctgaaggagccggggagcagaaagtatatgcgtcaggtgtgaggaagaaaatagattttggaagttaggagaactgtagagagtaagttgagcatagtttgtgatttttggggcttctaaaagtattaaagcagtggcagccgctgcatgcagacatgagggctaggctaaaatagtaaggtcaagttgtttggacagaaaggctacagggcgtggtcctggctcttgtgtaagaattctgactgcattaaccatgcctaggaaggaaaggagttgctgttttgtagaagggattgaggtttgggagattagcgggacacaatcagcagggagagcacgtgtgtttttatgagaattatgccgagataggtaacagatgaggatgaaatttgggcttgactgaagtaatgggagctgtctgtgaagccttgcggcagtacagcccaggtaatttgctgagcctgatgggtgtcagggtcagtccaagtgaaagtgaagagaggctgggatgaagggtgcaaaggaatagtaaagaaagcatgtttgagatctagagcagaataatgggttgtggagggaggtattgaggataggagagtacatgggtttggcaccaccatggggtggataggcaaaacaattcggttgataaggcgcagatcctgaactaacctgtaaggcttgtctggctttaggacaggtaaaaagggggaattgtaaggagagtttatatgctttaaaagaccatgctgtagcaggagagtgataacagtgtcaggcctctgagcccaagctaagccatcatatcccctgtgacctgcacgtacacatccagatggtcggttcctgccttaaatgatgacattccaccacaaaagaagtgaaaatggactgttcctgccttaagcgatgacattatcttgtgaaattccttctcctggctcatcgtggctcagaagctcccctactgagcaccttgtgacccccactcctgcctggcagagaacaaccctcctttcactataattttcctttacctacccaaatcttataaaaacggccccacccctatctcccttcactgactctctttttggactcatcctgcctgcacccaggtgaaattaacagccttgttgatcacagaaagcctgtttggtggtctcttcacatggccacgagtgaaatttggtgccgtgactcggatcggggaacctcccttaggagatcaatcccctgtcctcctgctctttgttccatgagaaagatccacgtacgacctctggtcctcagaccaaacagcccaaggaacatctcaccaattttaaatccggtaagcagcctctttttactctcttctccaacctctcttgctatccctcaacctctttctcctttcaatcttggcgccacacttcaatctctcctttctcttaatttcagttcctttccttttctggtagagatgaaggagatgcgtttcatccgtggacccaaaactctgatgccagtcacagactcaggaagacattcttcccttggtgtttaatcacgcggggacgcctgcctgattactcacccacgtttcagaggtgtctgaccacatggggatgcctgccttggtccttcaaccttagcagcaagtaccacttttctgggggtgtgtgggaccccatggaaaatcagactgttcaactcacctggcagccactgacagagcccctggaaatctggcccaagactctctaactgactccttcccagatcttctcagtttagagtctgaagactgacactgcccgatcaccttggaagccccctaaaccatcttggatgctgagcttcgggtaactctcacagtggtgggtaagtccatccccttcttaatctctatggaggctaaccactccacattacattcttttcaagggcctgtttcccttgccttcataactgttgtgggtattgatggccaggcttctaaacctcttaaaactccccaactctggtgccaacttagccaatactcttttaagcactcctttttagttatccccacctgcccagttcccttattaggccaagacactttaactaagttatctgcttccctgactattcctgagccacaaccacacctcgttgccaccttttcccccagttcaaagcctccttcacatcctcaccttgtatctccccaccttaacccacaagtataagacacctctactccctccttggtgaccgatcatgcaccccttaccatcccattaaaacctaatcactcttatcccgctcaatgccaatatcccatcccacagcatgccttaaaaggattaaagcctgttatcactcgcctgctacagcatggccttttaaagcctataaactccccttacaattcccccattttacctgtcctaaaaccagacaaggcttacaggttagttcaggatctgcgccttatcaaccaaattgttttgcctacccaccccatggtgccaaacccatatactctcctagcctcaatacctccctccacaacccattattctgttctggatctcaaacatgctttctttactattcctttgcacccttcatcccagcctctctttgctttcacttggactgtccctgacacccatcaggctcagcaaattagctgcaagtcttcacagacagctcctattacttcagtcaagcccaaatttcctcttcatctgttatctatcttggcataattctcataaaaacacgtgctctccctgctgatcatgtcggactaatctcccaaaatccaatcccttctacaaaacaactcctttccttcctaggcatggttagtgcggtcagaattgttacacaagagctgggaccgcaccctgtagcccttctgtccaaacaactggaccttactgttttagcctagccctcatgtctgcatagagtggctgccgctgctttaatacttttagaggcccaaaaaatcacgaactatgctcaactcactctctacagttctcctaacttccaaaatctattttcttcttcacacctgacacatatactttctgctccccggctccttcagctgtactcactctttgttgagtctcccacaattaccattgttcctggcccggacttcaatccagcctcccacaatattccgggtaccacacctgactcccatgacggtatctctctgatccacctgacattcaccccatttccccatatttccttctttcctgttcctcaccctgaacacgcttggtttattgatcgcagttccaccaggcctaatcgccacacaccagcaaaggcaggctatgctatagtacaagccaccagcccacctctcagaacctctcatttcctttccatcatggaaatctatcctcaaggaaataacttctcagtgttccatctgctattctactactcctcagggattattcggacctgctccctttcctacacattaagcttgaggatttgcccatgcccaggactggcaactcttaattccctcttagagtggatagatgatctttgctggcaggggaccctccaataatttcatcctgatgaagttctattctttacttttagagtcactcttattctcattcccattctttagccaccctctacttctccccagccatctccaccacactatcaaccttactcattctctcctagccatttctaatctctccttagcgaacaactgctggctttgcatttccctttcttccagtgcctacacagctgtctccaccttaaacacagactgggcaatatctcctgtctccttacacctctgaacttcctttaacagccctcacctttaccctcctgaagaacttatttactttctagacaggtccagcaagacctccccagacatttcacatcagcaagctgccaccctattccacacttacttcaaaaacctttctccttatatcaactctactccccccatatttggacctctcacaacacaaattactattcctgtggccgctcctttatgtatctctaggcaaagacccactgcaatccccctaggtaactttcacctgctcgacgttcctttactgttcatctccaaagccctcttcttgtttacttatacccagccctgaaaataacagtgaaaggttgctcgtaggtactcaacgttttttcacacaccatgaaaattgaatctccccctcttcgcagttacctcatcagtccccattacaacctctgacggctgccgccctagctggatccctaggagtctaggtacaggacactcctttgcagcactccttctcatctttttactttgcatctccagttttgcctcgcacaaggtctcttcttcctctgtggatcctctacatacttctgtatacctgctaattggacaggcacatgcacactagttttccttactcccaaaattcaatttgcaaataggactgaagagctccttcttcccctcatgacaccaacacgacaaaaaagttattccactaattcccttgcttgtcagtttaagactttctgcctccactattgctcttggtactggaatagcaggcatttcaacctctttcacgaccttccgtagcctctctaatgacttctctcctagcatcacagacatatcacaaactttttcagtcctccaggcccaagttgactctttagctgcagttgtcctccaaaaccgctgaggccttgacttactcactgctggaaatggaggactctgtgtattcttaaatgaagagtgttgtttttacctaaatcaatctggcctggtgtgtgacaacataaaaaactcaaggatagagtctaaaaacttgccagccaagcaagtaattacactgaagccccttggacactctctaattagatgtcctaggtcctcccaattcttagtcctttaatacctgtttttctccttctcttactccgtttagcttttcgattcatacaaaactgtatccaggccatcatcaataattctacacaacaaatgtttcttctaacaaccccacaatatccccccttaccacaaaatcttccttctgcttaatccctcccactctaggttcccgtgccacccctaatccctcttgaagcagccctgagaaacatcgcccattatttctccataccaccccaaaaaatttttgccatcccaacactttaccactatgtcattttatttttcttcttattataagaagacaaacaggctttaatctttttaaggcatgctgcgggatgggatattgacattgagtggggtatgagtgattaggttttaatgggatggtaaggggtacatgatcagtcgccaaggagggagtagaggtatcttatacttctgggttaaggtggggagatgcaagggcaggatgtgaaggcggctttgaactgggggaaaaggcggcaacgaggtgtggctgtagcctaggaatagtcagggaagcagataattagttaaaatgtcttgacctaataagggaactgggcaggtggggataactaaaaaggagtgcataaaagaatgctgtgcaagttggcaccacagttggggagttttaagaggtttagaagcctggccgtcaataccgacaacagttatggaggcaaaggaaacaagcccttgaaaagaaggtaatgtggagtgggtagcctcagtattgattaagaaggggacggacttaccttctactgtgagagttacttaaagcatctgtgatggtctaagaagattctgaggcgatcaggcagcgtcagtcttcagccactaagcgaagaagatctgggaaagagccagagagccttgggccagagttccaggggctctgggagtggctgccgggtgagtttgatagtccaatttccagtggggtcccgcacagatgggacacggcttaggaggaatcctgggctgccggcattccttggcccggtggtcagatttctggcacttgtagcaagctcttgggggaggcaggcctggaggaacgcctggccactgtggtttaggtgtttggaagaagtccttgtgtgctggagatgtggttgaggtttctctcacagtggagatttctgcatcctctcagtcatgatgataaaggatttactacctcagtcatgtcaccactcttgaatatcattcccatggcatggtgcagtaggaactggaacacatactttgagaaatgactgctgagaagaattggaaagggactggaagcaatgatggctaaagaatctcgagaaggaagacagactatacatattttttctaggaaattaaaagggaagataatttcataattattgccaatgttgtaaatagtaatctccatctctccatcagatagagaagaaaatgggattaaaatgtagtaagagaaatttagatggtttataacagtttgaaaggaatcatgagttaaatttcatagtgtagaggcaggaggctaagagaggataaagatataccgctaatgtttataaattctgtacattatccactccttacctctcaaaagcctctttgctaaaagtaggtgtcattatgtatgcaaataagggaagctatgccatgaaatgtaatccttaggctgctcatagtcttaagtacttttaataattgactcacttgaagtatttatgtagacctacttacaagaaaaaatatgaaaataatgtaaataaaaatgttacacactttataattaaattcttactttttatattgcccttgattgaaatcaaataattattcaagaataagaaagcattattatgagttaaatttttgagatgcaaaattatatgttctgcccattttctctacctgttttgtgtgaaagataatatgattgaatgtatgctttgtttgtgcccaagtacacgtctgaaccacagcctattctttatatcctattgagagaattgtggctccttttttcttttacgttacttaatatttggctgtagctgttctttggcagtaggtagggtatttgataattctgctgtgctgcataaacatttttacttcaaagtgattgcttgtccatgtctcactggaattatttcaagtcagacgtctaattctgtccaacatctttaatgttttcaaaatcatcttgggtgttgttaatggagtatcattaggtacaatttgaaacatttcagtgggcagtacatggattcagaatatttgtgcaatatgtgctcttgcttctgaagtctttgggggatttttcttttatatacccttctcctaacactttattttctttactagttgacttagttgtatagttatagtaaacataatttttccatttggccaatatttatgaaaactatagtaggatccaaacattccaaaagagcactgggataagaaagaggtggtgcctgtactatacctacagctaggagaaaacaggacacatagaaataaactcaagtacaagtgtgggcagtcataatagccaagaaagcccagatctaggagttcttaatatcattgggtgaagaaaggaacattttgatgttcctcagaagcacaaagaaaataaccccaagaaagaggattggcttaagaaaaagtatataaggatatgatctgctccaaaagcagaaagcactacatcaactgaaagaagttttggagagagaaatgtgaattatgctgagatagctggctttattcttcagatcaagggaagtattaaaaatttaaaacagggtatagcatggtcagatttgtatttaataaaaatatatctgaaggtcacatatttgacacactgtatggaagatacatttaagtagtcctattggtgaagaactgcttgagtcgctacacatgtggcatcgaactaaattagaaatgaagagaaattattcaaggctagaatattcagaaactatcagtgcatctaacacatacaataaaggctcaataaatgcctaatgatgaaaaacaaaaattaatgcacaaattgggtttcaaatgttacattgctagaatgtttaaaattatggagtcattttatgtttgtgtgtgtgtgtgtgtgtatatatatatatatatatatatctttttatccttattgaaggcagagatttcaaactacgtatgaagtattcatatctgtagatttatagcagattggtgtgttttctgttttagattgcctgttttgtagtagagagatgcttctcaggacgtcgtgggatcacactgttcagactgatttccaacaggcacagcgtgaattgtacagtaacttgttaagaggtcacctagacgttctcttaggttcctttctcctacagaagctaaggggaccgtctgttaaaaactccatggagccataaaatggcagaacattttgtccaggattcctctgcagtgagatgattccctccacctgatctgtatgccacctgaccctcaccttgtatcattctgtgagaaaaaaggaacaccaaagatgatttgttggttttccagtgcaagagtgatccctccttcgtttttaccaaaaagaggtgggagccctggcggtagctatgggtccagttcaaaggattatgaaatgcactgctttcacatcaaaaaggaagaagaaaggcaatacttgcaaccaatgataaagaggtattctgactttcatctgcctttgtgttaagcgtgagagagccagacagaattgcagcaggaaccagaaggagcaaagaaaaagattactgtttcttttataaaatggtttttatcctactggtgtctctttaaaaataaaaatcaacaaataaatgtccatttaaattgatcttctgttggactatgttattagtctgacatacaaattagtgcttctaagatttaactatgcgactgagaaccaatattttatggagagtgtcaaatggcttgcctttacagcaattcttttcactgtatctattttttttaatgtggatgatggaaactactttaatcaaaaagttaataatacttatttggaggtatgataaagcaaatgtctttggccacattgctgttattggaatttaagggctattatcttttgtaggacaatttttaaaatacagtttattctactcagtgccctaagtctgtttcttactagccatgaccttcagaagctgactttacctctctaagccattctcctcctctgtgaaatgggaatgttaatacccactcttgttactctcagagtgcaatgaggatcaatgagaagataaaaataaatgtgtttggttaactatgaaataccacgtaaatgttattagtatgaattatttatagaccatacacttgatggaggcaaaaagtagacctttgttgttcccatgaaaccacagtaccttccacagtgcctgacaagaagtaagaaagcaataa

SEQ ID NO: 1591 - DNA, 11959 bp, Homo sapiens; identical to SEQ ID NO: 1590

SEQ ID NO: 1592 - DNA, 2100 bp, Homo sapiens
gttttatagggtttgggtaagtaaaggaaaattacagttaaagggggatgttctcaggcgggcagggttgggggtcacaaggtactcagtcggggaggttttgagccaggatgagtcaggaaaaggaatttcacaaggtaatgtcatcagttaaggcaggaactggccatctggatgtgtacatgcagttcacaggggatatgatggctccacacagggatgagagttgctgctgcccagtccagagccacagagccaaggagggcctggcctgccccatggcccattacagaagagttcttcttgttggcagagactgggatgaaattccttaccatgaaggactgtattttttttttaacttaaatattcattgagcagcttctatatgcaaattatgaatatggagattcatatcatatattgtcactgcttcaaaaagctcacaatctcttttcttccgcacagatttctgcatcctctcagtcatgatgataaaggatttactacctcagtcatgtcaccactcttgaatatcattcccatggcatggtgcagtaggaactgaattgtacagtaacttgttaagaggtcacctagacgttctcttaggttcctttctcctacagaagctaaggggaccgtctgttaaaaactccatggagccataaaatggcagaacattttgtccaggattcctctgcagtgagatgattccctccacctgatctgtatgccacctgaccctcaccttgtatcattctgtgagaaaaaaggaacaccaaagatgatttgttggttttccagtgcaagagtgatccctccttcgtttttaccaaaaagagggctatttaactggataccaggagaagcaaattgctgatccagtcatggatgttttaccccattatttagttccactctacatggaatttatttggaagattctcaatgcacttgcattcaaacataaagacctaatgactctcattgcagcagtattcctcttgtattgttattttcttaacttcggatttcctccatttctgcactttttgccatctggaatttcatttgcaagggcagataaggggaaaagaatgtaataagagacgaggaaaaatataagcccttgctgaatgattgatatgaatgaaggaactgatggaataaataacaaaaataaaaagatccaggactactctcagtctctgaagcaggtgggagccctggcggtagctatgggtccagttcaaaggattatgaaatgcactgctttcacatcaaaaaggaagaagaaaggcaatacttgcaaccaatgataaagaggtattctgactttcatctgcctttgtgttaagcgtgagagagccagacagaattgcagcaggaaccagaaggagcaaagaaaaagattactgtttcttttataaaatggtttttatcctactggtgtctctttaaaaataaaaatcaacaaataaatgtccatttaaattgatcttctgttggactatgttattagtctgacatacaaattagtgcttctaagatttaactatgcgactgagaaccaatattttatggagagtgtcaaatggcttgcctttacagcaattcttttcactgtatctattttttttaatgtggatgatggaaactactttaatcaaaaagttaataatacttatttggaggtatgataaagcaaatgtctttggccacattgctgttattggaatttaagggctattatcttttgtaggacaatttttaaaatacagtttattctactcagtgccctaagtctgtttcttactagccatgaccttcagaagctgactttacctctctaagccattctcctcctctgtgaaatgggaatgttaatacccactcttgttactctcagagtgcaatgaggatcaatgagaagataaaaataaatgtgtttggttaactatgaaataccacgtaaatgttattagtatgaattatttatagaccatacacttgatggaggcaaaaagtagacctttgttgttcccatgaaaccacagtaccttccacagtgcctgacaagaagtaagaaagcaataa

SEQ ID NO: 1593 - DNA, 2100 bp, Homo sapiens; identical to SEQ ID NO: 1592

SEQ ID NO: 1594 - DNA, 28708 bp, Homo sapiens
ccccgtgtattttggactaccctcccatcttatgatgatactacctggaacacacagcctccaaggacacattggcagaggaagaggaagatggcagagacacaaacagacctatgtttatgagaacaaaacaatggtgtgcacgcaagcagttagtattgtgcctggaatacggaaaccttcacgggaaggatgggtacaaataagctcagactgagaagaatgcaataaatacccaaactttcaatgcccacacatcaacgaacatccgtaagatcatccaggaaaacatgacctcatcaaatgaactaaattaggcacaagagaacaatcccagggtgacagagacatgtaacctttcagatagagagttcaaaatagcagttttgagggaactcaatgaaattcaagataacagcgagaaataatgccgaaacttattagataaatttaatggagtttttaatagtttaacaaaaccaagaagaaattctagagctggagaatgcatcagagcctctcaacagcagaactgaccaaacagaagaattaatgagcttgaagacaggctatttgaaaatatatagttagagaggagaaaatttaagaaacagtttaaaaaaataaaacatgcctacaagacctagaaaattgcctcagcaagtcaaatctaagagttattggctgtaaagaagtcatacagaatgagactagggtagaaatttaattcaataagatagtaagagagaacttttgaaacctagaggaaaataccaatactcaagtacaagaaggtcatagaaaaccaaccagatttaaccccagtaagactacctcaagacatttaataatcaaactcccaaagggcaagaataaagaaaggaccctaaaagcagcaagagaaaagaaacaaaggagcaagtgagcttccatacatgcaaaagagctccaatacacctggcagcagactttttagtggaaattttacctgccaggagagagtggcatgtcatatttaagacactggacttaatctgcagcacagaccaaatggacttcatagatatttacagaagatttcatccaatggctgcaaaatacacattcctttcctcagtgcatggaacattctcaaggacagacagtatgttaggccacaaaacaagtcttaaaaattcaaaaaaatagaaattgtatcaagtatattatctgaccacaatgaaatagaactaggaatcaatatcaagaggaactttggaaactacacaaacatatggaaattaaacaacattctcctgaatgaccagtgggtcaatgaagaaattaagaaggaaatttaaaaataatattgaaacaaatgaaaatggaaacccaacataccaaaaattatgaaatactgcaaaggcagtactaagaggaaagtttatagcaataatcacctatatcaaacaagtagaaaaatttcaaataaataacctaaagtttaatcttaaaaaactagaaaagcaagagcgaaacaaacccaaaattagtagaagaaaagaaataataaagatcgagcagaaataaataaaattgaatgaagaaaacaattcaaaataaaaaagatctttaacttgactaagagaaaaagaaaaacccacgtaagatcagagatgaaaaaagaagacattgcaactgatactggaaaacctataagaaatggataaattcctagatacataaaactcaacaagattgaatcatgaagaatcaaagaacctgaattgactaataaaaggtaataaggtcaaagacaataaaaagtatgccagcagcaggactcagtggctcatggctgtaatcccagaactttcggaggtcgaggtaggtggatcatttgaggccaggagtttaagaccagcctggcccaaatggcgaaaccctgtctctactaaaaataaaaaaatttgggaggctgaggcaggagaatcgcttaaaacccagggggcggaagttacagtgagctgaggttgtaccactgccctccagcctaggccacagagtgagacttggtctcaaaaaaattaaaaacagaaataaaaaattaaaaaattaacaagtcctggtggctcacacctgtaatcccagctactcaggaggctgaggcaggagaatcacttgaacccaggaggtggaggcagaggctgcagtgagccaagatcatgccactgcactctagcctaggcaacagggtgagactctgtctcaaaaaaagaaaaatgtctcccagcaaagaaaagcctgggaccctatggcttccctgctgaattttaccaaatatttaaagaaccaatatcaatcctacccaaacttttccaaaagatagaggagggaatccttctaaactcattctatgaggctagtattactctgatacaaaagtgagataatgacacactgaaacaagaaaactaaaaaccagtatctctgatgaatactaatgcaaaaattgccaagaaaatactaggaaactgaattcaacaacacctttaaaagatcatccatcatgacaaagtgggatttatcccagggatataaggatggttcaatgcatgcaaatctctcaatatgatacatcacatcaacagaatgaaggacaaaaaccatgtgatcattacagttgatgctgaaaaaacatttggtaaaattcaataacacttcatgatgataaccttcaaaaatggatttagaaggagcatatctcaacacagtaaaagctgtatacatcagactcacagatagtatcattctaaatggcaaaaaactgaaagcctttcttttaagatctggaaaaagacatagatgcctactttcttcactgttactcaacatagtactgtaagtcctatctagacaagagaaagaaaaaaaagggatccaaattggaaaggaagaagtgaaattatccttttttttgcagatgatatgatcatatatttggaaaaacctaaagactccaccagaaaactatcagaacaaataaatttagtaaagttgcacgatacaatatcaatataaaaattcagtaacatatctgtatgacaacagtgaacaatctggaaaagaaatcaagtaagcctatttacagtagttgtgaatacaataaatatgtaaaaataaacttcaaccaaaaaagttataaacctctacgatgaaaactatgaaacattgatgcaaggaattgaagagaacaccacaaactgaaaggatattccacgtttgtggattggaagaatcaatattgttaaaattcccatactacccaaatcaatctacagattcaatgcaggatatgaaatcaaatccctatcacaatatcaatggcattcttcacagaaacagaaaaaataatcttaaaatttatatggaaccacaaaagacccagaataggcaaagcaatcctgagcaaaaagaacaaaactggagaaatcatattatctcacttcaaattatactacagagctaaaccaaacagcatggtactggcataaacagacacacagaccaatggaactgaatagacaatacagaaataaatctacccatctacagtgaacttattttcgacaatggtgccaagaacatacattggagaaaacacagtcctcaatagttggtgctggggaaactgggtatccatatgcagaagaatgacactgcacttctgttgcttgccatagacaaaaatcacaacaaaatggattaaagacttaaatctaataattcagcctatgaaacttctaaaagaagtaattgaagaaactcatcaaaacactgcagttggcaaaggtttcttgaatattacaccacaagcacaggcaaccaaagcaaaaattaactaatgcttttttttttttttttttttttttttttggtagggcatgaagtttcgctcttgtcacccaggctggagtacaatgacacgatctcggctcactgcaacctctgcctcttgggttcaagcgattctctcagcctcctgagtagctaggattacaggcacccaccatcacgcccagctaatttttgtatttttagtagagatggggtctcaccatgttggccaggctggtctcaagctcctgacctcaggtgatccacccgccttggcctcccaaagtgctgggattacaggagtgagtcacagtgcccagccaacaaatgctattacatgaagttaaaacctttctgcacaacaaaggaaacaatcaacaaagtgaagagacaacccacggaataggggaacatatttgcaaactattcctctgacaagagattaatagccagaatatataaggaactcaaataattcaataggaaaaaaatctaataatctgatttttaagtgggtaaaaattgaaatagacatttctcaaaataagatatacaaatagcaaacaggtatctgaaaaagtgctcaacattactggtcatcatacaaatgtaactcaaaattacgagagatattatcttaccccaattaaaatggctcttattgaaaagacaggcaataaaaaatactggtgaggatgtggataaaagggtacatttctccagtgttggtgggaatgcaaattagtactaccactattgagaacacttttgaggttcctccaaaactaaaactagagctaccatatggttcaacaatcccactgctagttatataaccaaaagaaaggaaatcagttgatcaaagagatatctgcactcctgtgtttattgcagcactattcagaatagccaaaattggctattctagacattttaagtaacctaagtgtctgttaacagaagaatggataaagaaaatgtggtacatatacacaatggagtaaaactcagccataaaaaagaatgagatcctgtcatttgcagcaacatggatggtacctgaggtcattatgttaagtgagataagccgggcacagaaagacaaacattgcatattctcaatcatttgggggagttacagatgaaaaattgaactcatggagacagtagaatgatgtttctcagaggctaggaagggtagtagggattgaggtgggtgggcaagtggggatagttaatgggtacaaaaacatagaatgaacatgatctagtatttgatagcactacagggtgactacaggaaaaattaatcttttgcacatttttacataattgagggtataattagaaagtttgtaacacagataaatgataaatgtttgaagtgatgtatactccactttccctgatgtgattattactcgctgtatgcttgtatccttaatataactcatgtaccccataaatatatgcacccactatgtacccataaaaattagaaataattttttaaaaaagaaaaaatatataaagcaaattggataaaaatcataggataaaactcacaaatcccctgtcagactggaagtttttagcatgcgtgtttttgtaagtgataaatcaaatagacaaaaatgaaaaaaaaagagaacattagaacaacataacaaaagtctgctttaatgcacatatatgaaacctgtaccctgcaagtaaagagtacacattttaaaaaaaataccatagtgagagaagagagagatcctctcatattgtattatactcagtacctgttttaagaaaaaaacaaggaagtgaaatcaaagacaggcagcccagtgccaggcccaaaaccaggcctgggcctgcctggcctaaacccagtagttaaaaatcaactcataacctagaaaccaatgttattcgtagattccggacattgtatagaagaacactgtgaaactccctgccctgttctgtttctctctgaccactggtgcatgcagcccctgtcacgtattccttgcttgctgaaatcaatcacaaccctttcatgtgaaatccttagtgttgtgagctcttaaaagggacagaaattgtgcacttggggtgctcggattttaaggcagcagcttgccgatcctcccagctgaataaagcccttccttctacaacttggtgtctgagaggttttgtctgcggctcgtccttctacatttcttggtcccctgaccgggaatcgaggtaactgagggatggccgaggtagccccttaggcagcttaggcctgccctgtggagcatccctgcaggggactctggccagcctgagtgacgtgatccaaagagcactcctgggtagaaaattgcctgggtggaacgcctcaccagaacagcacgtagcaggcccctgtggaggattaacacagtggctgaacaccgggaaggaactggcacttggagtccggacatctgaaacttgaattgacaagccgacatcagtctccagagtgaatccaaggagtggacccaagacatttgtgttctgtgatgtggtggcatgttacctgtcatctccgatgcataactcctaaagtgcgtctggggcagttgtacagattgcagaggataatactcaagatgttctccaaggccaactagtcatcagtttattcatgtttctgggattggattcatgaactcatcctttgaactatttcaacaagctttttcatgtaactaatctgcggaaggtagaaaggggaaaactgttgggtgctaaaatgacaactggttcaaggtacaatggcgaatatttttatttctgcaacttttcttagaggttggaaactggactgggcaggaagattcctttttgtaagattagtctccagttttcatcaagcagtttagtggggtattttaggcccagttccctctccacagtccccaaaggtcttctgttaactttaaatccgcaaagagagagatctctgccaagcagcaactgcaagagcatgtgggtcaatgttaccagcagacactcaaagcccattccctttacttcaacaccgctttataaattatcttagagacgttgtcaggttggtattagaggtgagtggtcatgacttcacgatttctcatctttctgaatgcatagtggctgggagtggtggctcatgcctgtaatcccagcagtttgggaggccgaggtgggcagattgtttgaccacaggagttcgagaccagccggggtaacatggcaagaccccaatctctaccaaaaaaaaaaaaaaaaaatacaaaaattgtctgggtgtggtgtgcatgcctgtagtcccaagtcccagctactctacttgggaggctgaggcagaaggatcacctgagcccaggaaggccaaggctgcagtgagccctgatggtgccactgcacttgaccttgggcaacagaatgagaatgagaccctgtcaaaaaaaaaaaaaaaaaaaaaaagaaaaaaaaaaagaaagaaaaagagagaaagagagagaaagaaagaaagaaaagaatgcatagtgagattttacagtaaaactctttcttagaggctaaaaactctggggatctcacgatgtgggtacatttctagagataatattttagatctctatagatattattttaatacatctttttctttttggtttgactgtgtatcatatggcttttcttcttggaagttatcaaacttctccctaactaaggtccttgcatatgctgacctgtttgacatactcccactctggtctactcattcttcaggtatcattttcattcctgtcactaccccttaacccaacccagacaaggttattgtgcactgaatcatttcaaaatgccactttaaaaatgagtaaatatttatgtaattatgtgttgaatatacctcctctttacaagcatataagtctatgatacaagtctatgcttgtctcttctaattctggtacatcatgtgatatgagaaccatggtaggcaatcaataatgcagagacgaaatgtttttatcttagagagactctcacagaagtttctagtttagagatgcttcactgaagtttatggcctcaacttccttgggtcttgattactatcagtggatgcagtgatggagggtaggtaaaatccaatgttatctacaagttctagactacagccaacaaactttttccaaaataggccagataataaatatattaggttttttgggccatgaagtctctgctgcaactactcagctccacatttgtagtggaaaagcagttatagatgaaacataaaatgaattagtgtggctgtgttcaaaaaaagctattttcaaaaacagccagtgggaaagctttggtccttgagccatagtttgcaaaattttgttctaaacagtaattccttcactggagattttaaaaacagaaagagaatacagacagctatacatgttctggtctattcctgttctctagtatagcagcaccttaaaattgtattactaacagagtacaggagattgtatggaaggcctatagtgatgactctttcatcagctttgttcgtaataaattaactgtatgtgtttcagagagtcatatgactccaaaatgatttaacacatgctgctacaagccagccttcttaagtttttattaaatcttgattgttttggtcacataatttttatattaaatcctgtgatactcattgtttttctataaaaatcatcacatttcaagtgttaggtagtgtgtatagaactgacaggtaataattttgacaggtatgggattaaatagaatccatccaaaaccatttactttccttatacattatagcagaagtggctaaattagagggttgttcctgtctccatcatgcacttctgtcttctactccatcccttgtatatattggggatattttgagccaagtgctaacgttacttacacagctgatatttcagattaatatgaatgctgaccgtttgccctcacaacatgcccacaacacatggattatacaggggaattaatcgttagcaatgaattcaacatttagcttttaacatttttattctgccagtaaggccagagaataaatctattctttctagcaggcaattattaatctctggctttcacaaacagcaaacggccactgaatccagctgacagcatatatttatttaaagattaataaggagaattatttatattagttaaaacgtattcttcattatgtttaaatctttccagagctatggcaggagttggattggagtatacagaatggattaacttattctaattgttatctaaagtagaggcattgagcactgatatggtttggctgtgtcctcaaccaaatctcatcttgaatcagttcccataatccccacgtgtcaagggcgggaccaggtggaggtaactgaatcatgggaacggtttccctcatgctgttctcatgatagtgagtgagttctcacaacatatgatggttttataagcgtctgtcatttccgctgctgttactcattgtctctcctgatggcctctggagagatgcctttgccatgattgtgagtttcctgaggcttcctagccatgtggaactgtgagtcaattaaacgtcttttctgtataaattacccagtcttggatatttcttcatagcagtgtgagaacggactagcacaagcatatttccaaaatacattctgacagtcatttaagattcatttcagaaagactataatcttgcaatagacattacctaactttttgctaagaaaatacattttcaaactcttcatcctttggtgtgaccaggttcagagatgtcccttcatgtatcttgtgtttatattgcaattttgagtataatgggatcaactacatgaattaaagacagaaataggaagcaggtttcaaaaaacataatttaagaacatataatggaggaataattgtaggagcttattctttatattccagttttattagccaagtaaaacgatttccttactctgtcactttttagtcataccaagaatgttgtcagtatttctcaaattattgtgcagatttagaagaatccacgttatagtgcaattttgagtctcttaaaagaaaaacaaggatcttaaaccaaaggcactctatcccaaattttgtaagtaactactgaatatctccaaagtcttcttaggaatcctaacaattttcatgctttttttttgagatggagtcttgctctgtcgcccaggctggagtgcagtggcacgatctcggctcactacaagctccacctcccaggttcacgccattctcctgcctcagcctcccaagtaactgggactacaggtgcataccatgcccggcatatttttttttttttttttttttagtagagacggggtttcaccgtgttagccaggatggtctcgatctcctgacctcgtaatctgcccgcctcagcctcccaaagtgctgggattacaggcgtgagccactgcgcctggccaattttcaggctttttattggtagatactttataatgtttctttagttggtttgcaaaaatggtcatagcttcatggttgtggcgtctgattttcctcatgtcaagtgtagcatcttccttgagttctaaccttctgttcacattattatgggaaagttattgaagagttgatgcttcagggacaattttgacattggctttacccttgtcatgtctgtaaagtgcaagctacaattgaaatgcacctgcagtttgccaccaggaggcatatttgtccatttctaaaatggaaatagttaaaaatgcattcacaagtagtaatatttgagtggacttcaattatttatgaaattctgtacctatcagatacagaaactgcaaaatgctacaaaaaattcatctaatgtataatatggagtgtaacattggaagagcagaggggctgtgaagtgagagtctctgttgactttgtctttcacagactcaaacaaaataccttcgatgtgactttactggcccctattttagtcccctgagcctcaactttctgtatttcattgggctttgatcactaatttacgtaaatttcactaatacttactggagttttcttacatttgtttgcttaaatgtcagcaaaaggaaaatgcaatactccagaataaaatcatgaactaaattaagaaacaaagtaaaaagactgtgctttaaaatattctattattattcagtttcaaccttgtttttattgtttgtatttccacttgtggattgtgagagaaaaacacagttaaaaagttgagtatgtcagacagtggattgtccttggatagtgtgtggtttggactcttccacacatttccagtgttatcgctctttaagaagtcccaattctcctctgttcattcaaactaagcttctcaaagtttcccccaggcacttcattttatctcatgactccttgaatgtaggactgctttttgacaataatgcatttttctgcttttttccttttcttgtttatccttaaagatttggcttctgtgttacttcttattagcagtgatccctgcctgccctcaccgagctcagggagttaggggactattctttgtacacattgtgtcctgtgctatccttttcacatcacctacatttgttatacttaagaacttgatttttttttttctcaacattttctacacttgcttgcgacttctttgagaagagaaactgcattcttacttcccagtagccaataagtagacacatagtaaacatttattgtatggatggcttatggggtttactacaagtctgttttgtttcagagaaagaattgcccacttgtgagtgggtcaaacggtggaaattttcttgcatggtttcaatttaacattcccttttcctaacgtccagtggaattttctggaccttgatgataacttttaggttatgtggtgatttttaatgtactttgagtcaaactaaaaatccgttgtcgtctttgggacatactagaccaaattagtttcggagagttcattacattccccatggcttcggaggtcaaaacctctcctgaagttcactttactataaataagtacttatttagattttatttagggatgggtttataatgtatacagatataatttgtattgtaataataacacatggaaggaagaaagttatagagttaatgaggaaaaaattgtatactgttgaaactaagttgatgttatatgaagtagattgttttaagttaagttgcaaatgtaattcccagggcaatcactatgaaataatccaaaaataggaagtaaagaaaacaacatggaaataaaaatgatatactagaatatgtctatttaaaacaaaagaaagaagtaatggaagaaaacagaaaaaaagaaataaaatatacacgtaccaatttggcataaataaatcctacctaaccagtaatgagacttaaaatgaatgaactaaacatttcaatcaaaaggcagagattggaagattagtttaaaaaacatatgatccaactagatgttggataaatgaaacaaaatttactttcaaagacacaaataagtaaggattaaaaaagatgtaccattcataaaatgcccaaaagagagttggaatggttatactatatgatgtgttttgtttttgttttcaatgaaattataaatgaaaatgaaaacaaattatacaaaaatttatagaatgcagctgaagcagtgctcagaaggagattttacaggcctatttttaaaaagaagaaagatggcaaatcaataatgcagccttcaatcttatgaatttttttaaataaaaaaacatactaaacctggagcatgtatgagtaataatacatactaatacatattaatacacaaggaacaagcattagggttcttcagaaagatagaaacagtaggatatatacagagagatggatagatatttgagagaagatgaattagggaaactggcttataccagttctggaggctaagaagtcccacagtggtctgcctgcaagctggagaccctgggcgatctactacacccaatagagtactaagaatggtgtttggagaatgagtatgccaacaaatgttgttacaatttaacctacaaaaactggagcctgaatatagacagaagtattgtcaaatggatttttgagcagacaaagaatgaattccttccattaacattgtatcatttgactcctggaaaattttttaaaacatatttatgaatatttcttaaatactggccttagaacatgattgagggtctttcttccctccagttcccacacagagtcctttgcttatcactgactagcagactcttcatttataaattgttgacaatctactttctagaagataaactgatcatttgttgttgtcaaacgataagcctcaaactataagaaagaaaaaggaaaaggagaaaaagacaaaaagaacgtaatatttttccaattgttcatataaaaccttggagtcatcattgacccctttctgcctctcacactcccagtccaatcactcagatcatcttgcccactttgtcttcaagttatatacaaaatttaaccacttcttctcatctgtactgccaccactgcagatcaagctaccttcatctcttacctggattagtaaaaagcttataagttgatatatcagcttcactacttatctccgctccaagtattctcaaaacaacagccagagtaatcttaccaggttagtcagatcttgtcactcttctgctcaatacacttcaggcatgtcttctccatcagaataaaaatcaccattgaggaagacctacagggtcatatatgatatttctgacattcattttacactaattttaccttccctcactgtgcatgagctagtgcttcctcattgttccagggatgagccatttgcgtctgccttagtttttatgcatttgctttttcttatctttagaatgcttgtcctcaagagtctacctggctcactcattcactttactggaatgtcaccttttcatgaaattgtgctgattcttcgagccatcctatctattattctacatatgatccttcctgtccctcttccttgcattttttatccccttcccactctcatcatctaatatactatacattttaattgtcttttgaattgatctcaatttctcccactagaatgaatgtcctatagggcagggatttttgcctgtgtctagagcagtgcttggcacataagaagtttctataaatgttagtccttctgggagacagatgcagaattgaactgtttacacatattttttcactttatcttcctaatagctctattatgctgatatttgtatcccccccctttttaaggtgaagatactgaaactgacagagggtaaaatatgtgaatctaggtctttctgacttcaaagctattattctttattatatcttagttacttttactcagaaaataagtgttatgtgacaggtccttaggtctttattttccttttatctgggactctattcaatcttcctttcactctctgacttttcatgttaacactgcaaagacgacccattgtgaagcctggcttagccacgctgtcacaagctcctttaaaatctcactagttggagtggagctgtcagccttttgtgaacaaggcaagcttctcactgaaagaaaaggccaatgacatggtgtaccttgtaaaagctatcatagtggaaaagaacatgcagcaatgttcacatcatgaagagaaatgtcaccagatgcatataatttttaaattcttacctatatttttatacacactacttgggttaacagttctgagacaataaaagaaagacacaatcactgtgttcagttcagttgcttcaaatgtaaaaaaaaaaaggctgtataaaagtgaatatcaggttagtagtctgaaatattgcctattgatctaatcaaaagagaacattcaaaatgaatgtagtccaggtttatgtaatatttagaacaagtcaaatgcttagtacttttgtggtaaaagttttatgattcttgaatactaatggcagaaaagtcaaggactgcaatgataaagtcgaaataaaacgtgaaaccaagtggaattgctagaatttgagtcattaggaatgaaggaaaatcagagcagaaagaacagtgtaatgatttaataggaatctttgcttcctatgtcagtccaagatttatgtgaacaagagtttttgagaactcatgatggaaaggagaaaaaggtgaaaaaggattttaagccttagctcgttgattttagatttgagatttgttaaacttctcacagtgagtaataaaaaattccataaaaagaatatctgttggccaggcgcggtggctcacgcctataatcccagcactttgggaggccgaggcaggcggatcacaagatcaggagatcgagaccatcctggctaacagggtgaaacccgcctctactaaaaatacaaaaaaaattagccgggcgtggtggcaggcgcctgtagtcccagctactgggaggctgaggcaggagaatggcgtgaacgtgggaggcagagcttgcagtgagccgagattgtgccactgcaatccagcctgggcgacggagtgagagtctgtctcaaacaaaaaaaaaaaagggagaatatctgttgaagaaagttatcaaaacatatgtgtatgcttatgagtgtgtttcattatatgtgcatgtatatatatgtatgtgtgagcatacacacatatatttcccaaaaagcttattttcatgatttctctgtattgtcagaatgtgctaggataatactggctgcttttacagataaaagcagaaaagctctcactcttcatgacttgcactctaacaagttcattcctcactcaatgtattagacccaagtaggtgttcacagtcagtcctgcaggaagagattagaggatctagttacccagggatcatctccattccttccaactgaaagggaaacaaacaaggaggagcacgcctggggaggttttcacaggccaggactggaaatgcacatttctcttttcctcacattccagtaagtagatctccattatatggctacgtgtaatacagccatgtgcccaggaagaagacaagtctgattttgagaacagatagcaatttgcctcattagaatagaacatgctcattgaacttttactatgggcaaggcagtgatccagaaagtagaacatacacatttgagtatcatttttttttttttgagaaaccaaatatagaatactaattgtatagttttttgataacaattaagttgttccatttggattataaaaatatataatagtacctatttgggctcatgtcatatgttttattaacatgtacttcctggtttatatcaaattacagaattttagagtttcagaataatttgaatttagaaagctattactgtaattatgtgggggcattaatggaggcttgtaattgtaatgctgaaaatataaattaattggcttgtaaatgagacaggtatagcaagtaaatgaggtcctgagggtatatttttattcagctactgagttgcaggataaagtcaaaatatttaccgaggttaatggaataattatataggatttatctatactattaaaattacatttaaaatatagagctatattgcttaccttaaattataaaatgagctttctccaaattcaaaatgcttgtaattcacagtcatttttggattactgtaaaaaggtaactaactgcctttttacaattaggaatttatttacaactttctcttccaatccattttctagtcttttatacaaaagactcatctgctttcaaggttagttcatttaagtcataaggtagagagaagcaagtacagaatacaacacagaaccacagccataaggtagatttctcaagtactgtccctaatgttaccgggggtccttgcttccagagctcccaagatggtggtgggccacttccaagatggtggcaagagtcgtattctctgacctggggttcttggtctcatggattccaaggaatggaatcttgcgccatgtggagaagcgtcagataattaggcagcagtccaacaattaggttttgtggaacttttactatgtcatctatttattggaattccccctggataccaggaccccctccagcagagcttaaagttatagttacaggaagtacaaattccttatgtggatccctggaagtgtgatgagaagaaccactgtttccaagatctatttattctatttatcaggcctataaaatcatgtaatggccatggcttcaactagactccacatcttgaatcacagaactcaacgaatggcatcaactacaagctggtattctgctatacatttaagaggccattttaatattctattagtctagcagcttctaagtgatgagggatatggggggactggaggatcccgtgctcacttccttttctgtaaaaggagctctttgatccaaggtgacatggtatgggatccaatgacaataaatcagttattctgtgaaccctgatcaaaacttgactaaacttttgacagttaggttttttcctgaccacagactcctcacctttcttttcttagaaaatttacattggaaaacagatgtaaattttctccagcctcttgcaaggtttacagtccaggactttgaggtcctgggagtcatccttttgaaatacaatcatcaaagaagatagtgctccaatctcctagtctctgtgggagggttggaacctaacttcagtaaactaatcaccaattagcaaacacagaggggctgatcatactgacccactttcccactaaaatgtctagtactttccaccagctcaccacagtgcttaaaaactctcctgtcttttgttttactagagttgagtccaatctctttcatctattgcaatagtgttgaataaagtcttccttgcctaacttgtcatgtgtattttttctctgactgccttcagagagtgttattgtccaagacactgaaaaatagaaacacaaccttcatctagaaaatgcaagaatctcagtaaagatgaatcattgttctgccaccatggaaggcagctagttgtagtcaattagccaaaaagtacctggttggtttccttgaggggatggcatgcgtattaatctggatccagtcaggacatagaaatcatagcaacaatttaaacaagaaaaattaatgtaaggtattattaactactaacaggagtgaaagagtgttgtacatgtaagactgagagagcaagaacaaggaaggaataagaacttagaagagacaccatcccccagcctgagaatcagatcttattagaaagagtgttgctaccccaaaaatatgcaaaagatcagtggggaagaagtttgctggaacatgtgggcttggattgttgggtagaaaagtcgtgtggggtggtcaaaaaattactacagagtgtttgccactaggtctctggcacactaatttcctagtagctacatcacaggaaaacaaaagtacaccagtaccaaggagagaagccccttcctcttactataacctttcaatgtccttccattgccccctgttgacaaagcttaacattgcaccagctggcaaaggagaaatgttcacgggattaagggccagtatcacagatcaggtcaaagaaaggtgaactaggagtttacagacaataaattaataaccagtgtcatatcaaggggtcagtgttggtctaaatttctgactggtcacacattcagtagcagcactggccgcttagtgagaaggagcccatagtgaaggtcccacttgtggcctgactttctccaatgctggcaactacaattgtgggattatatgcaagcactggagtggctgaagtcaaagggtggctagccactgttagatgagtctttctaacctagttgtctgtgctttctctgtgatgaatgttggtgggcaccgccatgagacacaaaaatcctcacattttatttactttctcatagtaaaatctgcatacttttcttcaaatgtctgctcttccagtcttactctgtactgtttttttttttctttttgactgagtctcattctctcataaggctggagtgcagtggtgcaatctcagttcacagcaacctctgcctcctgggttcaagtgattctcctacctcagcctcccaagtagctgggactacgggcatgtgccaccacgcccagctaatttttttgtatttttagtagagacggggtttcaccatgttggccaggatggtcccgatctcctgaccttgtgatctgtccacctcggcctcccaaagtgctgggattacaggcatgagccaccgcacccagctggttcttgacgaagaaactaggtctttcatctctgccccaaaatttattaataccctcagtgcaagcgtcttcttctacgtcaaagtgataacctaaagctttgttcaaaattctgtccattagtaagattttccctcaatgctgttttctgaagccatttctatttttggctggtatcaatacattggtttatagtaactagcctcttcataaatctgggccagatttacgtccacaggctggacataaggaattccatatgaagtcatagctgtgagctgaggatgagatactggaacaacagaatttggtacttggagtcttggtcacctctttttgtaacttacttgtcatctctgaattcatgtctctgaattctgattaggctgtaggcctaatttttgtcattgctatcatatggtggatttatattgtgcctatacaacttcattatttgataggttgataattcccaatttataattagtagcaccaataatatccttaatagtcacttgatatactggcactggacacttagtccctttgaggttaagctataagttaataaccaaatacttatcagtcaacttttttttaaactgtgattatgaagataagctccataaagagaaaagctaagtctgtctcatatactaagcctagtcatcatgaatattaaagttaggcacatagtaggtgttcagtaaatatttgttgagtaaatacatcctagagtaacttcatggaattatttgatgatgagagatttaaatcagtgccataagtcagccgataacaggtaatactttttcaattagacaatataagcatagctcagaattcaggttgtcctattttgcagcagcatcaggagaagaggaggaacaaggaaatgaggaagaagaggaaaaggaggaagaggaaaaggagaagatagtatttttcgtatctaaaactaagatttcaacatgccgtattcacagtgttcaaagggtgataccagtcagtgtgggagaaggaggagtgtgcttattattttatctagatgtcactgctattttttatgaatcaacttgctactttattagaatatgaaatatttcttttgtcttaaatttatatatgctggtgcaaaacttcttgagaattataaaatggctatgaccaactgtagagtcattttcagaatctatagcttgcgattccagaaatgaaatgctattaaacattagcaattaaagatgcagttgtcgttactgacctaaattcaccagttgtagtgatactaacataaagatttacaacatttttatgaaacattaataatctgtgactatgtcaaggtggggctgggagataaaaggcaaataccctttccatttcacttatgaagctgctttacaaggtttcaattagatctttctttttacccctgagagaaactaacaaatctattgcattaattatggtttcaagacaggatcatgacagccaaaattataaaattacagtcattgcagttgtgtaggctctacttctctcattctgtgtgcctgtagagttggaatgtaactttacaactgatatcttaagaggcagtgcaaatgcagaacaaatatgctgtgcagagcgagagaaagagaagtgataaagccaaagaacattgtctgattaatcaaacaaatcattgaatgtggcttataatatttaaaatgcaagactttaatccatcgattaccatttgaagtatattcatgtttttaaagaacagaacacgattatatttcaatatataatttctgtacagccaaaaaataaaacaccacagtaaaataatgggagaaacataatatttaaaatgcttgacaaaatgttaacatccttaatcataaatgagctcttagtaacaaagagattaactttacaagggaaatgaaaaagaaaaagaggaaaatgaaatagcacaaatgacttataaggttatgtaaagatgatatagcctaatgttaatagataaaaggcaatttcattataaattatattatcaatgcttacaaatattgatacctaatgtttgtatggctgtaggaaatgaggaattctcaaatactgggaaaatttactcctgtcatgagaaatttagtcaaaatatagattttgcatattctttgccctggcagtttcaatccataggaatcattccaacaaagtagttggatgaatttatatatatatatatatatatataatatatatatttttatataatataatatatattatataaaaatatttttatataatataaaattatattttatataatataaaattatatatatatatacacatgaatgtttactacatagaaaatgtgtaagtgatatatcatctgccgagtaaccacttaagtatcaactggtttataaaataagagattgggaggtggaattagaaagaaaaaaggcacttaagtaaaaatactagatttcacaacattctatgtcctttgaattcttaaaaaagatcatgttttaatgaatcagttttatgtttaccctgcgataagtaaaaattataaatatatgcattttatacttaggaaagcactgagatgaaacccttttaattccaccatcctgtctcctttgttcaataatgtatattcatgcttctatcaaattcagttttagtttttcatgtgtatgcatatatgcttgtatacacacatgcatacatagagtgggaaagagctatctctgaatatatattgttgtatttgtgtgtgtttatatgtgtgtttgcatatgaatgtttgtatgtgtgtgtgcatgtaggtgtagctagaaagaaagaaatgggaacttttaactatgagtccacagaactgtcccaaatcacaatacagctatttgaaaatagaaaggattggcatggtcatttattatttcccttaacatttttttaatctaaaaactaattgaatgcctcttctgaaaaatatattatgccaataatataccttatgactaaggcagtcagcagggtaaatttccagattattatttaaaaagctattgtctgtagaaaagaaaagccatgcataaaaatcttatctcttttgatatgggtagtatgttaaagaacactgtcacagcatttcctaaatctagaaaataaaatttgttggaaatatccgtattttaggatattgtctaaaaacatgattaaagttttaaaatggaatgtatcaagtgatccagagccacttaggtaactagctaatgccatagatgaaaagcacttgcaggcagagataactagttgtgagctgattttatatattcaaaaggaatgattttatttttgatgaaataaaatttaaaaaataatgtgcaatcaattaaaaatcataatatgcaggagacagacttagtagtattacatttaataatcaaggcaatgctttctgaaatacctaacttgtagaataaatcatatttatagcatgaataaattaggaaataggtgactgaaagagtaggttaattaaaattagtgcattttctgaactggaaaaggaaataccgtggtgagctagtctatcagagtctggcagtgatttcagccaaagtaatcaaagcagatgggcattcagaaatgaccccaaaagactttatttttatggtcatatactgagtcacagagcttaccatattatctttattcaaaacattattatcacatgaatatttgtgcagactaaatataattgcataacttcttgagaattaggcaagttatctattatacctttctttcaactcatttgcctcacttatgaaataaagataataataatactcatctcctatgatttttttaaagattgaatcaaataatatataagatagaacattggcacagactaaagctttcaataaatgaaaactagtacgttttaaaatattagctgtgctttgacgtttttggtatagcccccattaaagacgtttacaatttacaattatgtaaatttttgtttcattttatggtgtttgggtttataacagctttgcaagcagttaaatagattacaactaagtagactatgctaatctaatcaaagaggcgaccgaattaggcttctgtttttgtttttctttagcagttttatctatatgaaaattatcctcttcaagatctttcaggaaagcttttccactgttggagcacttttaataaatagggttttggttaagggaagaaaattaacaagagacctcaaagaaaattcacttcataaaggatatagacttttagatgacatagcaccttacagcgagtttggagatggagaagagtcagctgggaaataaaaagtcagctggggaaaaaaaaaaaagagtcagctgggaaaaaaaataaaataagattcaggggctaaaaatgaaatctgtaattggaaaaggtctacaagatcattatgtcttttgaattgcaaacaccaggtattataacttatgagaaagatgttttggagtatgcagacaacaggtgatctaatgcttctatttgttcctatacgatcagaggtcctagttcacattgcttattaatcagaaagaaggttttcaatttattggccttactcctgacctttcattccgttgaaactaaagaatcccacatgttggtattgcaaaatgagacaacttcatttacagttagatctgattttatatagcatattatatatagcatattgtgttttaattttgtttttagtagggggagtgggagaaggatgctgtaacattcacaaagatcaagaatacatgttatagacaaacaggtttaattcctacaagtgacatatgctatgtgactctgggcacacattctttaatgttaaggcctgttccttatttgttatttaatcaatagcacccaccacagagtgtgtatgaaacaatcacacaagaaatgcatattgaaaaagcaaatggtattttttaacttcatgttctctttcctatttaaaatgggaataaaaattctttataaattcgtgggaattaaataacgtccactaaacactggatagagaaagtacctgatgtatagtaagtcctcaatcaatagtagcttttattatttgtattaaaaatattcaactgcatgacaagattttttttggacagagagaactattactgctttaaacatcaggcctgtcaggaatttatatcatttactattattttatttatatacaaatttgtcaattattttgatacacattagaaaataaatttttttatcactggataattatgacagagttttaggttagcatttttatagttcggttggatttggaacagatttgatacagataaatcttgaaaacctaaattaagtgagaaagaagtttaatcccaggaaacatttttgtccctttttttacttttccttccttaaatacagtgggaatttagatggaagtgccaaatgcagttccctatatggggataaaattgcctggtaagaagttgtttttcttcctaccaatcgtttgtttcctggattttaatctatgaaagtcatcccaactgtcccttcttattattatcatacttttttaatcaaagtactcactagatttgatacactttaatttcaaaccttaatcaagcattgggttcatttctatgccatccttttgattgtcaacatggcttctaagtgtcattgagaactgtattgggaaaagccagccatttctgaagtctccttataagaattttctttatctgtttattatataaagtgcaatttgtaactaagctgtcctgtatttcttttgctgacagcacttgcagccagcgaaacagttcaggtccatgacttcatccgatacccactgattacccagtacaggatgatgatttttaactccaaatcagcactagctccctgatgactctaattccagtaatagcaatattgcttcaacaaaaagagaaggaccatctgagaccttctacatttattcttatacattagcttatcctgaagtgttcaaaaacctttggtggaggagatagtggaggaaagggataatattttatttttattaaactaaaggtatattcagaggcactcctgttggcttaatggaaaaggatatgactcattagtagctttttttattggtaattttgggtactagcagaggaacagtatcacttctattctctaagagccgaagttgatctatgctccttttgccaagagaactgctcccagggaggaaagtcttttctaccatgcctgttggcattattgctctgtcaatacagacctactttctccacatagcctctaatagccccgaacttacagatctgatagccaggttctatcacctgagacaactttggatcttttgaacttctgagtccacaatcctaaagaaaaaactattattctagggaaaaattaggtctagtcccttgggtctatcaattttagctaaagtaatatgattatataaaatcataatatctccaataggaaccagatgaatataagggggagaggagaagtcttttggcagtttgtcatgttttctacagtgtctcacttccacaccctcttcccaattagaattatccatttctgcacagaatggtaaaataatctattttgggctaccagaaaactatcaccaaacctcagcttgaccttgtttgttaatgtctcgttattgagtctagaaagtggtggtatctgagtccttaatcattcaaatttctctgctgtgtattaaattgcagaacttacaaaacatgtcaactagttttcaaatcctgatccaatgaatttctggtattgattctaggtttaaaattgcaccgtttctctagatcccattttacagttgatctttaagtgacaatttgatatatagtagcttttcatataatctatgttcatattacttcctagtcttttgtaacggtggtaggagaaatcattgtcaaccatttcaatgaactacaaagaaatagatgtacagaaaaagttaaggaaaaaatataccagaaatcttccattaaaaaacaggcagatgaatctgtacaagattgtagtacaaaactagcatgaacattgggaatcctaaatcaaaagctcttcacttagtttaagttcttgggacttaccactaatgagacttgaaattccttcaaaatttagtatagaataaaaatcagatttccaggaagacttgtcaaaaatatctaagcaattgaatcagaaacctattggattattttctcttaagtagaatacatcattttctttccataaatagacaacataaacaccacctgttaacaatgattcaattaattcaatcaatagagtcagtcttgctttgaggatcaaaactaagccaaaaccaaacaaagctcaaaacaatgttttccccacaataatagaatatttgtaccttagcttgttataaacatactaaaagtaatatgccatattaattagtctatgatgtcacaattgttgatgactcattactttttaattttttttttactttggcctcatctttattcttacaagtctaaaactcaaaattaataagatagtggtaaatcaatgataaaaagaccaaaattataattgtttcttacatcatatacaaaaatcaactcaagatggatttaagacctaaatgtaaagcctaaactataaaaaccctggatgataacctaggacattctggacataagacctggcaaacatttcatgatgaaaatgccaaaagcaactgcaacaaaaacaaaaaaaattgacaaatgggacctaattaaagagcttctgcaccataaaagtaactattaagagagtaaacagacaacctacagaatgggaaaaaatattttcaagctatgcatctaacaaacgtctaatatacaggatctataaggaacttaaatctacaagcgaaaacaacccccttaaaaagtgaccaagcacatgaacagacacttttcaaaagaagacatagaagtggccaacaagcatatgaaaagctcaacatcaccaatcgttagagaaatgcaaatcaaaaccacaaggagataccatctcacactagtcacaatggctattactaaaatgtaaaaaattaacagatgctggagaggttgtgcaaaaaagggaatgcttatacactgctgattgaaatgtaaattagttcagtcactttggaaagcagtttaaggatttctcaaaaaactaaaacagaattaccatatgacccagcaatcccattatagagaaatataaattattctaccgtaaagtcacatatatgtgtacattcatcacagcactgttcacaataacaaaatcacggaattaacctaaatgcctatcaatagtacaatggacaaataaaataatgtggtacatatataccatggaatactatgcagccataaaaaatgagatcatgtcctttgtgggaacatggatgaagctggaggctgttattgtacaccaactaatacagggacagaaacacaaatactgtatgttcttacttgtaagtgggagctaaacaatgagtacatatgaacacaagggaacaacacacatcaaggcctacttgagggtgaagggtgggatgagggtgatgatcaaaaactatgtatcaggtactgattaccggggtgacaaatgatccctacacaaaactgctgcaacatgcaatttacctatataaggacatgcacatgtacccctgaacctaaaataatagtaaagaaaaagaaaatagttacaataagttccataatattaatgagttagttaagtggatgctttacctattggttccatcatgtgtgcttgtttaattatttttttgtatgacagtttattagaagcatgattaatttttgaataaaaaactccctgaagctttctagagaaaagaataatattttactgttttaagcagtatttaatctaaacaaactttttatttatttagacacagggtcttgctgtcatccaggctggaatgcagtggtgtgatcattgctcactgcagcctcaaattcctaggctcaagcaatcttcccacttcagcttcccaagtagctgggaccaaaggagtgcaccaccacatctggctaatttattattattattactattatttgtag

SEQ ID NO: 1595 - DNA, 14049 bp, Homo sapiens
gacagagccagactctgtctcaaaaaaaaaagatttaatagagattgaagaattatagtgttattactttatgaaagagctacctcttggtgccattgcctctgccattggtttgtttggaatacaatttcaaataacttttaggttttcgttttgaaatgaaacgattttcaaaacaggtacttacagaagttcctcattttatttaaaagccataaaaactataccttcaatacacagtgcttctagcctctgaaaataatattttatgtgacatgtgacttaaccttatttatctaacaaaactttattgaggaaacaccacaggaaaatactatgctaagaagtttttatataaatactaaatgggaagttttaggtaaatataagcccttttcctttagagcaaacaaaatttgttatgttctaatatcataacttttggcatatttaaatgagctgaaagtttaacagtaatgttgtgaaacatgtaaaaattaattgacatctttcaaaatattaacatgcataagaaatatgttaaataaattttaacaaagtaaacaaagcctcacgataataattctttatattttaagaaaagcgattattttcttctagtgtcaatgcagattattttacttgatttttggttacaggtcaatttttccttctaaaattcagcaaatagtgaatgagtagcatctacgcaaatattagaaaatgcttagtgacatctactgtagatgactggagacatctgtgaacttagacaaatttctgcttgccttctaacacttcaggtttaaaagggatagcgttgactgggaagcttctcactttcatttctgaaataaaacattaagacttctttgaaactaaaataatttctgctaaccagttgcaaagtacaactgtgttccaaaatattttggaactttatttattgtttgcatgttcagaaattaattatgtatgcatacatttatgtattcattacaggctttgttgctgcccagtcttttgaaagatatttgaaaattcaggatacatgtttacagaagagacaaacttgacttcattatctagagccagaacacatagtatctgtatatccacggtgattgggactaatgccaagatttgaaataatacctcagacagttcagcttcagagagagaatagcttttgaaaaatctaaaatctaccttaggaacgtacatttctctaagcaaagtgagtatgtaaacaaaatgttttattatcagggatttctccctttccccttcaatgttccctttctctttcaccaggctcccaggctcttgacactcctggttcctcccagtccccttgtgattcctttaatatctatgcctatttctgagatatcccttcctcactctgccccctgcatacccgtcagttgccttgtaatgtccctttccctgaaagcctcgttatttacctacatttaaaatatagattatattaggcttataccctaaccattccacatgagatctacactgtaattgaggcttctaaaaagtgatgtggtatggaggaccatgatcagatcagtggaggcctttgggagacgggggagctttggaaatcacatcagtgaaaggtgtggacaaaaacggccttttgttgttccacatcattttttaatcgtattttttaaagaaaaaaatgaaaagattccctcaagtaagtatattattctggtttcctcagaccatctcactaacatgtttcattcactattccagtatttcactcgcgttggtgagaagagaccaccaaacaggctttgtgtgagcaataaagctttttaatcacctgggtgcaggcgagctgagtctgaaaagtgagtcagcgaagggagataggggtggggccgatttataggatttgggtaggtaaaggaaaattacagtcaaagggggatgttctctggtggggaggggtggggtcacaaggttctcagtgggggagcttttgagccaggatgagccaggaaaaggaatttcacagtttgccagtcctgggcgggggcaaatcctcgagcttgatgtgtaggaaagggagggggcctgagcaatccttgaggggtagtagaatagcagatggaacattgagaagtgatttctttgaggatagatttccacgatggaaaggaaatgagaggttctaagaggcaggctagtggcttgtactatagcatagcctgcctttgctagtgtgtggtgattaggcctggtggaactgccatcagtaaaccaagtgtgatcagggtgaggaacaggaaagaaggaaatatggggaaatggggtgaatgtcaggtggatcagagagatacagtcatgaggttcaggtgtggtatcaggaataatgtgggaggccggattgaagtctgggccaggaacaatggtaattgtgggagactcaacaaagagtgagtacagctgaaggagccggggagcagaaagtatatgcgtcaggtgtgaggaagaaaatagattttggaagttaggagaactgtagagagtaagttgagcatagtttgtgatttttggggcttctaaaagtattaaagcagtggcagccgctgcatgcagacatgagggctaggctaaaatagtaaggtcaagttgtttggacagaaaggctacagggcgtggtcctggctcttgtgtaagaattctgactgcattaaccatgcctaggaaggaaaggagttgctgttttgtagaagggattgaggtttgggagattagcgggacacaatcagcagggagagcacgtgtgtttttatgagaattatgccgagataggtaacagatgaggatgaaatttgggcttgactgaagtaatgggagctgtctgtgaagccttgcggcagtacagcccaggtaatttgctgagcctgatgggtgtcagggtcagtccaagtgaaagtgaagagaggctgggatgaagggtgcaaaggaatagtaaagaaagcatgtttgagatctagagcagaataatgggttgtggagggaggtattgaggataggagagtacatgggtttggcaccaccatggggtggataggcaaaacaattcggttgataaggcgcagatcctgaactaacctgtaaggcttgtctggctttaggacaggtaaaaagggggaattgtaaggagagtttatatgctttaaaagaccatgctgtagcaggagagtgataacagtgtcaggcctctgagcccaagctaagccatcatatcccctgtgacctgcacgtacacatccagatggtcggttcctgccttaaatgatgacattccaccacaaaagaagtgaaaatggactgttcctgccttaagcgatgacattatcttgtgaaattccttctcctggctcatcgtggctcagaagctcccctactgagcaccttgtgacccccactcctgcctggcagagaacaaccctcctttcactataattttcctttacctacccaaatcttataaaaacggccccacccctatctcccttcactgactctctttttggactcatcctgcctgcacccaggtgaaattaacagccttgttgatcacagaaagcctgtttggtggtctcttcacatggccacgagtgaaatttggtgccgtgactcggatcggggaacctcccttaggagatcaatcccctgtcctcctgctctttgttccatgagaaagatccacgtacgacctctggtcctcagaccaaacagcccaaggaacatctcaccaattttaaatccggtaagcagcctctttttactctcttctccaacctctcttgctatccctcaacctctttctcctttcaatcttggcgccacacttcaatctctcctttctcttaatttcagttcctttccttttctggtagagatgaaggagatgcgtttcatccgtggacccaaaactctgatgccagtcacagactcaggaagacattcttcccttggtgtttaatcacgcggggacgcctgcctgattactcacccacgtttcagaggtgtctgaccacatggggatgcctgccttggtccttcaaccttagcagcaagtaccacttttctgggggtgtgtgggaccccatggaaaatcagactgttcaactcacctggcagccactgacagagcccctggaaatctggcccaagactctctaactgactccttcccagatcttctcagtttagagtctgaagactgacactgcccgatcaccttggaagccccctaaaccatcttggatgctgagcttcgggtaactctcacagtggtgggtaagtccatccccttcttaatctctatggaggctaaccactccacattacattcttttcaagggcctgtttcccttgccttcataactgttgtgggtattgatggccaggcttctaaacctcttaaaactccccaactctggtgccaacttagccaatactcttttaagcactcctttttagttatccccacctgcccagttcccttattaggccaagacactttaactaagttatctgcttccctgactattcctgagccacaaccacacctcgttgccaccttttcccccagttcaaagcctccttcacatcctcaccttgtatctccccaccttaacccacaagtataagacacctctactccctccttggtgaccgatcatgcaccccttaccatcccattaaaacctaatcactcttatcccgctcaatgccaatatcccatcccacagcatgccttaaaaggattaaagcctgttatcactcgcctgctacagcatggccttttaaagcctataaactccccttacaattcccccattttacctgtcctaaaaccagacaaggcttacaggttagttcaggatctgcgccttatcaaccaaattgttttgcctacccaccccatggtgccaaacccatatactctcctagcctcaatacctccctccacaacccattattctgttctggatctcaaacatgctttctttactattcctttgcacccttcatcccagcctctctttgctttcacttggactgtccctgacacccatcaggctcagcaaattagctgcaagtcttcacagacagctcctattacttcagtcaagcccaaatttcctcttcatctgttatctatcttggcataattctcataaaaacacgtgctctccctgctgatcatgtcggactaatctcccaaaatccaatcccttctacaaaacaactcctttccttcctaggcatggttagtgcggtcagaattgttacacaagagctgggaccgcaccctgtagcccttctgtccaaacaactggaccttactgttttagcctagccctcatgtctgcatagagtggctgccgctgctttaatacttttagaggcccaaaaaatcacgaactatgctcaactcactctctacagttctcctaacttccaaaatctattttcttcttcacacctgacacatatactttctgctccccggctccttcagctgtactcactctttgttgagtctcccacaattaccattgttcctggcccggacttcaatccagcctcccacaatattccgggtaccacacctgactcccatgacggtatctctctgatccacctgacattcaccccatttccccatatttccttctttcctgttcctcaccctgaacacgcttggtttattgatcgcagttccaccaggcctaatcgccacacaccagcaaaggcaggctatgctatagtacaagccaccagcccacctctcagaacctctcatttcctttccatcatggaaatctatcctcaaggaaataacttctcagtgttccatctgctattctactactcctcagggattattcggacctgctccctttcctacacattaagcttgaggatttgcccatgcccaggactggcaactcttaattccctcttagagtggatagatgatctttgctggcaggggaccctccaataatttcatcctgatgaagttctattctttacttttagagtcactcttattctcattcccattctttagccaccctctacttctccccagccatctccaccacactatcaaccttactcattctctcctagccatttctaatctctccttagcgaacaactgctggctttgcatttccctttcttccagtgcctacacagctgtctccaccttaaacacagactgggcaatatctcctgtctccttacacctctgaacttcctttaacagccctcacctttaccctcctgaagaacttatttactttctagacaggtccagcaagacctccccagacatttcacatcagcaagctgccaccctattccacacttacttcaaaaacctttctccttatatcaactctactccccccatatttggacctctcacaacacaaattactattcctgtggccgctcctttatgtatctctaggcaaagacccactgcaatccccctaggtaactttcacctgctcgacgttcctttactgttcatctccaaagccctcttcttgtttacttatacccagccctgaaaataacagtgaaaggttgctcgtaggtactcaacgttttttcacacaccatgaaaattgaatctccccctcttcgcagttacctcatcagtccccattacaacctctgacggctgccgccctagctggatccctaggagtctaggtacaggacactcctttgcagcactccttctcatctttttactttgcatctccagttttgcctcgcacaaggtctcttcttcctctgtggatcctctacatacttctgtatacctgctaattggacaggcacatgcacactagttttccttactcccaaaattcaatttgcaaataggactgaagagctccttcttcccctcatgacaccaacacgacaaaaaagttattccactaattcccttgcttgtcagtttaagactttctgcctccactattgctcttggtactggaatagcaggcatttcaacctctttcacgaccttccgtagcctctctaatgacttctctcctagcatcacagacatatcacaaactttttcagtcctccaggcccaagttgactctttagctgcagttgtcctccaaaaccgctgaggccttgacttactcactgctggaaatggaggactctgtgtattcttaaatgaagagtgttgtttttacctaaatcaatctggcctggtgtgtgacaacataaaaaactcaaggatagagtctaaaaacttgccagccaagcaagtaattacactgaagccccttggacactctctaattagatgtcctaggtcctcccaattcttagtcctttaatacctgtttttctccttctcttactccgtttagcttttcgattcatacaaaactgtatccaggccatcatcaataattctacacaacaaatgtttcttctaacaaccccacaatatccccccttaccacaaaatcttccttctgcttaatccctcccactctaggttcccgtgccacccctaatccctcttgaagcagccctgagaaacatcgcccattatttctccataccaccccaaaaaatttttgccatcccaacactttaccactatgtcattttatttttcttcttattataagaagacaaacaggctttaatctttttaaggcatgctgcgggatgggatattgacattgagtggggtatgagtgattaggttttaatgggatggtaaggggtacatgatcagtcgccaaggagggagtagaggtatcttatacttctgggttaaggtggggagatgcaagggcaggatgtgaaggcggctttgaactgggggaaaaggcggcaacgaggtgtggctgtagcctaggaatagtcagggaagcagataattagttaaaatgtcttgacctaataagggaactgggcaggtggggataactaaaaaggagtgcataaaagaatgctgtgcaagttggcaccacagttggggagttttaagaggtttagaagcctggccgtcaataccgacaacagttatggaggcaaaggaaacaagcccttgaaaagaaggtaatgtggagtgggtagcctcagtattgattaagaaggggacggacttaccttctactgtgagagttacttaaagcatctgtgatggtctaagaagattctgaggcgatcaggcagcgtcagtcttcagccactaagcgaagaagatctgggaaagagccagagagccttgggccagagttccaggggctctgggagtggctgccgggtgagtttgatagtccaatttccagtggggtcccgcacagatgggacacggcttaggaggaatcctgggctgccggcattccttggcccggtggtcagatttctggcacttgtagcaagctcttgggggaggcaggcctggaggaacgcctggccactgtggtttaggtgtttggaagaagtccttgtgtgctggagatgtggttgaggtttctctcacagtggaggtaaggaattgcaactcagaaatatgttgctacttggctgcctctattctgttattgtacaccttgaaggtgaggttagttaagtcctgttgtggggtttgagggctggaatttaatttttctagctttatttaatgttgggtgcagattgggtaataaaataaaatgtatattgagaataagacggccttttgacctttcagggtctagggctgtaaagcgtctcagggttgctgccaaaggggccgtgaactgggctgggtttttcatatttgatgaaagagtctaaacgctaactgatttgggagaggttggataaagaaaaaggagcatcaaccttgactatgcctttggctgcagccactttttaagaggacattgctgggcaggtgcaggaagaaaactgtaagccggaccgggtgtgaggaggggaggtgataaaaggattatagggtggaggagcggaggctgaggaagagttgggacctagcttgacctggtgatgaggggagaggtcagatgggtctgtagaaaaggaagattagaaagactcagcaacacttggggttgggactgaggggacaggcgagagggaaagaaggaggatttgggacaaatcgcattggggacagagactagggagggaccgaggtgtcaaagaatgcctggacatcaggcacctcagactgtttgcctattttacgataagaattatttagatattgtaggatgtagaaattgaaagtgccattttctggctatttggaaccactgtcaaatttgtattggggtcaagcggcattgcggaagaaaataaggcatttaggttttaggtcaggtgtgaattgaagaggttttaggtttttaagaacacaggctaagggagaagaagggggaatggagggcagaagcttgcccatagtgaaggaggcaagcccagagaaaagagagtagagacacggagagaaggggttggggggttcttgccctccagaaaagtgcagaaggggtagagacacgaagagaaggggtcaggggattcttgccctccagaaaagtagagaaggggtagagatacagagagaaggggtcagacacaattggcagggaggcaccaaatttcacttgcgtccgtgtgaagagaccaccaaacaggctttgtgtgagcaataaagctttttaatcacctgggtgcaggcgggctgagtccgaaaagagagtcagcgaagggagatagggatggagctgttttatagggtttgggtaagtaaaggaaaattacagttaaagggggatgttctcaggcgggcagggttgggggtcacaaggtactcagtcggggaggttttgagccaggatgagtcaggaaaaggaatttcacaaggtaatgtcatcagttaaggcaggaactggccatctggatgtgtacatgcagttcacaggggatatgatggctccacacagggatgagagttgctgctgcccagtccagagccacagagccaaggagggcctggcctgccccatggcccattacagaagagttcttcttgttggcagagactgggatgaaattccttaccatgaaggactgtattttttttttaacttaaatattcattgagcagcttctatatgcaaattatgaatatggagattcatatcatatattgtcactgcttcaaaaagctcacaatctcttttcttccgcacagatttctgcatcctctcagtcatgatgataaaggatttactacctcagtcatgtcaccactcttgaatatcattcccatggcatggtgcagtaggaactggaacacatactttgagaaatgactgctgagaagaattggaaagggactggaagcaatgatggctaaagaatctcgagaaggaagacagactatacatattttttctaggaaattaaaagggaagataatttcataattattgccaatgttgtaaatagtaatctccatctctccatcagatagagaagaaaatgggattaaaatgtagtaagagaaatttagatggtttataacagtttgaaaggaatcatgagttaaatttcatagtgtagaggcaggaggctaagagaggataaagatataccgctaatgtttataaattctgtacattatccactccttacctctcaaaagcctctttgctaaaagtaggtgtcattatgtatgcaaataagggaagctatgccatgaaatgtaatccttaggctgctcatagtcttaagtacttttaataattgactcacttgaagtatttatgtagacctacttacaagaaaaaatatgaaaataatgtaaataaaaatgttacacactttataattaaattcttactttttatattgcccttgattgaaatcaaataattattcaagaataagaaagcattattatgagttaaatttttgagatgcaaaattatatgttctgcccattttctctacctgttttgtgtgaaagataatatgattgaatgtatgctttgtttgtgcccaagtacacgtctgaaccacagcctattctttatatcctattgagagaattgtggctccttttttcttttacgttacttaatatttggctgtagctgttctttggcagtaggtagggtatttgataattctgctgtgctgcataaacatttttacttcaaagtgattgcttgtccatgtctcactggaattatttcaagtcagacgtctaattctgtccaacatctttaatgttttcaaaatcatcttgggtgttgttaatggagtatcattaggtacaatttgaaacatttcagtgggcagtacatggattcagaatatttgtgcaatatgtgctcttgcttctgaagtctttgggggatttttcttttatatacccttctcctaacactttattttctttactagttgacttagttgtatagttatagtaaacataatttttccatttggccaatatttatgaaaactatagtaggatccaaacattccaaaagagcactgggataagaaagaggtggtgcctgtactatacctacagctaggagaaaacaggacacatagaaataaactcaagtacaagtgtgggcagtcataatagccaagaaagcccagatctaggagttcttaatatcattgggtgaagaaaggaacattttgatgttcctcagaagcacaaagaaaataaccccaagaaagaggattggcttaagaaaaagtatataaggatatgatctgctccaaaagcagaaagcactacatcaactgaaagaagttttggagagagaaatgtgaattatgctgagatagctggctttattcttcagatcaagggaagtattaaaaatttaaaacagggtatagcatggtcagatttgtatttaataaaaatatatctgaaggtcacatatttgacacactgtatggaagatacatttaagtagtcctattggtgaagaactgcttgagtcgctacacatgtggcatcgaactaaattagaaatgaagagaaattattcaaggctagaatattcagaaactatcagtgcatctaacacatacaataaaggctcaataaatgcctaatgatgaaaaacaaaaattaatgcacaaattgggtttcaaatgttacattgctagaatgtttaaaattatggagtcattttatgtttgtgtgtgtgtgtgtgtgtatatatatatatatatatatatctttttatccttattgaaggcagagatttcaaactacgtatgaagtattcatatctgtagatttatagcagattggtgtgttttctgttttagattgcctgttttgtagtagagagatgcttctcaggacgtcgtgggatcacactgttcagactgatttccaacaggcacagcgtgaattgtacagtaacttgttaagaggtcacctagacgttctcttaggttcctttctcctacagaagctaaggggaccgtctgttaaaaactccatggagccataaaatggcagaacattttgtccaggattcctctgcagtgagatgattccctccacctgatctgtatgccacctgaccctcaccttgtatcattctgtgagaaaaaaggaacaccaaagatgatttgttggttttccagtgcaagagtgatccctccttcgtttttaccaaaaagagggctatttaactggataccaggagaagcaaattgctgatccagtcatggatgttttaccccattatttagttccactctacatggaatttatttggaagattctcaatgcacttgcattcaaacataaagacctaatgactctcattgcagcagtattcctcttgtattgttattttcttaacttcggatttcctccatttctgcactttttgccatctggaatttcatttgcaagggcagataaggggaaaagaatgtaataagagacgaggaaaaatataagcccttgctgaatgattgatatgaatgaaggaactgatggaataaataacaaaaataaaaagatccaggactactctcagtctctgaagcaggtgggagccctggcggtagctatgggtccagttcaaaggattatgaaatgcactgctttcacatcaaaaaggaagaagaaaggcaatacttgcaaccaatgataaagaggtattctgactttcatctgcctttgtgttaagcgtgagagagccagacagaattgcagcaggaaccagaaggagcaaagaaaaagattactgtttcttttataaaatggtttttatcctactggtgtctctttaaaaataaaaatcaacaaataaatgtccatttaaattgatcttctgttggactatgttattagtctgacatacaaattagtgcttctaagatttaactatgcgactgagaaccaatattttatggagagtgtcaaatggcttgcctttacagcaattcttttcactgtatctattttttttaatgtggatgatggaaactactttaatcaaaaagttaataatacttatttggaggtatgataaagcaaatgtctttggccacattgctgttattggaatttaagggctattatcttttgtaggacaatttttaaaatacagtttattctactcagtgccctaagtctgtttcttactagccatgaccttcagaagctgactttacctctctaagccattctcctcctctgtgaaatgggaatgttaatacccactcttgttactctcagagtgcaatgaggatcaatgagaagataaaaataaatgtgtttggttaactatgaaataccacgtaaatgttattagtatgaattatttatagaccatacacttgatggaggcaaaaagtagacctttgttgttcccatgaaaccacagtaccttccacagtgcctgacaagaagtaagaaagcaataa

SEQ ID NO: 1596 - DNA, 18915 bp, Homo sapiens
tagaaataccatttgacccagccatcccattactggctatatacccaaaggactataaatcatgttgctataaagacacatgcacatgtatgtttattgcggtattattcacaatagcaaggacttggaaccaacctaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctgggtactgttgtggggttgggggaggggggagggatagcattaggagatataactcatgctaaatgacaagttaatgggtgcagcacaccagcatggcacatgtatacatatgtaactaacctgcacattgtgcacatgtaccctaaaacttaaagtataaaaaaaaaaaaaaaagaaagaatggtgtcatttcaccctagctgctttcaagaattttttctttgtcttcagttttcaggaatttcactattatgtacgttgctttgcatttctttgggttatactgtttggggtttgcttagcttcttgaatctgtggatttttattttgttgccaactttgggaggttttcagtcataatttctttgaacactttttttcaccccattctctttctcctctttttctggaacactgatgacacaaatgctagatacatttattatgtatacattggtctgtgagggtttcttcatttcttcttccttttttggtccattttctgtttttccaaaagtgtaatttgtatctttctatctttgagttcactgattcttttctttttctctctattctgtttttgaacccatctattgtttcttttgttattttatttttcagttatatatttccattttaatataagttcttgacttaggatgacttaggatatttcaactttcggatgagttcactgtggatgctaaatgcatttttgacttatgatatttttgacttgcaatgggctattaggaatgtaatcccactatgagtagaggagtatctgtattctatcactttgctgaaacttcctcttttcaaaatttatttcaagcttgtttataatgtttgttgaaatatttcctttattgttgtcttaaaatcttcttcagagaattctaacatctctattttctcagtattcacttcctttcccactcagtatactctttttgttatgacaaatgatttttgattaaaagctaaatatttggggtattatgttataagatttcgagtcttatttaaacttcttttcattggctttttctgacaatacttcaccaggggaagaaaaggcactctgcctcaatactgcaagatgtgggaggcagttacgtacaagtccaggctccttactgaatcttcagtgacagctgacatgtgtgggaatactcctcattactgctcactgcacagcctccactaacatctgactctaggtgggtagggtggagagaaaaagtgcttgttatttatgggtgttgatggaagtcctgactgtgtgaggcttcctctggcaccactccagcagtgaggagtagggtctcctcattactgctgggtagggatgaaagtgctagctttctacttagtctttctgataccaccttcagggaggaaggctttgggctgcctcatcaagccagttgaaaatggaagtctaggctccccactcaacctttgctactgtgagtagggtcgggccacagttttttttttttttctatgtgtttgtctggagtaaaaccattattgtttaaagttttatatctttctagactatttctttcacagtccttgggctagacaaagaaggattttgattggatatatataatatatccaatctccatatatatattggaaaaatatatatatatatatatatgtattttttgtctatgcccattggcatttttggcttaccagtttttttttttttttcagctctaagtcaatgatatacgagccaaaaacaaaacttagggacttactactgtgttgtttcttgggtcccagggtccttaattggtcgccttcttctctctacctttgaggatcttcttacgtttgtttacatataatgtgtagggtttttaactgtacatagtaagagatattttttaaaaatgcattcagaactccatcttctgggaagtgaacattttctataatgtttttaaagtagtactcttgaatatccatgtgactccataaaccaattataggaccgtctcaaaatagattgtgctaaaagatccatgtctaatcattagaataactgaaataattagtctatatgtgaccactttacatatttccatgtttcaactactatccaatttaacgttcaaggcatgtgaatgaaaaaacaagcaaacaaaaataaatgtaatcccccaatactaagaattaagctgtataataatataaagctcctgctgcttattttttgacataactaccctgatatattttatgtacatttccatcctacatattatgtgtcttctgtttgtttggatatttcatatcttctttgtgattcagtctcattttatcaactagtatttcttttcacaatttttaatacatagttatttaaatgaaccaatttatgggttaatgttttctctggcttctatgcatcagtagccaccttcttgccatgaatctcttttacctatagggaacgaatattataagcttcagatccaaagtgggagtggaaatcctgctcataatctttattagatatgcaaacttgagcaaaccctttagtgtttctgaacctgtttccttgtatataaaatggggataataattaccacatcatgatgttgtatagagtaagaaaaatgtgaaatcattgagccagtgcccagaaaatgccagatgccaaataaatgttagttctcttcctttctctccttagtaattaaataaatacatgtaaatgaaaaaagctttcttgtgtggacaatctttacgttaacaaatctcctatctctcctccattactttattactatcaaaacacactgggggaggggtgggatccctacatttgtattttattttcttttattagtttctgcattttactctcagtttttgctcctcttataatagcttaatatccaatatatctgaagtttctattttcttcttttatggaggtaagaagatatgatttggtattaattaaatcctacaattttattatatctatacttttcatacaaagacagtaatatgtaatatggtagaaagagcaaagcattttaaggattaaaaatctctctacatttagataataactatgtcacataaagaaaacaccaaaaagactaaaaagttgtcagtggttgtttctctcttctctaaactctctactgccgtagatgggaaaaaggaaggaagactgttaacatttaaatatgagaacatcggaattgatccaaataattcttcgtaacaatcgacatttgtgcaaaggtatttttatgaaagttaataaaattattcatttttcacactttatgtacacctgtgcataaggaaaaaataaaatgaattgattttacacatgagtgaatttctttcatttatgacaattagtcatgaagactctagtgccctaggattattttataaaatagaaagtttttttttttgcttgtttgtttttttttttttttttctgatggcataacacaacacactaacacttggatagatgaaaagcagaactgtttgctacttactgcttcaaataagagaaggctatgaggcagggccactctgggagttgtgctaaggacaaggtcacagcaaactggagccagaagtgggcagcttatgaatggcaagtggggtgggtttagctacatctaccccatccatgtaagttggtgaatttaattaattttgtgggctgtagggataggaggtgtttttacttctttactacctcgccctgggatgaatagggaaggtttatactaacctggaagtgtgagagctggataatgggaagttgttcctgtgtgaacttatcagctgcttaaaaaggagaactgatccacttttcaccaagacctaaaaactggctcaagaaagtatttttgaaactacattacgagggcccacctagttcagtagcagggcatgctgtacaatgattagttgtggtttcttgttgaaaaatatcattgtgtacatgatagcatttggtagagataaccattttgacatgactattctaaatataaaataagacttttagggtatatttatctattggtacttgcagttgtttgggctttgtatgataatagataatacattttttgtttatttgcttgtttgtttgttttgagacagagtctcaccctgtcacccaggctggaatgcagtggtgtgatctcggctcactgcaacatccaccttccgggtgcaagagactcccctgcctcagcctcctgagtagctgggaccataggcacgtgccaccacgcccagctaatttttgcatttttagtagagacggggctttaccatgttggccaggctggtcttgaactagtggcctcaggcaatccgcctgcctcgatctcccaaagggattactggcgtgagccaatgtgcctggcctgataaaacatttttatatactgattaaaacactagtttaatttctcctcctgccccgaagattagcagaaatataatatgtagtcataccttctatagaaaacttagtataaggaaagcttgtgaagaagtcaagtgggctttgcaggacattagaaatgaaattaaaagtaaaattaaagtattttattatttgaatgctttcaattgctacaattctccttgactctcactgaataatgttagttctacattgaatagtttccacttgtgacaaacctcttgatatgctaagtttgaatattgccaagacttgcttgtttttcttagtttattttgaccatttgaaaaataaatttaaataaaaggtccttacagtgctacatttctatttgcgtggcttaaatggttgtattttggaaaaggtggtttggtcatttcaattgtctttgtacatgaatctgttgaccgcatcataactccaagagaataatatacaattgattgagaagttggccagagaaaacagtttgattgcacaggtgcccttgtcattggtgggtgtatgtgtgacttttaattatgtctgtataaatttgctggattaaccttgcatttctgctattttttcaactgttaaatttataaagccttgtattggctattgttcgttcaattgcctcagacacagtttttatgaaggccaaacttgatgtgggccaaaattgttgatagcttccagaatgaagactcttttgtgtagttgagaattagatggcatgtaaaaggtgaaggaaagtgattttacaaaaagatgctaaggaaatgttgagaatagatgctagtactactttctttctgtctacattgttccttattgctctttgccttctttcatagtattttctaataaatgctaatgataataacaacagtggcaaatgcattagcataaactactgtgtaatcttatataactacatgttatttatcaggtggattaaacacagaatttataaagatatattttctattgattttaggaggtggagataaaatggatttctttaaaaagcaagataaatctgatatgctgggggaaaaaagtctacgatactaaagcaaatgttctctttcctttgtccagggaactaaatttttctgatgtaaagccaattgctggagagagattcactggggatcacttctgttgaaggaataagatgaatttgtgaaaaattttgaaactctattagaggatttggatgcagtgtgcagtgtcagctattgtaacactttatagttgaaatgcacataatatatattactgttataaaatgccttgctgtgaatattaaataaaaacagcctagataaagtggagaggttactaaacaagatatgtggatttacagaacatcattcttgttccaaatataataaagatatacaaaccaatatttattcctttaaatgttataaatactttctaagcacctacatcttttactttctattttaaagactatattaatttccagtgagaactgatactgattccttttcttttgtgtaggccatggatattaccatatgattaagtgactttctctgtaagattgtaatgttaatgaataggactctttctctttgagttataaatgtctctggttgccttaacatgcatcattcctccatgtatttacatagtgattcagttaagactttgacttgtataaactttatccagtttgctatccagttatagatcttgaaggggaaaaaaaatccctgaaaattttcatcattcttctaagactgagtttaagaacaaatttctcctggtgtttgtctccaaatttctgaagcctgatttgcatttttttttttttttttgcattacattcaccacctaatatatatttcttccaacagagaactgcccaataatcatttgttagctgttttttaatgaagatgggtcacacccatctttggtgataaatgtcgtaagttgcaaataactggcacttggatcttccaacctaactttttgcaatatgtcaatgttttcacaagccatgaaatgagcctactgaaataggaatcaaattgctgaaatctattaagaaactgattttgctattttcatagattttcagtgaagacagaatgcttttaacttaagaggcaacatagtttggagacagaagatgaccaaagaatttattttttaaaattgatacataatattttacatatttatgggggtatcttttgttgcaagcatagaacatgtaatgttcaaatcaaggtatttggagtacccatcatcttaaacattgatcatttctatgtgttgggaacatttcaagtttgtgactgaggaattccttggaatatgaaatccagaagcctattaaaaccacagccacagtaggcttttatgttttaaacaaaataactagagtagtctgtgtgttagattcacaatcctgagtgaaatttactctgacaagaaaatcactgagcagggttaaatgatttgccattattttagaagtggaaagagatattaaatacttatgtaatacaagtataaagaaatgtccaaaaaatttgacatgcacttctgtgtatataagaaatggagtgataagggattatagagacacactgtcaggcctctgagcccaagccaagccatcgcatctcctgtgacttgcaggtatacgcccagatggcctgaagtaactgaagaatcacaaaagaagtgaaaataccctgccccaccttaactgatgacattccaccacaaaagaagtgtaaatagccggtccttgccttaagtgatgacattaccttgtgaaagtccttttcctggctcatcctggctcaaaaagcacccccactgagcaccttgcgacccccactcctgctcgccagagaacaaaccccttctgactgtaattttcctttacctaccgaaatcctatgaaacggccctacccttatctcccttcactgactctcttttcagactcagcctgcctgcacccaggtgaaataaacagccatgttgctcacacaaagcctgtttggtggtctcttcacatggacgtgcatgaaatttggtgccgtgactcagactgggggacctcccttcggagatcaatcccctgtcctcctgctctttgctccgtgagaaagatccacctacgacctcaggtcctcagaccgaccagcccaagaaacatctcaccaatttcaaatccagtaagcggcctcttttcattctcttctccggcttccctcactatccctcaacctctttctcctttcaatcttggtgccacacttcaatctctcccgtctcttaatttcaattcctttcattttctggtagagacaaaggagacaagttttatccgtggacccaaaactccagcaccggttatggaatgggaaggcagccttcccttggtgtttaatcattgcagggacacctctctgattattcactcacgtttcaaaggtgtcagaccacgcagggacgcctgccttggtccttcacctttagcagcaagtcccgcttttctggggaaggggcaagtaccccaaccccttctctccttgtctctaccccttctctgcttttctggaggaggggaagtacccctcaaccccttctccttcacccttagcggcaagtcctgcttttctgggggaggggcaagtacccctcaaccccttctccttcacccttagcagcaagttccgcttttctagggggcaagaacccccaatcccttatttctgcaccccaacctcttatctctgtgccccaattccttatttccatgccccaaccctttctctgattttctggagggcaagaaacccctaccccttctctgtgtctctactcttttctctgggcttgcctccttcactatgggcaagcttccaccttccattcctccttcttctcccttagcctatattcttaagaacttaaaacctcttcaactctcacctgacctaaaatctaagcatcttattttcttctgtaatgccgcttgaccccaatacaaactcgacagtagttctgaatagccggaaaatggcactttcaatttttccttcctacaagatctaaataattcttgtcgtaaaaggggcaaatggtctgaggtgcctgacgtccaggcattcttttacacatcagtcccttcctagtctctgtgcccagtgcaactcgtcccaaatcttccttctttccctcctgcctgtcccctcagtcccaaccccaagcattgctgagtctttctaatcttcctttcctacagacccatctgacctctcccctcctcgccaggccaagctaggtcccaattcttcctcagcctccgctcctccaccctataatctttttatcacctcccctcctcacacctggtccagcttacagtttcattctgtgactagccctcccccacctgcccagcaatttactcttaaaaaggtggctggagccacaggcatagtcaaggttaatgctcctttttctttatcccaaatcagaagcatttaggctcttttttatcaaatataaaaacccagcccagttcatggctccttcggcagcaaccctgagatgctttacagccctagaccctaaaaggtcaaaaggccatcttattctcaatatacattttattaccaaatctgctcccgacattaaataaaactccaaaaattagaatctggccctcaaaccccacaacaggacttaattaacctcatcttcaaggtgtacaataataaaaaaaaagttgcaattccttgcctccactgtgagacaaaccccagccacatctccagcacacaagaacttccaaacgcctgaaccgcagcggccaggcgttcctccagaacctcctcccccaggagcttgctgcaagtgccagaaatctgaccaccaggccaaggaatgccttcagcccaggattcctcctaagccgtgtcccatctgtgtaggactccactggaaatcggactgttcaactcacctggcagccactcccagagcccctggaactctggcccaaggctctctgactgactccttcttggcttagcggctgaagactgatgctgcctgatcgcctcggaagccccgtagaccatcacggatgccgagctttaggtaactctcacagcggaaggtaagtccgtccccttcttaatcaatacagaggctacccactccacattaccttcttttcaagggcctgtttcccttgcctccataactgttgtgcattttgacagccaggcttctaaacctcttaaaactccccaactctggtgccaacttagacaatattcttttatgcactcttttttagttatccccacctgcccagttcccttattaggctgagatattttaaccaaattatctgcttccctgactattcctggactatagctgcatctcattgctgcccttcttcccaatccaaagcctcctttgcatcctccttttgtatccccccaccttaacccacaagtataagacacctctactccctccttggcgaccgatcacgcacctcttaccatctcattaaaacctaatcaccctcaccctgctcaaagccaagatcccatcccgcagcacgctttaaaaagattaaagcctgttatcactcgcctgctacagcatggccttttaaagcctatagactgtccttacaattcccccattttacctgtcctaaaaccagacaagccttacaagttagttcaagatctgcgccttatcaacgaaattgtttcgcccatccaccccgtggtgccaaacccatatactctcctatcctcgatacctgcctctacaacccattattctcaaacatgctttctttactattcctttgcacccttaatcccagcctctcttggctttcacttggactgaccctgacacccatcaagctcagcaaattacctaggctgtactgccgcaaagcttcacagacagcccccattacttcagtcaagcccaaatttcttcctcatctgttacctatctcggcataattttcataaaaacacatgtgctttccctgccaatcgtgtccgactgatctctcaaaccccagcaccttctacaaaacaacaactcctttccttcctagcaatggttagcacggtcagaattcttacacaagagccaagaccacaccctgtagcctttctgtccaaacaacttgaccttactgttttagcctagccctcatgtctgcgtgcagcagctgccgctgctttaatacttttagaggccctcaaaatcacaaacgatgctcaactcactctctacagttctcataacttccaaaatctattttcttcctcatacctgacgcatatactttctccttcccagctccttcagctgtactcactctttgttgagtctcccacaattaccgttgttcctggtccagacttcaatccggcctcccacattattcctgataccacacctgacccccatgacggcatctctctgatctacctgacattcacccatttccccaaatttccttatttcctgttcctcaccctgatcacgcttgatttattgatggcagttccaccaggcctaatcgccacacaccagcaaaggcaggctatgctatagtacaagcccctagcctgcctcttagaacctctcatttcctttccatcgtggaaatctatcctcaaggaaataacttctccgtgttccatctgctattctactactcctcagggattattcaggccccctcccttccctacacatcaagctcgaggatttgccccacccaggactggcaaattagctttactcaacatgccctgagtcagataactaaaatacctcttagtctaggtagatactttcactggataggcagaggcctttcctatagggtctgagaaggccactgcagtcatttcttcccttctgtcagacataattcctcagtttagccttcccacctctatacagtctgataacagaccagcctttattagtcaaatcagccaagcagtttttcaggctcttagtattcggtgaaacccttatatcccttacggtcctccgtcttcaagaaaagtagaatggactaaaggtcttttaaaaacacacctcaccaagctcagccaccaacttaaaaaggacggacaatacttttaccactttcccttctcagaattcaggcctgtcctcggaatgctacagggtacagcccatttaagctcctgtatagacgctcctttttattaggcccgagtctcattccagacaccagaccaacttagactgtgcccccaaaaaaacttgtcatccctactatcttctgtctagtcatactcctattcaccgttctcaactactcatacatgccctgctcttgtttacactgccagtttacactgtttctccaagccatcacagctgatatctcctggtgctatccccaaactgccactcttaacacttgaagtaaataaatagtctttgctggcaggactatgctgaatctccttaggcactctctaatcagatatcctgagtcgtcccaattcttagaccttttatacctgtttttctccgtctgttattccattcagtttctcagttcatccaaaaccgtatccaggccatcaccaatcattctatacgacaaatgtttcttctaacatcctcacaatatcaccccttaccacaagacctcctctcagcttaatctctcccactctaggttcccacgccacccctattcccactcgaagcagccctgaaaaacatcgcccattctctctccataccaccccccaaaaattttcgctgccccaagacttcaacactattttgttttattttttcttattaatataagaaggcaggaatgtcaggcctctgagcccaagccaagccatggcatctcctgtgacttgcaggtatacgcccagatggcctgaactaactgaagaatcacaaaagaagtgaaaatgccctgccccaccttaactgatgacattccaccacaaaagaagtgtaaatggccggtccttgccttaagtgatgacattaccttgtgaaagtccttttcctggctcatcctggctcaaaaaacacccccactgagcaccttgcgacccccactcctgctcgccagagaacaaaccccctttgactgtaattttcctttacctacccaaatcctataaaacggccttacccttatctcccttcgctgactctcttttcggacttagcccgcctgcacccaggtgaaataaacagccatgttgctcacacaaagcctgtttggtggtctcttcacacggacaggcatgaaacacactttgtgtgtttggtggaattcttgaaatattacattacatatgtgctaatgaatacattattaaaatctacatttgcccaaatatttaccactaatacatagtagaaagaaaaggagttaccactgtgaattgcctaccttctttgtgaaatgcagttttttgtgtgtgttgagatgtttgactttatctgatatcaaaggaacatgtatatttcttccaatttttactttagattgggggtacatgtgctggtttgttatctgggtatactatgtgatgctgaggtttggggtgtgtattatcccatcaccatggtactaaacatggtacccagtagtttttcagcccttcacccctggccccagaggtccccaggttctgttgtcgctatctttatattcctgagtacccaatgttcagctcccacgtataagtgagaacatgtggtatttggttttctgttgctgttttaatttgcttaggataatggcctccagctggatccatgttgctgcaaaagacatgatttcattcttgtttatggctctgtagtattcaatgatgtatatataccacattttcaacccagcgtgcctttgatgagcacctaccttgattccatgtctttgctactgtgaatggtgctgcattaaacatgcaagtgcatgcgtctttctggtagaatgatttgtttttttgggtatatactcagtaatggagttgctggattaaatggtagttctaagttccttgtgaaatctccaaactgctttccatagtggatgaactaatttacattcttgctagcagtgtataagcattcccttttctctgcaaccttgccagtatctgttatttttgactttttaataatagccgttctgactgatatgaggtggtatctcactgtggtttcaatttgcatttctctgatgattagtgatgtggaggatttttttatgtttcttgaccaattgtatatatcttctttggtgaagtgtctcttcttgtgtctttcattcattttttaatgggattatttgtttttacttgttcaattgtttaagtatcttatggattttggatattagatctttgtcagatgcatagttcgcaaatattttctctcattctataggttgtctgtttattctgttgatagtttcttttgctatgcagaagctctttaattaggtcccaaagggacttattttggtggaagactctaaagatgtgaaaatattgcaaaattaaatttaagtcaagtagtttatttgtttttatttgcagaacaaacacataaatggtgattcaatgtttgaagtccaatgcaatgataaaataatataaagcttcttcaaaataggctgtagttgtaaaggtattcatctttacgtctttgatattagtttattatcaagaagctatacggttaaattagaggtgcatttgtctcctgagacttgcctgttgagtcactctggaatccgtgttctatccaattttcagagtcataaacgttgccgtattagtaattttgaggggggtacaaagcaggtgtaatataatgattgagattaatgatctgaaaaggtaggaattactaaaaaatttcccttgtacaccatgcatgaacaacatattgatttggttttaatgttattctgcgtttaaaattccataccatcttttcaaatgttaaaagaataaaatacaatattaattctaaacacgaaactcactatttcaagtataactaattatattggaactgtgaaagtagtgtattacaatagtgtatttccaaaactatccaggaactattttgttgactcaattagaaattacttttgtagttgaaagaaaaatataaatataaaaatgtattttgaaagacgtttgtccttttataatgtagagccagctgtttccagggttgaagttattagaaagtgaatagatgcttgcttatactagttttcactacccatgggaatcatttaatgtggtttcttttcttttcttttctcctccttttcttttcttttctcctccctcccctcctcctcctcctccttcttcttcttcctcttcttcttcttcttttaaatagggtctcactctgtcatccagactgtaatgcaacttttagtagttccctacttgctgaggttttacctcagtcttggcctttgatgagtgaccaaaatctttgcttagggcactgagagaaggaatagttttattcccatgaggttggccatttaaattcatactatatttggcttagattgattctcagttattgtcataataagtttcttgtttatatgatgcacagcgaaatgaaaatggtcagttgttactgtggaatcagatagctactgaaaattcaggcatgccaataggttcctttcttggaccttctctttttctcaattgataaatctcagagtgtcttttcagtgcctccacattttcagctcgaacacaaataagtttccagtataatgtcctattgcgcttcatcccaacttgcttcctcttcttcttataattatgctttctcctatctccatgattattgatgacatctcactctcctggattattttcttaactgttctaaccaaatcttgtaagactgagatcaattttcacctctttcctaaagccatgcatgtccttccccaaacttcagcctgaaatagtatttccagtttatgaatagtacttctagcatttattcaggagtgaattatgtctatatcttatattatttaaaatatcttaaaaacttttacacctacttacacttctagtttaacacttatctaactttattagagggtgcagcttgaaggcatacttactgttatgggctgaatcgtgttacccaaaactcatattgaggtcctaactcctagtatctccgaatgtgactgtatttgaagataagcgttgtcaagaggtaattaagttaaaacagtgtcgttacattgggccttaaccaatatgactagtgtctttatgagaaggggaaattagaaggtagacacacgcagagaaaagaccatgtgaagacacgggagaagaccgccatgcactacccaaggaaagagacctcagaagataccaaccttgatgatcttgaacttctagatcacactctgcagcaagaagatttgaaattcatgagctttgcaacatcttcacatcaggacaaataacccccctgctgttgaaatcacttgcataatttataacgttcaaaattggaattgcatcattgcctcctttgcaattaccctgtagtcaagcctttcaccttactgaaaggtctttaatttttcttgatttttaagcatttctcaatttctaatgggctcatttgaatggcttgggatgctacaaaaatctattcttatctatataatagtttagaagtataactatatccagattatgttcaaagtcaaactgttgcaaatgttacttatgtactgatttgtgtttaaaaatcagataataacattccaaaaaaaatgttatcaatacctaataggaaattcctctttaacctaagtttgttgttctctttgctatgctttcatagtgccttgtatatatttctagcctgacaataattgtattattaaaattatctatttgtgaatgtctttataattggaccatagctcctcaaaggatcacatacatcttaattaactgcttatccctaatgggtagcatattatctggaatgtactatttactcaatgaatgtttgttgattcatttagcaaactttcttataataaaacaaatagatatttttcatcttgtaaaaaaatagcagtgtagatgttatttcagaatctaattagatctaccttagcaattttcacttaaatataacacccctgaaagacaaacatgtgacatcttaaagctaatattgagtagcagctcattcaagatttcctttactctgactaaattgttacttcttttatcaagacactattccatcctttggagcattgtagaataagcgtaaattattctccacatgagagtccttcaaatatttgaagacagccataattcctcctttatctcagctttacacaaaatgtcctcagtgtttttcctattataaaatgatttccagactcctcatatttttatctgcattcctccttcagtaattcattttaatgtaatatttaggtatttgattaaagtaataaatagagaaaaaattagaaatcggaagaaagcatctagaaattttcagtggtttctccaatttttccatttaaaaatatgtatgaattaaaatgtaaagtcctctctgctgccttccagtctcacaaggtaacctcagtcagtagtttgagtttaattcttctatgatgtcatctttgcttattcaaacatgctcaaacacacacacacacacacactcaagcacacagatgtctcttttggagttttgttctatttttttaaaaatggaatcttgttatagtattgctattccatttttccccatgaaaaatcatcggttgctgttattgtcctttggttacactttatcagtggatcttttaaaatgttacctccaggactaaatataaattcagatacaattaacttttattaagaatttactagatgccagacactgcatttgcacttaagatgttatatcatttgaattctcaaaagaatatataaggtaattagtattcctatttcacatgtaacaaaatatgtttagagaaagcagttaaattgctcaagatcactcatacatagccatttaccaaagctatgtatctatttattcatttattcctcaatttgattcagaaagcatttcagaccattttccaggcttaaatgcttaagtgcaactgcatagcttaaatgtgaaaaaaaataggtaaaaagcaggaaagaatatttatgactgagaatgtaaaatgaagttagtaatgagactagcaaaaaaataaataataataattgtgcacttgctatagatgaccacagagtatggatattcttagcaatgcgacaatggtcagttattaattcgtaaagccaagaagagaaaaaatgtaaattatttttaaaaataagaatgcagctagacctggtactaagaataaagaatttctgttaaatatccttagagaaaggactagaggaatatgtagaaaatgtatttttataaaatatgtaattataaatttcagttggcttttatttacaatgtttcttgctatagccaatgccctcacaccaaagtctagaccagtaaaggcaattttctaggaaatcaagaattttatgttctcgatacccggagctttgtttgtttgtttaacttataaatggtagaaatggtagagtttagaacatctggagtaataaatgattataagtcttttcagtaatccttcatagatatataaaatatatgaatatatattatatatgaataatcatatataaatatatatatgctgtgtatatataatatataatgtaatgtatattcgtatatatgtacctttaaagataaaaatatcaaaaagtatatgagaaaggaatagagtaagtcaagatgctttagattggtggatcacagaagggag

SEQ ID NO: 1597 - DNA, 11888 bp, Homo sapiens
aaaagagtattaaccaatgtttatgtttcaagttatatgataattagaaactgacgcaaaagtcaaatgcaaataatttgttgataatttagtggcaattcactatttgctatgatcatttcaaacacattagaaacacattgccatattttatattctttagacctcctatctttaaaataaaagtgtgtgtgtgtgtgtaattttatatatgtgtgattttttttttcaggctaaaatgaaacaataacttgtctggctgattagatttccttggaggtgaactttcacaaatagccaaaaatgtttgcaagtaaagagtataactgggcttttaaataactcctctaaaatcaaaatgaagaacaaaagcttccttcctttcagaaagtaatctgcaaccactctcatgcatttgtgtgctttttaaaaaaaatattgaggatggaagggaagcatggtacatatacaaatggtagtaaggctcctattaaaacaaaaaaattttaccctcaccactaaaaaaagaaatcaacattaccaaggttgatcttgagtatctctcctcttctctccaccagaggtaaagactatattgaatttggtatttttaaaattcctgtgtgttcattgatatatacttaagtaatatatggtatattttgcccttcaacttctgtttacacgtatcacactatatatatgtttctgcaattttttttctgtttgctaaatatattggtgagatccattcagtttccatctagttcattcaatattgatggaatagtgtattccattatacatgcaccccacaattcatttgttctgctcatagttacctcattggcatgactttttatttattgagaaatgcaataatcaaatcaataaactgcaatgtaaatgatccatattaattactgaacccttctggtttgtgggtatgtaagtttttccctctgtttcatctctgtgtgttagagttgtttcaaatctgggaggtgatcaaaatcacctggagatcttcttaaaaataatttcaaataatctgactctaccctagaccttctgaatcagtttcccagactatggtcgaggaaattgtataaaaataaaataaagcaaaaatgtacaactagaatgaggcatggtggctcacgcctgtaatcccagcactttggaaagctggggccagaggatcacctgggcccaggagttcaagcctgcagtgtgttataatagtgccactgcactccagcctgggcaatagagcaagactctgtctcgaattttgaaaaagcacagataatccttatatgtagatatacttgaaactactctattaaggttacatttcttttaacttttaaaatgaaatgtagaaacagaaaagcacacatatcataagtgtgcaattcaattaagaagataaatttttcacattatatacttccaaaggccaactgaaaattatttttcccagcttctaattttaacaaagccttagaaaagaaaaagagaaatagcttgagacatgagaaaaataaaattaaacttgacaaagagatagtaaataattatcaacttgtccagtttttgtataacttaatttatataaataaaaatatcttcatacttttaaaggcatagaattacacaattttaatgacttgagcccaaaagacagtaacaaaacagaagaattggcaactccatagagactgcatttcataactggaattcgtcacctatggaagcagacaacagaggataattaaatgaatgatcacataaaatgaactgaagtcactgaacacttaaacagctatcgcatgttaatcataatttgtatcagctctcattctttgatcttgggatgactttcttctgcataataatgaggttatattacttgtgttgacatcatttaaagaagtgaatacagtagactgcaactggatttgaatctagatttttttcttcaacacagtcatctagctttaagaaatcatttaaaaggttgaatgtgaaacagctctgaccattgtaagagtaaacataaaatgtacaaagaattattttaatggtttgattatctgtactttagagatagttattatatcccatctttgatttgtgcatgttcacttaactccctttaaatgtctcgaccacagctcatgttactttactatcatttttgggtaatatttttacttctctggagttttaaccattttaatgacaaaaagttcacatatgtatgaaagcaattaaatatattagatttgtaagaacttacaaatatgcagtacttacatattacaaataatgcagtaatttgttatgacattttgagagaaatacactgtcatcatgcttaatttgataaggaaagtgaaagttgtcttatatcatcacaattaaataatgttgcttaaagttgtaaatatgtgacattggaaaagtaactgatgaaaggtataaatgattacataaatatgcatgtattttataaacaataaaaactaattttatgcacaaatcatcttttgtactctaaacttaattctcccaccaaacatctgtccaatatccagagctatgagtttttgtggagttcccaatgataaaataatgtctaaggcaacaaaaaagttgtttcttcaaagatgtggagtttggaataatttctaaactgctttttttccttaagctgctaaaagcaagaaatattttcttggttataaaaagatgactcacagtacgttatcatggaaaaatactagagtagaaattgaacacaaatgggaataaattcacacagacaaaatgtgctctcttcaggtctccctttcatgttctagtaatctgaagttatctctggatcaataaatacatgctggatcaactctgccttttgttttttttttgtattttaattttttagattgatatgggtcagtattcgagacatcttattccatctggttccatttaggagtaaaaatattgtttgaacagaaaaatcccctagagatttttttagtgtattctgtagacttgaacgtggttgaatgaggagcagaattggacagtataaagctataaccattttgttgtaatgcaggattactcaggcagaggagtataaatatacagtaccaaaggtatatgttcacagcccacactggactgttgcaagctatatatctctttgaaattatattacatattgcacataaaaatttcatatatgaactcgtatttctggctcattccacatgtcaccagaagaactctgctcattatagatgctcagacttctaaaggaagagagtagtcgccatcttgtgatattaccatcctactatgaggctttagggtttgcagaggcagaagaaaaaaatggagaattgaactaaactggtactggtaactaaaagtatttcctgaaaaatgccacatacaacttctacccagattttagggaccaggattagtcatatgcccatacttttactcttacactcaaaggaacagagaaaagtaattctccagatacctgaaaggagaggaaaaccaaatattgtgacttggtaagtcctaccataacttttgaacagatatgtttacttaactatctttttatggcaggcagaaattttggggttatgatattaattaacgttggatttttttcatttacagacaagaatctgcttttccatacataaagaagctaaggtctaaccctatagtaacattcagtaaatttttgatatctgttatgttttcatttatcggtgttagtgatatgtgtatgtgtatactgagagggagggtcattggtataggatagcacatatataaaaataaaaagttttagtcaagttttatatcagagtttttattatagcatatttgtgaataaattttgagatgattcagaacatgcgataagacatccttaccctattcctccatttcatcacatcagtttcaagcaacagttactgtcagagactgaatgaagcagaatgatactgtcaatagggtttgttggatcaagtacaggctttgaattatataaatatcttggatcacacacatttttgtcttattggccttttggctaataatttaaaaaaaaatcctaaaactaaacttccaagttggtaacacagggtaagagaacctcttttgagagttgttctgttgttctgagaattagagcttttctttagaaaatacagaatacagtggatagcatggaatgttttaaaacaaaagtacagccatcccttggtatccatggtggactgatatcaagaaacccctgcaaatagcaaactctatggatgctcaagtcccttatataaaatggcatagtatttgcacatagcctagttacatcctcctgtgtattttaaattgtctctagattatttataatacctaatacaatgtaaatactggataataagttttccatggtattatgtggggaataatgacaagaaaaaaatgcctgtacatattcagtacagatgcaatttcttttttcctttttaaaatttttttaatttaatttttttttttggatggagtcttgctctgttgcccaggctggagtacagtggtgggatcttggctcactgcaacctctgcctcctgggttcaagtgattctcttgcctcagcctcccgagtagctgggactacaggtgtgtgccactacaactggctaatttttgtacttttagtagagaaagggtttcgtcatgttggccgactggcctcaaactcctgacttcaggtgatctgcccgcctcggcctcccaaagtgctgggattacaggcatgagccactaatttggctgtgtgatttcttttttgagtattttctattcatggtttgtggaaaccacggacatggagtacaaggatatggagggtaaactgtattgttaatgtttttatgatgccaatatgtaatcctcttttatttattgctattttgttggttagttgtataatttagctaaaaaaatcatttatgacatgggactatctagaggagacctttataatatgaagttcacaatgaccagtcaactaatgcctgtgatagtctacgctgaagagtattaccactacacacaaggcaattacaaatcaagttgctcctgtacttgggttataatttaaagttgccaaagagatcaagttatttctgacacaagtaaagtttcagggtgtcttaaagatgccctttggtaaaatattttgtattgtcccctctctacccctttcatcagctaaattaactccctacttccagtattcaaatttcaaagattaaaacaagcatattggtgtctcggatcacctatagaaaacatgaatttttctcaggatgggacgcggtactaaagataatgcaaataattgaagtgattatcaccaagttcataactacgtctaggaaactaatcagtggctagatacataatacaaataaccacgttttgcctttcatatgaaagttttattaaagagtaagctaccaaggagctatccctgcttccagtacaaataaattaataaatattataaagtacatatgaatgaccagtattataatatgcgataggaagagttatggaatgtggaaggaaaacataccaatttggggctcttcagtgtaaatataccacttatctgctgtgaatactttccgaaattgcgtttcagttatcagcttgaagtcattatggacttactctccttctaaaccgtgaaattgctccaaaagtctgtgttaaatgttattaattttaagaataaattttacaatgcatttttgcttatgaaatataattgaatcataaactgtatttgtacaaaatgcagataaacaataatttttcacaatctggtagttgaattataacactaagtcatcttgaattagaactgtccagaatagtttcttaatcatatctaaatggcaaggggaaaatatttttgtcaaatacatgaatttacttgtactaaatgctttgggaaacttaatttaaaactttattttatgaaacgcgattcctgggttggttaacttcactcagtaaccaggaatttgtcagattttgaaagtataatgactctattttgcatattcttcaaatactttcatttgaaatattttattcatttgaaatattttgtttaatttgttatctcaataacaattgcttataccatcagcacactgggcattgctatttcaatcaaaattcatgcccacatttactacagaagagagattcatacagagttatgtataactagtaaacatttggtatcttttaataatgattcttagacttatagagctgaaaataaatttagaggtctactaattcaagtgctctatttgcagaaagggaaaataatttccagagacagtaactgcctgctgaaggtcagggaacacaattgaagagcttgaattaaaactacattttttgaggtcaaggagggcagatcacctgtggtcaggagttccagaccagcctgaccaacatggagaaacctcgtctctactaaaaatacaaaatgagctgggtgaggtgttgcatgccagtagtctagctacttgggaggctgaggcaggagaattgcttgaacctgggaggcagaggttgcagtgagccgagatggcgccattgatctccagtctgggcaacaagagagaaacttggtctcaaaaaaaaaaaaaacaaaaacaaaaaacaaaaaaacaccacagtttttttttattgctggtttggatatttttctagcaaacttcatagtttattttgttagaagtgggaattatatggttagaaaccatcaatatcaccactatattctcaaggaaattatgagtgtttattcaaatatcagttttgataatatcaatcaaaaaaagaaagaacaagatagggtttcaattccatcttgctattaacatcttctcctacctagaaagagaactgaggtatccaggttgctctatctacaataaagtgtatataagagacataggacaacggggaggggagagaggccatggctaacatcattagttctctgctttctttgtgctaggtaatggcatgcagttagttgcttcttagtgaagctttgcttgaggaagcaaaaatcagttttggggagaacatagatggaaatatgaaggaaaatttgtccttattaatctttaaatagtaaggggaagtcttggtgaagtgaaccatatgaatctctttgacaaggtctcagtgtcgtttttgtttttatccaacacattggctttgtctggaagttcacaccgatcttttaaaggcaacacagtgaaaactgaaagaaacagtgtgtgtaaaaactctttttcaatagaagttagagaaaaataattttcctaaaatgtcttttcgctagtatccattgttgaacaaatattagggaacatttaactttaagttgaaagtaatacaatggagaatgaatgccagtgatgtaattgtctgataaaatctgcagcacctgaagagttgaaattaatttatactaaatcattatctttttatggcaggcagatgttggggttatggtattaatgaactttgggttcttttcatttacagatcaggatcttctttttaataaaaggagaagctaaggtctaacccttctggcagcaaactggctctctaattatcttagtaatagctctaaattattattcaatgtaggactacatcccactgttaatgggtcatgatatcccttgggattcatactttttttccatttcagtaaatgacttgccatctgcagaaaattcaagttcattgtctaacttctaaaaataatattgatatggtcaggaagatattgatgtatttgaaagggtttgaaagtgaactggaaggcagagcagccgattcttgtggtaagatttttttctccctgtagtcctggaaaaaaataatcgacatcagtaatttaataccacaatgcctaatgtttttctttctgatttgactttcactgtggtctatacaatgtttctactggatgaattttgttttcttataacataaaattgcataaaagtgcctcagtaagaaggtaccaaattctacaagaaggtgcagtgaactatactttaatgttacctctgacagttaacaggttttaatttccagcattatctactcttccaagccttagtttactcatctttaaatagaagtaaaaatattttgtcttcttgaagcatctcttgttgtctttaagaagttactcattttgacctggtaattataattttctgagactgccttagggaaacaatttatgattttaacaaagagatatagatatgcaaataggagaaaaaaattagactaacaaaaaatgagaaaatctaaatttctataaatatggaaatataatgatgcatgatactactgcaaaatgaaatactataaaacaataattatattctaaaatattttataatatggaaactgcaaaatagagaataatatgtttaaaaacataaaagtttaatagtaatatatttttgatagcattgcaacaaattcaattatcttaaaatacactgcataaacatatacatgcatatatctgtaactatataagcattttaacaattaacatacaaatcctttgttctgaaaaaatataattaaaagcagtaataatgactttctatttcaaaatatgatgggatacctgtgacagaccaatgtacctaccaggaatacctagaaaagcaataataatgtaaaaatattttttatattgcatacactagaaaaggagaaatcaaagaataacatagcttggaatcaaacagtatgttaaacatgaaaaattgttaggaaggaaattataaacaatagcagaaatcaacaactaaaaaatacaaaacaaatgaacaataagggaaagtatcaatcaatccaagatttggttcttgaaaaatgatagtcgggccaggtgcggtggctcatgcctgtaatcccagcactttgcgaggcctgggcaggcggatcacctgaagtcatgggtttgagaccatcctggccaacataatgacaccccgattctactaaaaatacaaaaattagccgggcatgatggcgcatgcctttaatcccagctactcgggaggctgaggcaggagaatcacttgaacccgggaggctgaagttgcagtgagccaagatcacacaactgcactccagcctgggcgacagagcgagactccatctcacacacacacacaaacaaaaaaaaaaaaaaaaaaaaagaaaaagaaaaatgacagtaaagttcataaaccactactagattcattaagaaaaaattagagggtgtagaaaaaacaatattaagaatgaaaaccatagattctacagatattaaacagatttgttattttaaaactttaggcaatgaatttgaaaatttagatgaaatgaacaaaacccttgaaaaacacaacttatccaaactgacacaaaagagttagaacatttattagttttatatctattaaaaattaagtctctaaatttaaaacaatattaacaataaaaacttttcaggaagcatcatccatttatttagagcaaacatctaagtaataaataacagcaaatcttacacaaattcttccagggaaaattaaaaaataagttaatacttcccaccccaattcattttatgagaccagccttgttaacaccaaacccaataaaactttattaaaataaagtataaatttctgaaaattttctctcactaacataacattaacaaattgaacattagcaaatgaaatccagtaatgtttgggaaaataatacattatgattaattatattttctggtttaacatttgacattcaatgtaattcaccagattgccttaaaaaaggagaaaaataattttctctgataaatgataaatagaaaaacttattaaaaattcaatacccaatcaggaggagaaagaaacttccctaatttgataaacagtctagaaaaacatagtaaacagcacacttaaaggtgtctctaaagtaaccactgtccctaaaaaaattaattattccaatgtaatttaataaattaagattaaatatataaagatcaggtataaactcaataaacaaaaatcagttttacatatatatcttaaaataaatagaaaataaatgtttttaaaaaatagcttttaaaataatatcaaaaacaaagggctgattcttataaatgatgtgtcatatttttatctcaaaagcaacagaaattagtgatagaaattaaagaagaccagagtaaataaaaaaaatgtatactatgttcttaggttgaaagattcaatattatgaaggcatcaatttttctaaaattgatctatagattaaacataatcaaaggctcagtaatttcatgaaagaaattagtaagatcataaaatggaaatggaaatgcaagtatccaagataatattgacgaaaaagatgaaaagaaacaaagttaaaagacttttactattaaacatgatgatttattacaaacctagataaataaggcaataagggactggaacaaagagaagtggccaaaggaatagaacagcaagtccagaaacagccacacatctccactcagttgaactgtgacaaaggggacattgcagtgcaatggaaaaggacgctcttctttaataaaagatgctgagtcaattggataattatgtaaaataaaaagaaatcttggtcgggcgcagtggctcacgcctgtaatcccagcactttggaagggcggatcacaaggtcaagagttcgagaccagcctgaccaacatggtgaaactctgtctctactaaaaatacaaaaattagccagttgtggtggtgcgcacctgtaatcccagctaatcaggaggctgaggcaggagaattgcttgaaccgggaggtggatgttgcagtgagccgagattgcaccactgcactccagcctgggtgacagagcaagactctgtctaaaaaaaaaaaaaaaaaaaaaaaaaaattaactccagtttgattgttattctacatgtgataagtaaaacaaaactttaaaaaaatcataaaattttaactgccttagaagaaggcaaagttttcttgaactgaactgaaaaagtactaactgaaggggggaaaatgtgataaataggattacagtaaaagtaaggatgttttcttattcaaagacatcaagagagtaaaaaagtatacccacagatgatatgcatatctgacaaagagatatgcatatctgatacagaattcttaaaatgcaataataataaaagtcaatacagtaaaaataattattagtattatgagcaaaggcttcaaagtcacatcaaaatggaaagtgtcaaaatgcctgataaacacctgaataattgcagacttcattggttaccagagaaattcatggaatactatgaagccataaaaaagaatgagttcgggctgggcacggtggctcacacctgtaatcccagcactttgggaggccgaggtgggtggatcacgaggtcaggagtttgagaccagcttggccaacatggtgaaatcctgtctctactaaaaatacaaaaattagctgggcgtagaggcacgtgcctgtaatcccaactactcaggaggctgaggcaggagaatcgcttgaacccaggaggcagaggttgcagtgagccgagatcgtgccattgcattccagcctgggcgacagggc

SEQ ID NO: 1598 - DNA, 1048 bp, Homo sapiens
ctactgagcaccttgtgacccccacacctgcccgccagagaacaacccccctttgactgtaattttcctttacctacccaaatcctataaaatggccccaccccatctccctttgctgactctctttttggatttagccagcctgcacccaggtgattgaaagccttattgctcacacaaagcctgtttggtggtctcttcacatcgacgctcatgaaatttggtgccaaaaccggggattgggggacctcccttaggagatcaatcccttatccttcctcctgctctttgctccatgagaaagatccacctatgacctctggtcctcagacccaccagcccaaggaacatctcaccaatttcaaatccgatcttctcggcttagcagctgaagactgacactggccgattgcctccgaaacctacaggaccatcacagatgctctgggtaactctcacagtggaagacaggaatgtcaggcctctgagcccaagctaagccatcatatcccctgtgacctgcacgtacacatccagatggccggttcctgccttaactgatgacattccaccacaaaagaagtgaaaatggcctgttcctgccttaactgatgactttgtcttgtgaaattccttctcctggatcatcctggctcaaaagctcccctactgagcaccttgtgacccccacacctgcccgccagagaacaacccccctttgactgtaattttcctttacctacccaaatcctataaaatggccccacccctttctcccttcactgactctctttttggattcagccaccctgcacccagtcctgaggaagattgacatttgccacacctgcataaagaacccacttggtgaaaacccaagttttcttggagtctgctgctgtgagacacgaggaaaaaacagtacatgtgtacacggtagatctggaagggaaagcagaaagtatccaacacttcttgcatgaagaaaacaaaatgtaagtttttcagtttatgaccatgtgtttacttactgcttcctaatttcaac

SEQ ID NO: 1599 - DNA, 724 bp, Homo sapiens
aacccgtctcagcacgttagcctcccctgcacaagctaaagcagcagcctcagggcgaatatccacactgtgcgccttccctaaaggttggggcctgcggatgcccggaaaggcagccccccaggcccgagcgcatggcgatcccgtttcaactgcggagcgtctcgcgagagctcggagcgccgaactccgcccccaacaatgcgcaagccgggtgattgacgcgggcggagcggcctggcgagggcgatgccaacggttcaccggcaccggtcctgtcccgtcgcctccgcgccgtggccgagtggagaccgctgcctccaacccttccccaagtaaagcctaggaccctcccccaactcgtgtggatgaccgaaaataaagcttcgggtcctggttacagtgtaccgaactcggactgcgccacggctttttactccatgtttcccgtgctctacactgggaaggaaagcagccgaagtttcgtaatgtcttagagaggaaaaacgccctttagccactgctttcgcaccaccgtcctatctccccacaatccgggccctacccatcatggaagcttctggaagggcacaggagtgctgtaccctaagaaaacgtccattaatttagagtttttgcctccgtgccatccactatcatctcccctggcgccctatgaccttcactacagaccgcgaccgccaacagactgcatacctgttat

SEQ ID NO: 1600 - DNA, 3711 bp, Homo sapiens
gtcggccctccgaacccggaagtgaagcgataagacgcacggtgttctgggaggagttacgcaggcagggttgtggttgctggctgttaccaggacaaccggaggcgattgaccgttatctgcggtttggagccgttagcgggagaggcagagatattcagaggtcttttaggatgcgctaaagggtcgtgagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaattgaattgaaaagacaggatgaagtggacacagcatgtgaagacaattctttcaagaagtttggctgtcaaggaaaacagagaatgtgctaaagaacatacagacacagagcagacaggccacctttgcaaccacatggaggtttgtctgatattgaagctaaagaagctaagctggaagacagagagaccaagtcctgatgacattgtttgaacccagagatccagacatgcctgaaaactagttttaccactggacttatccgttgaatgagccaataaactctcttttatacttaaccttgggttttacctggatttttgtcattgacagctcaaaatattctaatatagaagtatacatcattaaatcaacatttctttttttctctgtcttattttaaatgtaactctataaggtactctaaaagtattctacagtctcactaagttaatctgcaaatttggtaaaattccaatattaatcccaaaagtattttaagagcttgtttttgttgtttgcttgtttgggactaaacagaattactccaaaattcattgagagaaaaaaaaacatgaaaaaaaaaacaagaaaatagaattcataaaaggaaattgtattatataacaaagcataaaacaagaataataaacatagagtggtaatggaataaataaacagtcatggaacagaattcaaagcctgaatatatctaagagcacttaccaaatttaatatgtggtacatcaagaaaagattaatccagtaaagtatataagtacattgagctagatttagaggagaaagataattagatcgttaccttattcccagaataaatttcaaatggatttgtgacttaagtgtaaaaattgaagccagattctcaatatacattgattggcatataattggcacagtctttagcaatatcaattaaatgttaaatattaataacaacacagcctttcaattctagaaatatatcctacagaaacaaaatatatgtataaatatagataatgcagtattggaatatcaaaagtagtacacatatgaaataggatatggaatacctatatcatgaattcacggggtggcaacatcgcaacaaggaggtgaaaattgattcttgagggaaatttttttttctaaagcatagatatgtgtgtaaagcacataaacaaatatacagtatatatgtggtattgaaacttcatgggagagtaataattaagaaaaaaatgtctacactgggtgcagtggctcatgcctgttatcccaacacttcgaaaggccaaggtgggtggatcatgaggtcaggagttcaagaccagcctggccaagatggtgaacccgcaactgtactaaaaatacaaaaattagccgggcatggtggcaggcgcttgtaatcccagctactcaggaggctgaggcaggagaatcgcttgaacctgggaggtagaggttgcagtgatccaaaatcacgcaactgcactccagcctgggtgacaaagtaagactccatctcaaaaaagaaaaaagaaaaaagtctaaaaggctgagaaaaactgtggtatacaattcaataccatgttaaaaagaatgaggtagacttgtatgttgacaaaagaggatgtcccaagatgcattgcttttaaaaaacaagttgtaaaataatatgcataatatggttccttttttaatgattaatatatgttgatacaaatgaaaaagtattgatggtgtttttctctggggttaaaattaatgtttaattctatattaagtagaggggtccagccagaggagggtcggaacaggggccccttacttggtgtaagtactacaatataattcccacagtctgagttttgcagatcaaatccccaaggtgtcattaaataagagttttttattccctctatttcctataaattgatgtttagatctaggagcctgatcagattcaggttcaaaattgttggtagtatttcataagtgactttgtgtgcacccatcaggaggcacataaaatctatcactttttaattgagttataattaaaatacacagatcgtaactgctcaattagttttcacaattgcgtgcagccatgtagcttcctccaaaaacaagatacagaatatttccttcactccagaaagttctctcatgggtctttatagtcagttcctgtccaggcccagagccaactattttctcatttccgtcaccatagatagtgttttagttcatttatgccactatcacaaaataccctacactgggtaatttataaataatagaaatttatttattacagttccagaggctgggaagtccaagatcaaagcaccagcagattcagtgtctggaacagggaaaaagctaaacctatggatgtgaaactaaacattatcaagaactatgtgccaggagaagacagctaacatcaaaggttgcttggaactgactgaatgcacattgcaaatctcaagaagctcaaagctgttgactgactagagtgggcacacgcctttaaccctcactttgttcttaccatcctcagaatcccacgcaggaaaaggcccatctgtcaatgagcaatattgtagaaccagccaggagccacaactcctctttaagggactcaagcacctcactcatgtcttcttcctcaaagtccacctgcctggctagccttcaagccatcgacctgtggagggtggaggaaaccacccccactaactccaaccctgcatccaacagctttccctgcttatgccacacctcaacttccttcccttgctctttctttcttaccctgcactcctcctacccttggccacttcaccaattacccactggtacttcaacaagcccatctgggtcctctccttccccagcctgatggaggctgcatagttatcctggaaacagcacaggctttggataaaaacaatacgtttgacttttggctctgctttgatgatctttatgagcttgggcatgttatatagcccctctaagtctgtgtcttcatctgttaaatagagataataagatttaccttgcaggaatgaaatgatgtattttgcagcaacttggatggagctggaggtcattattctaagtgaagtaactcaggaatggaaaaccaaatatcataggttctcataagtgggagctaggctgtgaggacgcaaaggcataagaaaattcgtgggaagactttggggacttgtggggagaaggttgggaggggtgagagataaaagactatacattgggtatggtgtacactgctcaagtgatgggtacactaaaatctcag

SEQ ID NO: 1601 - DNA, 3711 bp, Homo sapiens; identical to SEQ ID NO: 1600

SEQ ID NO: 1602 - DNA, 3711 bp, Homo sapiens; identical to SEQ ID NO: 1600

SEQ ID NO: 1603 - DNA, 3711 bp, Homo sapiens; identical to SEQ ID NO: 1600

SEQ ID NO: 1604 - DNA, 3711 bp, Homo sapiens; identical to SEQ ID NO: 1600

SEQ ID NO: 1605 - DNA, 3711 bp, Homo sapiens; identical to SEQ ID NO: 1600

SEQ ID NO: 1606 - DNA, 1525 bp, Homo sapiens
gtcaagttgcctatgactaacgcacaaggatcaagaatgctgacttagaacacaatttcaagttacataaaaaacattctggatggtgaagagcaggcacaagaggcaaactttaattgatccttaaaaataaccactgcttcatgaggccagcatcatcctgataccaaaacctggcagagacacaacaataacaaaaagtttcaggccaatatccctgatgaacatcgatgtgaaaatcctcaataaaatactggcaaacctaatccagcagcacatcaaaaagcttatccaccatgatcaaatcagcttcatccctgggatgcaaggctggttcaacatatgcaaatcaataaatgtaatccatcacataaacagaaccaatgacaaaaaccacatgattatctcaatagatgcagaaaaggccttcgataaaattcaacacccattcatgctaaaaactctcaataaacgaggtattgatggaacgtatctcaaaataataagagctatttatgacaaacccacagccaatatcatactgaatgggcaaaagctggaagccttccagcacaagacaagaatgccttctctcaccactcctattcaacacagtattggaagttctggccagggcaatcaggcaacagaaagaaataaaggtattcaaataggaagagaggaagtcaaattgtctctgtttgcagatgacatgattgtatatttacaaaaccccattgtctcagcccaaaatctccttaagctgataaacaacttcagcaaagtctcaggatgcaaaatcaatgtgcaaaaattacatgcattcctatataccaataatagacaaacagagaggaaaatcatgagtgaactcctattcacaattgctacaaagagaagaaaatacctaggaatacaacttacgagggatgtgaagtacctcttcaaggagagctataaaccactgctcaaggaaataagagaggacacaaagaaatggaaaaacattccatgctcatggataggaagaatcaatattgtgaaaatggccatactgcccaaagtaacttaaagattcaatgatattcccatcaagctaccactgactttcttcacagaattagaaaaactactttcaatttcatatagaaccaaaaaagagcccgtatagccaagacaatcctaagcaaaaagaacaaagctggaggcattatgctacctgacttcaaactatactacaaggctgcagtaacaaaacagcatggtaacagatatatagaccaatggaacagaacagaggcctcagaaataatgccacacatctacaacaatctgatctttgacaaacctgacaaaaacaagcaatggggaaaggattccctatttaataaatggtgttgggaaaactggatagccatatgcagaaaactgaaactggacgccttccttacattttatacagaaattaactcaaggtgaattaaagacttaaatgtaagacctaacaccacaaaaaccctagaag

SEQ ID NO: 1607 - DNA, 770 bp, Homo sapiens
gtgaaatgatacagtgggagcggggcagtttatgctaaaacaatcacacagaattctagatgagaaggaacatgaataggcttgaccaatttcgtgatcactgagcacagtaaagatcaaatttccaggtggaggtggtagacagggggcgtcaaggggagaaatgtggacctctggaagacgaagtcataagcagagctctgcccgcggaggccagagagcagcttctctggctgcggagttggagcctcggaggaattccacggcagggatagatcacagcatacggaacgggactggttccatccaaagagtgaaccacaatgcttttggaaagcagtatggaaaaatgggaggagcccagattatggctccagataaactaggttcggattcaggtcccatggctcactgagtgacttggggattttaatgccaactttgtagatgagttgtgggggttaaatgagttaacagtaacaagcaccgagcacagtgcctggtacacagtagttattcagcacgtgttagtgctgtctcccacactgtaccatgtcctctcatttcctggtgaagtgacattaggtaggactgtttgggtgcctgtgcagggcagagccaactcacgcttagggagaactcataccgcctaaatataaaggcaattatatatatatatatatatgtgtgtgtgtgtgtgtgtgtgtgtgtttatatatatatatttatatatttcaatatataaaggcattttttataaataaaataca

SEQ ID NO: 1608 - DNA, 770 bp, Homo sapiens; identical to SEQ ID NO: 1607

SEQ ID NO: 1609 - DNA, 770 bp, Homo sapiens; identical to SEQ ID NO: 1607

SEQ ID NO: 1610 - DNA, 770 bp, Homo sapiens; identical to SEQ ID NO: 1607

SEQ ID NO: 1611 - DNA, 770 bp, Homo sapiens; identical to SEQ ID NO: 1607

SEQ ID NO: 1612 - DNA, 770 bp, Homo sapiens; identical to SEQ ID NO: 1607

SEQ ID NO: 1613 - DNA, 10002 bp, Homo sapiens
caaaaagcacccccactgagcaccttgcgaccccccgctcctacccgccagagaacaaaccccctttgactgtaattttcctttacctaaccaaatcctataaaacggccccacccttatctcccttcgctgactctcttttcggactcagcccgcctgcacccaggtgaaataaacagcctcgttgctcacacaaagcctgtttggtggtctcttcacacggacgcgcatgaaatttggtgccgtgactcggatcgggggacctcccttgggagatcaatcccctgtcctcctgctctttgctccgtgagaaagatccacctacgacctcaggtcctcagaccaaccagcccaagaaacatctcaccaatttcaaatccggtaagcggcctctttttactctgttctccaacctccctcactatccctcaacctctttctcctttcaatcttggcgccacacttcaatctctcccttctcttaatttcaattcctttcattctctggtagagacaaaagagacatgttttatccgtgaacccaaaactccggcgccggtcacggactgggaaggcagtcttcccttggtgtttaatcattgcagggacgcctctctgatttcacgtttcagaccacgcagggatgcctgccttggtccttcacccttagcggcaagtcccgctttcctggggcaggggcaagtacccctcaaccccttctccttcacccttagcggcaagtcccgcttttctggggcaggggcaagtacccctcaaccccttctccttcacccttagcagcaagtcccgctttcctagggggcaagaaccccccaatcgcttattttcacgccccaacctcttatctctgtgccccaatcccttatttccacgccccaatctcttatctctgcgccccaatcccttatttccgcgccccaaccctttctctgcttttctggaggggaagaaacccccaccccttctccgtgtctctactcttttctctgggcttgcctccttcactatgggcaagcttccaccttccattcctttcttctcccttagcatgtattcttaagaacttaaaatctcttcaattctcacctgacctaaaatctaagcgtcttattttcttctgcaatgccacttgaccccaatacaaactcaacagtagttccaaatagccagaaaatggcactttcaatttttccaccctacaagatctaaataattcttggcgtaaaatgggcaaatggtgtgaggtgcctgacgtccaggcattcttttacacatcagtcccttcctagtctctgtgcccagtgcaactcgtcccaaatcttccttctttccctcccgcctgtcccctcagtaccaaccccaagcgtcactgagtctttctaatcttccttttctacagacccatctgacctctcccttcctccccaggctgctccttgccaggccgagctaggtcccaattcttcctcagcctctgctcctccaccctataatctttttatcacctcccctcctcacacctgctccggcttacagtttcattccgtgactagccctccccgacctgcccagcaatttattcttaaaaaggtggctggagctaaacgcatagtcaaggttaatgctcctttttctttatcccaaatcagatagtgtttaggctctttttcatcaaatataaaaatctagcccagttcatggctcgtttggcagcaaccctaagacactttacagccctagcccctaaaaggtcaaaaggccatcttattctcaatatacattttattacccaatctgctcccgacattaaataaaactccaaaaactggaatctggccctcaaaccccacaacaggacttaattaacctcaccttcaaggtgtgaaataacagaaaaaagttgcaattccttgcctccactgtgagacaaaccccagccacatctccagcacacaagaacttccaaacgcctgaactgtagcagccagacgtttctccagaacctcctcccccaggaacttgctacacatgccggaaatctggccactgggccaaggaacgcccgcagcccgggattcctcctaagccgcgtcccatctgtgtgggaccccactgaaaatcggactgttcaactcacctggcagccactcccagagctcctggaactctggcccaaggttctctgactgactccttcttggcttactggctgaagactgacgctgcctgatcgcctcagaagccccgcagaccatcatggacgccgagctttaggtaactcacagtggagggtaagtccgtccccttcttaatcaatacggaggctacccactccacattaccttcttttcaagggtctgtttcccttgcctccataactgttgtgagtattgacagccaggcttctaaacctcttaaaactccccaactctggtgccaacttagacaatactctttaaagcactcctttttagttatccccacctgcccagttcccttattaggctgagacactttaactaaattgtctgcttccctgactattcctggactacagctatatctcattgccgcccttcttcccaatcaaaagcctcctttgcgtcctcctcttgtatccccccaccttaacccacaagtataagatacgtctactccctccttggtgaccgatcatgcaccccttaccatctcattaaaacctaatcacccttaccctactcaacgccaatatcccatcccgcagcacactttaaaaaggttaaagcctgttatcactcgtctgctacagcatggccttttaaagcctataaactccccttacaattcccccattttacctgtcctaaaaccggacaagccttacaagttagttcaggatctgtgccttatcaaccaaattgttttgcctatccaccccgtggtgccaaacccgtatactctcctatcctcaatacctccctctactacccattagtctgttctagaactcaaacatgctttctttactattcctttgcacccttcatcccagcctctctttgctttcacttagactcaccctgacactgattaggctcagcaaattacctgggctgtactgccacaaggcttcacagacagcccccattacttcagtcaagcccaaatttcatcctcatctgttacctatctcggcataattctcataaaaacacacgtgctttccctgctgatcgtgtccgattaatctcccaaacctcaatcccttacaaaacaacaactcctttccttcctaggcatggttatagtgcagtcagaattcttacacaagagccaggaccacaccctgtagcctttctgtccaaacaacttgaccttactgttttagcctagccctcatgtctgcgtgcagaggctgccgctgctttaatacttttagaggccctaaaaatcacaaactatgctcaactcactctctacatttctcataacttccaaaatctattttcttcctcatacctgacgcatatgctttctgctccctggctccttcagctgtactcactctttgttaagtcccacaattaccattgttcctggcccggacttcaatccggcctcccacattattcttgataccacacctgacccccacgactgtgtctctctgatccacctgatattcaccccattttcccatatttccttctttcctgttcctcaccctgatcacgcttgatttattgatggtagttccaccaggcctaatcgccacataccagcaaaggcaggctatgctatagtactagccactagcctgcctctcagaacctctcatttcctttccatcgtggaaatctatcctcaaggaaataacttctcagtgttccatctgctattctactactcctcagggattattcaggccccctcccttccctacacatcaagctcagggatttgcccccacccaggactggcaaattagctttacttaacatgcccgagtcaggaaactaaaatacctcttagtctaaatagacactttcactgaataagtaaaggcgtttcctacagggtctgagaaggccaccagtcatttcttccgttctgtcagacataattcctcattttagccttcccacctcaatacagtctgataacagatgagtctttattagtcaaatcagccaagcagtttttcaggctcttagtattcagtgaaacctttatatcccttacagtcctccatcttcaagaaaggtagaatggactgaaggtcttttaaaaacacacctcaccaagctcagccaccaaaaaggactggacaatacttttatcactttcccttctcagaattcaggcctgtcctcggaatgctacaaggtacagcccatttaagctcctgtatagatgctcctttttattaggccccagtctcattccagacaccggaccaacttagactgtgcccccaaaaaaacttgtcatccctactattttctgtctagtcatactcctattttccattctcaactactcatacatgccctgctcttgtttacactgccggtttacactgtttctccaagccatcatagctgatatctcctggtgctatccccaaaccgccactcttaactcttgaagtaaataaataatctttgctggcaggactatgctgaatttccttaggcactctctaatcagatgccctaggtcctcccaattcttagaccttttatacctgtttttctccttcttattccatttagtttttcagttcatacaaaaccgtatccaggccatcaccaatcattctatacaacaaatgtttcttctaacaaccccacaatatcaccccttaccataagatctcctttcagcttaatctctccgactctaggttcccacaccgcccctaatcccgcttgaagcagccctgagaaacatcgtccactctctctccataccactccacaaaaattttccccgccccaacacttcaacactatcttgttttatttttcttattaagaaggcaggaatgtcaggcctctgagcccaagccaagccattgcatcccctgtgacctgcatgtatatgcccagatggcctgaagtaactaaagaatcacaaaagaagtgaatatgccctgccccaccttaactgatgacattccaccacaaaagaagtgtaaatggccagtccttgccttaactgatgacattaccttgtgaaagtccttttcctggctcatcctggctcaaaaagcacccccactgagcaccttgcgacccccgctcctacccgccagagaacaaaccccctttgactgtaattttcctttacctacccaaatcctataaaacggccccacccttatctcccttcgctgactctcttttccgactcagcccgcctgcacccaggtgaaataaacagccttgttgctcacacaaagcctgtttggtggtctcttcacacagacgcgcatgaaagggaagacatacaaaaacaaggcctctgaggtaggtactactgagacagccaggtgggaaggactccttggcaaaactccaaccagcctgtacactgggaggaatgtgcactgggatggagccatagaagtttgtgtcgtttgcagtggggaggagcctggtccctcctcttcctgtgaggaacctggaattcaatctgtgaggaacttcttgaaagacccatcaattcttcaatagaaagcatcaaaggacaatttacaccctaagactgaacccctgacctcaaaatctttcccttgctatgttcaccaacctcaacagaaatattaggattcttacctgatcctagccaagccccctccctcatctcccattaaagggtccatcttcaaccaaacttaagtctcaataaatatctggacattgtccttccaactctgggaagctgctaagactctgtccttactgcagaagaaaaaacagccttgtaccctggtcttctcaacaggttgttctggagatgttctggggagactgcattaaacacagcttcgcaccattgaataaactcagcaacaagccaatgcataaaagtaatctatgcttcaggtcacagaagcttcaaggggaaaaaaacagaatactctagggccattgttcacaaactcatctgaaaacatcctggaaaaattttcccaaacacatggaaagaaagagaggaaaaaagaagatatctgaataatgtggactagaataaagagctgccaggagctgtttatttaaaaacagtactttcttctctggctgagtccctggtattctctgctgcaatctgtagctgtagaattttgaagaatgcaattaaattcaaatggtttgatgagtaatatcttttctcttcatatttgtctaaaacttttctttattgaatagcgagagtgatgaaagtgttttccataataataacaatgacaagggcctgatgatgaactacaattagctcagtgattcatcagttagcagtgaaattttcaatgcatcctgacatttagagcatttggttgtgattaacagtctttgaaatgtcaccgaattttatttaattggctaagaaaaaattttaaaaggtaatcactgcaaagatcacattcatcgccaaaaatgataattgcagttgtcacatgacaaggtagatgctaactactgtagcaaacttgctctgtgttcttacagaatctaatgaatgcagcagagatcaagagcttgaaggggcttagaagtttatttgaatgctcctttcaaagccatttgtatcaagaactgcaagcctttaagtcatctgagcaaataccaaaactgaaatgcaggtaactgtaaaacagaataaactccattcaattatagtaacctctgaaccattctaagctccagccacgatcacaattttaagcacgtgtgtgtgtgcgtgtatatgtgtgtgttcaagaaataactttttatttcatattgacttgtaaaggcaggcataatacacaggaagataataatatcacttaaaggtcatattgatgaagtagaaaatattaatagacaaagcttcattttcatgggagattaaccacctctgtgtttgtcaaagagtttagctatttaaaagctcactggcaatagatgatatgaaatgtttctccctatgagataaatgtgcactcaaacaaatatagtgttaatcgccaaccaatctcaagctgggacattttgtaacatttatctttgtgtgtgtgtgtgtgtgtgtgtgtgtgtgtgtttgatggagtctcgctctgtcacccaggctgaagtgcagtggtgcaatctcagctcactgcatcctctccctcctgggttcaagcgattctcctgcctcagcctcccgaatagctgggattacaggcgcctaccaccatgcctgactaatttttctgtatttttagtagagacgggatttcaccatgttggtcaggctggtctcgaaccccggacctctggtgatccgcccacctcgccctcccaaagtgctgggattacaggtgtgagccaccgtgcctggcctatcattgtgtttttttaaaaaacatttattcggctttttgctttccaagatctatattcagctcatgtggttatctgactgaccagactccagaggtatttttacaggggtatggagggttttcctgttcaaaaatgcttccctcacaaagattcaggataaaaaagtccaccatgtgttggtgatttctctgggtcttagtaggccctgtgaaagtgtgaatacaccttcttggagcatacaatattatgccccaaaatgtggttggtgagctgtaacttctacaagatgctaatacggagatgatggtatgatataaagtgttcctgggttagtaagtgtggttaaacacatttttaaaggtttgttcactgcaggacttctcaaggcctttgatatgcgcaagtaccttgtgagtctgcaagaggaggatggcatctcctcaccttgaccacaacccccatgtgggagtaccttggcaggccggcattaaactgcgcatgctatgggaaatagtgtcttaggagggtctgagaacaaaggtgacagatggaagggatggacagagaaagggtaccagggaaaggaacagaaaatagaggaaggggagcagacactcctaatgacttgggcaaagagaaccaaagcatttgtagtgggagctgtgtctagagacctgggttctcagtggtcacagaggtggcacttctcacccagcccagcactgctgaaagggagccaggtcctgcctcatcaggctgaatctcaaccccacgagaaagggaccaccaggaccacctcacgggtgtgtgacatgcacagctgcacaagattacactaagaaagctccgcacttggttcaaggctttgctaccattaccttaaaattctcaataactgtgaacaagaaaccctgtaaactctggctgagtcaggcttctcagccccaatctgccttactccaggggccacagacttaaccatacaacaatctcctaaccctttctccttcgccacttaggccagagaacagggaaagagaaattcactgcagggaagacttccaaacaagggactccacagctcagagaagtctccccctgctctggccactaggtttttgagataaaacgagagggaattttcaaactgtaacaggtcttttcaatatcaccacctggaaagagcctgctgagatgcagagacccaagccctaagaaggcacctgcccagcagcctagtcctctgtcctcgccggctgtgtcactaaaactattactttgctgtcaacagagatgtactgtccaaaacacggactcttacataaatgtttacatcctgtagccaacagccccttggagctcattaggtgaccggggctttggatttgtactgaggaagttgacttggcaccttctctccttatttttctcttctcctctgcagtcatgacactggctcaggactgagatctaaacagtcatcttcgtggcaacaggtattattggtaaaagagagtctggaaattagggcctagcctttcttgagaggccagtatagctgagtagtaaaaagtcaagttttggagtcaggtgtaactaacccacaatccaagttatgaactgtggagtgaatgactcacctgcctgggcttctgcttgctcacctgcaaaatgacaacagcctgccctacagagctgcctgcagaccaacagcagcaaggccttgggagtctctgctggtctcccagctcctgcttgacacctcaagatgatgttgctccatttagtgcctgtttgttctcagactatcccatgccttcttcctgcaaaccacagctctcaagctccccaacagtttgacaaggatcatacaaaggggaaaggaagcaaggaaagaatcaaggtctttctaagcaatttctctacgctctcaggggataggcattttctggccgtgactgtgtctcctccatagttccaacttccacaggacaggtccttccctccatagtcacagttcttcttgggtagcctcctccacacttctgaatggcccatctgaatggccacagtgactcggcgctgatgtcacccctcctgcctgttgtaccccctgccctagagaggagatgcctcctgctgatgctaatctgtggattgcttcattctctggtttctcagcttttccatcccttatgccatcaattgcccgaattaaactcctactatttaaaatacctagagtggtttttatttttctgcttcttaacatcttcactgctatctccctagtccaagtcaccattatcttacccagataacttaatggcctccctgttattgtccttgccctcctagggttgcttctaaatacagcagccagaaaaatgctgttgagttcaag

SEQ ID NO: 1614 - DNA, 1042 bp, Homo sapiens
gctatttaaaacaacgggttccttcctgtttcctacgcgctgactgaggcgtcttctgtgttagaaaaaaaaaagaaactcaggaataaagtgcctcctctcacaatgaatgggctacacatttcggcccgcagtgacacaaaagctcctaactgtttcatctgtacagatggctctcatttggtgttggtggcatgactctgtgagtaaaaacctcctctaagccaagttagaatcctccaagaaatagaattgctcttagccctgagtgtgaaatttttgcagaagtccctgaattgcagatgttccctccaagagggaaggagggagagtgcgcaatctccctggtctgaagtgagaacggcctatgctctcactctttgttcccctccccagggaaatccagttacccactgggagtgagctgccccctaaccccgcatgaccctgttccccgggaggggcagcctggggagtgacaggcatgacctcgatggtgggccaggggcctcctcagaggagcaaagagaagcttggtggaagagaaagccgctagtattcagcgagaagatcactcaaatccttcaccagcatgctcagtgaagaatgcattaaaaaaattagactttttttcttcctggcaacaaaatcttgccaaaataagtaccaaaataagtgttccaatggttttatttggggaaagccaacgctttccccaaaaagactttttcttgtttctcatttggctgctacaaataaagctgcaatgaacatacatgtacacatctttgcacggaagtagctttcttttctcttaagtaaatgtaggtgtatttcattttattgtactttgctttcttgtgtttctcagatgttatttatttattttgcaaattgaagatttgtggcaatcctgtgtagaacaagtctatctgtaccatttttccaacagcatgtgctcactttgcatctctgtgccacacttggctaattagggaatactttaaactttctaattactattatatttgttatggtgatc

SEQ ID NO: 1615 - DNA, 1083 bp, Homo sapiens
gaccagccagccgccaggacgatgctggccgcccgccgccagcggctggggcccggccgcagggagctgctcatggcgcgcagcttcccggatccgattctggcgcggcctgagctccacggcaggtggcccggccctgcagggaccccagcacctccgggggcctcgcgggaattgaggacgagcctctggcgttgggtgaacctgggcgtttggtcggcaacggcgcctgcctgtgggaggggcacccgagcagggaccgcctcgagtgcactggggcccagctagggcactctcgcgggacaatgggtgtcacggcagccagcgaccgtttgtcattcacagctgcctgaaaggaggaccgcagtattcccacgcaggaagcttggaccaaaagcaggaatgcttaagggcgcatatgacttgccatggtaaaaaacaggatgccaacccaggcctgatgacatccacctcactaaaagctaaggactaggactttctgctttaaacaaggacccacatgtgggtgttttctgtgggagagggagagaggacattcgaagggcagaagtctgacctttgcaagcacacgtgaaccacaccaatgagaaatgaatggacgagccagatgccaatttataaatttcctactgcacaccttgaatgtgaaagtacatgtggccgacaaagagaagggaagatggagccgccatcttcaacaggagtggcacaactgtcggatctatgtctgcagctggattttacaggctgctcttcgttagaaaggaaaactttacggaggacttccatgccttcactatctgcctaagtaaattcttcttaactcctgtaccagtctcagcctcattttgtccagcccctatacaagatggagttgctctggttcaaacgcctgacacaaacttgctccaaaataaacatgggtgatgtatgttacctgtatgtttacccattgcacatgtggtcaaccccctcataaatatgtacagctttcccccaaaacctgctgaatatgactttcttgtgtaatacagaccctgggatgcataaaacccaacctgc

SEQ ID NO: 1616 - DNA, 459 bp, Homo sapiens
cgcttctccagacgggagcgcggttgggcctccatacaaaggctgcgcttctgccatggcgggcacaggacaatgcgctgcagagcacactgagtgggagagcaaattctggaactgtcgcaggcggaaaccacacaagggggaaacagacaaaacagcaaacccggaagaaccattcccgcttccgaagctccatgatcacggcagacgcttcttaaaacctcccgtttaatatcagatgccacacatacgagatcgatgtgcacgtcgggagaaaccacagcacagccaggagtactggcgcacagtgaatacgcttccgtcctttcaaaagcctttcccgaacggtatcttgtaaaaaatgccaaaaataaaatgaaaaaaactgccaggaaaagagaactggctttcagtgttaacgaaatggattctccagaagcatggaaatcaggactgcca

SEQ ID NO: 1617 - DNA, 2444 bp, Homo sapiens
ttgaccaaccgttaatttttatttgtgcaaatgacattacattagactttagaagcttaagcaaataaaaatgtgcttcccaattgctacgtgtaattccttgagatcaactatcagagactttaatctgagacgacttgaggtgataaggaagcaacagaagttggcagcagtcttgctttaatcctctcagagttgccaagttcctggcaaaacctagttatttgttattgctgtgaaggtaacgctggagcccaaaaaatgataccccaaatgaaggccgcagaagcaaagtttctctgccctcctgtctgttgaccctgattcttccccaggtgagccatagaaactagaattcctcttctccaagaccggccatagaagccagaatcccgtttcctgaaagccagccataaaacctaaatatattgctcttaaatttcccccacctttctatgtaacagctggccataaagaaattaagacactcattccagagggatcccacccccacacccagcagaaggaaatgctgcagacaggccttggtgagcttccccatgtagtctattctgatagcattaggaccatatcctttttgtccatatttctacatgtccaatcatatttctacatcgacttttcattgaacataagcataaaaatgaacagttttccctatatctttgggtcttcattctgaaggctaccatgtcaagtaaactataagtgtgttatgctttttctagttaacctgtcttttgttataggggtgttagccatgatccaatggggagggaagggatcactcctttcctcaagtgatcaggcagttggatcacttgaggtcaggagttcaagaccagcctggccaacatggcaaaaaccctgcctctactaaaaatacaaaaattatccaggtgtggtggtggtgcatgcctgtaatcccagctactcaggaggctgaggcacgagaattgcttgagcccaggaggcaaagtttatgagatggtgccactgcactccagcctgtctagtctgggtgacacagcaagaccctgtctcaaaaaaaaaaaaaaaaaaaaaaaagttaacgaacttaggtacctacttaggagaaccaaaaatatatggccacacaaaaatttgtacatggctgttcatagcagcattattcataatagccaaaaagtagaaacaacccaaatgttcatcaacttaccaatgaacaaaaatggcatatccttacactggaagagtactgtcagaaaaagtaatgaaatactgataatataaacatggtacaacatagatgactcttaaaaacactataccaagttaaaggagccaaacccaaaggtcacatattgcctgattccatttacatgagatgtccagaatgggcaaatccatagagacagtttattagtatttccctggggctgggagcagaggggttgggactagggaaatgactgctaatggtacagagttctttctggggtaaggaagatgttctgaaagtagatggagatggttgcacaactttgtgaatacgctaaaaaccactgaattgttcaatttaaatgggtgaatactatgacatgtgaattatatctccatttttttaaaaaaagttaatgaaaagcaactttcttcttatttcatttttagggacaggcaggggagcccagcggcatgctggatatgaatgtatcttcagccttcaagttaccattggccagagggaagagtggccccaaactctgaagagcgctggcaaggctccccatcttcctctccctagcctccacaggaacatcacagtatggcttggcattttttttttttttttgagacggagtctcactctgtcacccaggctggagtgcagtggtgtgatctcagctcactgcaagctctgcctcccgggttcatgccattctcctgcctcagcctcccgagtaactgggactacaggcgcccgccaccacgcccagctaattttttgtatttttagtagagacggggtttcactgtgttagccaggatggtctcaatctcctgaccttgtgatctgcccgcctcagcctcccaaagtgctgggatgacaggcgtgagccacgcgcccagcctggcttggcatctttagggcagatctcagtatgccttgcattccaattcatctccagaatcctacacttcctccaaggtcagtcctcatgcgagtctccaacctcatccccacttcattttcctcattgtacttaccatcttttattcgtatcccaccaaattttggctttgttagctatactgcaaatagtagatgctcaataaactactagtgaatgaatgaacttggaaaaaaaagcttacacagaaatctgtactggatgttatttaaaagatgaaatttcatggttcaaatgtatttttctccc

SEQ ID NO: 1618 - DNA, 4657 bp, Homo sapiens
ggagcgcgggcgcggcgggggcgggcggccaggctagtcgggcgggtgcgcggggcgctcggggcccggggccagagctggagccggagccgggcgggcgccatggaggggctgcggcgggggctgtcgcgctggaagcgctaccacatcaaggtgcacctggcggacgaggcgctgctgctaccgctgaccgtgcggccgcgggacacgctcagcgacctgcgcgcccagctggtgggccagggcgtgagctcctggaagcgcgccttctactacaacgcgcggcggctggacgaccaccagacggtgcgcgacgcgcgcctgcaggacggctcggtgctgctgctcgtcagcgaccccaggtagtctgggttggaggaggcagagccatgaccaaggggacctgggtactggctgaaggaataggctggggtagagggcacttttggaaggcacttctcctgcctcccgggagcctagatctcactccagggtctgggctcccaggtggaccatgaaaccctggcctgaccagctgatgcacactgcttcagacactcctgctggagccccagtccctgacaaggacctaggacatttttgctcctgcccagcctatcgggagggagccttgagcctttcagctctgctgtgtgactttgaggttgttgctcccctcttggggccctgggtgccctgtcttcagtggaaagcactgtgccaccttggaaagctcccatgggcagccagagggcatcgcaagaagagaagcacagaaggggcaggagagacactcagaggcacttccgctcttgcccaggacattttcccagccacacctttgcccaagccgtgccccctgcctggagcacttttcaacctcttctctgcagctccaatacacctgggattgcagtctcctccaggaagtcttctcagattccctccttcccagccagagagcacctagccttctttggggcccccacaggccctttgtgcagtgaacagccctggctgggggtgcagccagtcgtgtccgaactctccaatgactaagcggggagatgcggacatcctagctccttctcaggcctccaactgtgccccatttccacccccaaatacctccccaggaggcacctgtgcccaccccctgggctgtttcccccttccccttaaatccggatgcctcgtcttgcatagggtcttggggcagcggggaaggggttctgaagaactctggccaagaggacgaggatctgggggtggggaactgggcctagctgtgggaggtcatcgcggggcattgcagggagtgcgttgtgggaattccgggtggagaccctcagggcagtgtgccgggcctccgttgcacctctgacctgcagccacgtcatcgttgcgcagcccctggggagggtctttggggagggggtgccgaggctacgcatgtcctcgagggccgtgtacactctccaggcaccatgggcggaggcgccagaggctgggaagaaataatgttttagttaagagtcctgttggctgcaggactcagagcatggacaggtggatagtaaatcaccaccacggggacagccgtgcccagactgtgcgtttgcttagctcggggacagcacttggcccggggtctcctgctcgcctcccttcagagcatctgccaaacttcgggcatctaccctgcaattcccgcttggctgagaggagggggagaaggaggggaagagagaggagccccacttcactccggcaggcagacctgctggagctgctttgcagaatgacttgggtcttgctggcccctgggtgtgcctggaggggggtcttcctatccccctccacctctccccttggtgcctaacccaggactttgtccccagagacccactgtgtgccccctggagctcctcctagagcagagtctgctgctgtctgttctgcagagggtagcctgaggcccaaggaggttgtcagggacacacagcagggggaggcagcccagatccctgctcatgcgtggtttgggcctctgctaacagctgggccacatgcgtgtatctagagcctgggtcccctctgtcctcatttccctgtgcatattcagggacatgcctcgtcagggtttggcaagaaaatggggcatttaataatctccccagtttcattccttggtccttactccatgccaggacttgtgcacatctttttggagccctgtctcacttgattgacagccggccaggcgcggtggctcacgcctgtaatcccagcactttgggaggacgaggcaggcggatcatgaggtcaggagatggagaccatcctggctaacacggtgaaaccccgtctctactaaaagtacaaaaaaaatagccgggcctggtggcgggcgcctgtagtcccagctacttggtaggctgaggcaggagaatggcgggaacccgggaggcagaggttgcagtgagctgagatcacgccactgcactccagcctgggcgacagagcgagactccgtctcaaaaaaaaaaaaaaaaaagattgacagcctcactgctcaggggccaggataacagcccattttacagatggcttttggcttgcccaaggtcaccaccctctgaactgaggcgtccccaacccatgccgggagctggtggaggaagtggggaagggtttcccgcttctccactgggggtggaggtgggagaaagcattttcagggtgttttgacatttaacaaacagtatgcaaatcacatgcaaatcgcatgcaaatcaccacccatttcttaagcctcgacagcgctggcatgttctgaaataataatgttggacctgtcccttgatgatgacctgggtcgggaggtgcacggccttttccttcctccgtcttcccttcccttcccttcccttcccatctgttctcccttccttcgcccccttcctttcctctccctccctatcttccatttttctcttcttccttcacatcatttgtccaagacctccctggcctgagataaacataagttgcaaaagtggcttcctgcagcccattttccaggttgggaaactgaggcatgggcctaaggtcccacagccacaccgaggaaagcagcccccactgaatgtcaccatgcaccaaagtgcatggtcctcgtgacacaaagaggggagatgacagtggctggagttgtcagagctgctttgaggaagctccaggcctgataggcttgacagggccaaggggaactattgtggaatgtcttggccttgaatgacaggctgctgattttggatctggagaaagctcacactgactcttcctgctcccccagtctgtttttctcctgctactccatccatgtatccctgagtttgggccacagtccctccacttggtttgcatgtcccaccttctttgtttggcaagctcctattcatccttcaaagccctagcttcaatacctgctacttcatgcagccattgcttatccttcaaggagagcctacttccctcaaggaccctgctgcttccagtctcaccttctgactcactcgggatccactgaactgggaggtctgtgtctcctcccagcagagtcatcactacctttggggccgcaggatcacccagcttggaactagatacagaaatgctgttttgagagtgtactgaataaaagattacatgtttgaaaacaagattgagtttaagcttcctaacttggccttggagctctcttgggcttcattctaccccatctatggttttgggctgagctctacttctaccttcctctcactcccctccaggcctttgcacatgctgttactccaggtgacgctgttactccaggtgacactgttactccagttgaccccaggccagccccctcccatatctgggctgtgaaactcagggaatcctgctcgctccccgccagggcctctcagactctgggctccaccctgagcaagtctgggctatgaggagtttcgggtgagacttggcagctgccgtctcgctaaggcccgcggcgttctggggaggggccacctcccgtcttggccgcccacctagtttgtgctccaagaaggtccaagggaattctcctagggggcaagtgagcccaggcggttcccagaggagatgtcagcggtttagccagaaactgccaggacctggaattgccacttccttcctgccctgcctctatctctctgttctctttctgtgcgactccaggctgggctctggcattctcctaactctgagcattcattcaatgagagatataaagacagatgctgctccggctgccacagacagtggggcaggttgttcactgcacaagaggacccagctgcagaggacccatctgatcaccacgtggaaaagcctcctgtgaatgaagttaattcagaagaaagcagatggtcttgacatggcttcagcacctggatcaaaccgtgcctgaaggcatactattatttacaatagctccctttttgctgaagtcaattgaaatcaagtgtttctgtttgttctttgtttttgtgacttttagagtcctggctattgaagagctggtaaaggtggtctcgtgggcactatatgagtttgttagggctgc

SEQ ID NO: 1619 - DNA, 4657 bp, Homo sapiens; identical to SEQ ID NO: 1618

SEQ ID NO: 1620 - DNA, 4657 bp, Homo sapiens; identical to SEQ ID NO: 1618

SEQ ID NO: 1621 - DNA, 4657 bp, Homo sapiens; identical to SEQ ID NO: 1618

SEQ ID NO: 1622 - DNA, 2818 bp, Homo sapiens
ccaagattgaggatccacatctggtgaagaccttcttgctgcatgctaacttggaaaagtatcacatgcattagaaagacaccggtgaaagacgcagctcaagagggcgctttgcagaagatgctgggaaatgtagttcctggcggccgcgtgcgcaggcgtacttcctggcttgggaaccacatcgcccgaccgtgctctttatttttcggtggagcagctctgctttctcaggtctctacttacttatataagatggcatcaagaagaaggacctgaccactggcccctgactacatggtctttggaacccgtggcattggaagatgtcagagacatggcacatggatgtgatcttcaaaaactgttacagcctcatctcattggattggtctacacatcaaggtgctggaagtgtcgcatgcccagagatgatgtggaagctctatacccctttcccttctgcccaccttgccctgtgcatctcttcctgaatggcttctcctgaattgtatcctttataataaactggtaaataggaaagagataatatcttctacttaatcctggatactatatctgaagtcagagcatccactccaaagcagagaatttctgaaaaacaaaataatgtcatcatatgatgttagaattttttttcaaatgatggttcctaatacttcacattagaagaactcgaatttgatgaccagtttgagaaacaccagtatatccagattacaagaaaaagcgagtcaaaaggatgatcatgaatataacaacttcgaggaaacatttaaccaaagaccaaagctttttaaacaactgagagtttttataagaaaaagacctcatacagtagtccccacttattcatgggggatacatttcaagacccacagagaaggcctgaaatcactgatgtaccaaaccctaaccaggttcttaggatgagctactaaatgacaaatgggtgggtagtacatagagtgtagatacaccagacaaagaaatgattcacagcccaggcaggacagagcagatcacacaagatttcatcacagtactcagaaaaccacaccatttaaaagttatgaattgtttatttctggaattttccatataatatttttgaccacagtttcccatggataactgaaaccatgggaagtggaactgtggataaggcaggactactgtaactatgacatcaatggtaggaacctgaagcataattctgctgtagtggattttttcaaaagaaactcatgaatgaaaaataatttattagatataagaaaggatgcatttgtatctcaaactttacttattctggaaataaatgaaaagccaacacctattacataccgacaaaaatgaaaaaataaataaatgtaaagccatagttcagtactgatggaatctgagaaaatttatatgaccgcgaacccatatctctgtactgaatgtgggaaaggctacacttgtcttgcatccctgacccagcatcagaaaacacatattggagaaaaaccttatgaatgtaaaatatgtggtaagtcctttacccggaacagtaatcttgttcaacatcaaagaatacatactggagagaaaccttatgaatgtaatgaatgtgggaaagcttttagtcagagcactaatcttattcagcatcaaagagtccatactggggagaaaccttatgagtgtaatgaatgtgaaaaaacctttagtcataggtcatcccttagaaatcatgagagaatccatactggagaaaaaccctatccttgtaatgaatgtgggaaagctttcagccatatctctgcccttactcaacatcatagaattcatactggaaagaaaccatatgaatgtactgaatgtggaaaaaccttcagccgcagcacacacctaattgaacatcagggaattcattctgaggaaaaatcctaccagtgtaagcaatgtcggaaagttttttgccacagtacatcactaatccgacatcagagaacccacacaggagagaaaccatatgaatgtaatgaatgtgggaaagctttcagccataccccagccttcattcaacatcaaagaattcatactggagaaaaaccctatgagtgtaatgcatgtggaaaggccttcaatcggagtgcacatcttactgaacaccagagaactcatactggagagaagccctatgtttgtaaagaatgtggaaaaaccttcagtcgaagtacacaccttactgaacatctaaaaattcattcttgtgtgaaaccctatcaatgtaatgaatgtcagaaactgttttgctatagaacatcactaattcgacatcagaggacgcatacaggagagaaaccctaccagtgtaatgaatgtgggaaatccttcagcttaagctcagctctaactaaacataagcgaatacatacaagggagagaccctatcaatgtactaagtgtggtgatgtcttttgtcatagtacatccttaattcgacatcagaaaactcatttcagaaaggaaaccttagcagagtaatgagtgtgggaaagcctgcagtcagtcgtaggttattgtttacacctgagcactcacagttcaagcaaccctaggattgttatgtgaggaaaatcttaggcaaaacactcatttacttaatatgctatttgtactgagaagaaggactatgcttataatctaaaaaaggtgttattgaaagagaaagttataatggaagtgttcatccaaaactgaggtttgttttttaaagacatttagaaagttactttcagagataatt

SEQ ID NO: 1623 - DNA, 609 bp, Homo sapiens
ctcatcattaggcaggattttgaggtcgtggctgtagtcctcgtctgcttggcgggtgtggttctccaggaggctcatgttgaagccagggtgtgggaagctctcactgacatgaacaaactgggctgtgttttcgtcgtcaaacaagttgtggcgacccagccagagctggtaattgctggggaaagatgggaatggagggatgagaagacgggaaggggaaaaggggatggggcaggggagcatgggggagggtccccaaagagagaaagggaaagagaaaaatgtgggtgggcggagacagaggaagaaagatatagttatggagaaatacagacagcgaatgggaagatgaaagattttgagagtgcaaaaggcaaatgaagagacagagcaaaaaagagctcaaaaggacagaggggtgaaaaaggcggaggggagggcagtgagaaacagggtgagcaaaaaagaggcagatgagaaggataaaagacagggacagcgagaaacaggacgcgggacgtcagagtgagaactagaaacagaggcagagaggaagcaggagtgaccgagtgtgggagagaaaagggagggaggccctgggggagg

SEQ ID NO: 1624 - DNA, 6729 bp, Homo sapiens
ttttgctgctgccacgtaagaagtgtctttcgcctcccgccatgattctgaggcctccccagccatgtgcaactgcgtgtttactgctctgggcccagtgcctccctcgctcaatggagtgacggcatccaactcacaagacaggagactcaacagaatgaccaagtggagaagacgtctaagttctcagcggtctcagccgaatgactgaagaggaaccagggacagggatgactcacatgggaagaggaccccactttgttctgtttgattctaagaggacacagactgcttcattcatttcagtttccccagcacctggcttaactctcagacatgttagacggtttgtaagcaccggctctactgaactggcatcaaatcatgacctggttcagaagagacacgaggactggatctgttctaaacagattgtgcaaaggggaaagacacagactcagcatttccacagcttttaacatttcagcgagaggtgagaaagcatgtcaggaacacaggcccggccgatgaaagtgtctgatgctaacacatgaactgtcttctgctgggcacactaaggggccacaagcaagctacgccccagagccactccacattctctctgggtgcactggccctcggccacgcaaggccgcgccagcctccgaggtgagccagaaggacacacacctgtggactcgatgtccctgacttgggctcgatggccagccccagggtgactccgcccgccagcgctttcttcaggctctccttgacctccgtcagctccagctccaggctgacacgctccgcctccttctgccggcactcctcctccagctgcttcagcttctcctccaggatcgcctgcggcttcctgcctggaattcccagaaacgccgttactcccgcggcaggcacaggttctccaaacaacagagaaggcacctggtccccaagaagaacttccacaaaacgtctgaggtcgagctcccctgacttaggtcctcgttgtgaaacttaaattcagcagttctctaagggatcagagtccttctcctaccatttccctttgctgcagccgttgaggactcggaccaggaaagaggagatgctgattctgacgaaggccaggagctcctggctctgggcctcaatgttctcattttaaaacgtggaccctaaactccacagttcccaaagctgccaccttcttggagtgtgaaccctgtcctcccctaacgctccgccgatccttcagtcatcttatttgcgcccgaggcaatgaacagtagctcagcttgcatctctactggacatggcacacatttctttaaggcacattcacttattttatttgaggtttgctgcagtgacctaagatgcacccactgggcagatgagaacaccaatcccaagaggtgaacggacttgtgcccagggcctgggccggtggtggccggcaggcgaggttctctttttcaaagccaaaagcactcctggccctcctgcatcttcactatcctgcaagctgggaacacgggagaaatgctacttctgtctcattaaactccatgccccgtcccattctctggcacagcctcctcccgtagggtcagcctcagactgcaggccacatcctgggcctcctatagggtcagcccgacctgccctgccaacacctgccttccctcctctaaactccaaaagcatttcccttcatcagatcattgaggcacaaagtccagcaaggctggagctgctaaccacctgctgggtgtgcgtcagctcctccccgcgcggcgagccatgggaaggccacagcctcttctctggaccacccagggctctgaggcatctgaagcccccgtcccagcccaggccagtacaatctcaatctaaggagccagtcttccgtagtctaagcaccgggctggaagggaggccatgcgtaggtaagcggtgccaccccaggctcaggagctgagcgccagctcccgccagcaggaattgcacgcgcctggcccagggctgccactctggctgcaaactcagtttctgtgacttcagtccctctctggtgtctgtattccattagcctggcctcttccctgatgcatcccaagacagatgctgccttgctctcgcctgtcccttctcaacaaacgaggggctgcttctacccttgtctggacttctgaatattactgacccctgtgggctaccctctgtagagaaatccagctgatccctcctacccggtgaccagaatctactgcgtcctgcggatacaggggccatcctccagacaatctctgttgtcagcgccagaagccggaacaggtcccccagcacctcccctgcctcggtgagcagcgtgtgggtctggccctggcctctgcctgcacgccgcatgtttgaccacacaggcacctgcctcggggttaccagcaatgtttccaagccccaagaaacactgtgagataacccactcttactaaataaaatgacagccttggtgagcaataggtcctttgggcaaagcagaatgaaatctccagtctctaatacaaacatgcaccctgggcagtcacccacacccttcataccggcgttcacttcaatagccgctcgaaggtcttttctttccttgcggagctgggccagcctattccgcagggcctctttcctcttcagcagctcctcctctttggtctgtagccgcttggcatctgcttctacccggttcttgccatacttgtactgggcagcatcttgagaagaaaaaaaagcagcaattaaaaattaggtttactagcctgggaaatatgggacgatcccttctccacaaaaaatacaaaattagccaggcatggcggcacatgcctatagtcccagctactcaggaagctgaggtgggagaatcgcttgagcttgggagcttgaggctgcagtgagctgtgatcctgccactgtgctccagcctggatgacagtgagaccccgtgtcaaaaaaaaattaggtttattcaagcagataatggggtaactcaaaaagcctgttgaatcagccaactcagtaaacaaacacaaagcattattttgctaattcaacaagaaaaggacagggctggtatgaaccaagcagaaaagtgactagttcaaattctccaatattctttgaatcaaattcttaaaaacgaaaacagaatattaggaaattcctttaattcacttccctttgaggcacacggcttataattaatctgcaacaaggtggagaatgaacattctataatcggaaaagacaggagtaatatcaaaaataatgtctgaaatttgcttccttctctacgtcttcaaatccttccctaacaccgcagtatctgttccttatggccatgtcatctgactggctctgaattgctgctacacccccagcactgagattagcacccggcacggagtgtggcacaataaatgcttgtttagtgaataaatgaacaacggatacatgaagaggcaaccaggagcggtatctggagcctgactgtctaggaaggagtcccagcttacacttgtagctgcatgacctggaacagggcacgaatccctctgtgcctcagtttccctcatccgtgaaatggggatagtaagagcaggcaattcactgagtggttacgaggattaaatatttataaagcacttagaacaaacacaaatgggcaacacataaatgcttatttcataaaatgaataaatgaagaggaaactagctgtagggaaaatttacagacttggcaacttcacatcaccagtgaaaacagctttcaaaacctgaccccatgctctctcctattatgttggcttttcaataacagtaatttaggacaacacctctttgttaagacacatggaagagatgaaggttctaacaaaactcggatggaggatcaccgatttcaaagcttccgtggtctcccagtcgcttctaacaatcactcacgcctgaaggcaactcccaggccttcctgactgcacaccccaagtgtctgactccctcacaaggctagaaactacttcaggtagaagccacaggggtggcataatgattaagaataaaaacactggactcagagaggtggctagaaacccacactccaccctcccttgctccatgactctgcaagcaacctccggagaagctcagcttcaccctctctaaagcagaaacgagaaggaatcctgtgtgtgtgtatgtgtgtgtgcgtgcgtgtgcatgcgtgttttaaattagaacgttatatctgaaaaaaatctaacaaaatgatacgacgcctgatgtagtggacattcactgacaattcttaccatatcagcgataagtgattcccagagccttgtccactcagggacagcagggagccatttctagcacctgtcctaaatgctggatttgccaattcttgcaacgtaagttatcatgatttcaatgaaatactgcatttatgaaggcataaaaagtgatcactccccagtcaattttcccctaatcaaaagaaccacatagaatgacagcaaaagcgtcggcagcctgaggagaggcgaagcattcgacaatctgaaacaaaaggatcgctgtttgcagctaaggttaacaacatatttggcaaacagggccaagtccaaactctactcgcttatttctaaactaagctgtttccccaatgaactcaatgcaatcacctataaatttccacatcttttggtccccatgtaataaatcccatctaatctataatgcaaccggctggattcaagcaaaaacacggaatgccattatttttctcttttgtcaccattagacgtcaccacagttaataaaaactccctacagaacatcccataaaataaaggaataaatcatctaggaaataaagtcagcacaggtactgacagagaaacaccatggcgattgagactccgtgggactccgattttgcttgtaacaaagctttccaggtgtgagctgctcctctcccccatctgcccctcctcaaagaaacaacactaaaagaggtgaaagtaaatacacctgatacattcaggaaataagatttgccagataaggtcaaaggaagttagtacattaaacaaatggtggtaggagggaggatttggcccaactggctccaacctatctggtcaacacgtatgttgggtagaacagaggtggagaaaagcctagatcagggatgtatacgcttccttggggcagacgcagcctggccctgcggagcgatttcaagcctcgttcacgaacatggccaaggacactgccagcctcttcattcccctgtgtggatgctccaactccaaaagtggaaccacagggcaaatgaatgtcggcacgtgtcggtatggcagcctcgctcttcgacagctggtgtgggggttaccacctggggctagctggcctcatcttcgttagcactgagactggtctaccagttgcacagattcagatttgaaaatctcaggtgcaaatcccaagtggcgatggcatgtaaccacatcaaactcaacatctgcacctaactcccaccttctttctctgggaaatcttcctggacatgcccagatggactcaggagcccatcacctgtaaatccccacactgcagccctgccacttgcttgtctgcatgtgtgggtccgctggaccactttggtgtatctttgagccccttgagtgaaaaaatgctgcctggctggctccctgattagacatccaacataatgaggactaacaccaatacaaacacttaagagatgacatatcgccctagctggatctactacagggaagggaagagggtgctgggtccaggcaggctgagtgtctcatgtcttaatgcttctctgcccaatctatttccggctggatgtggagtctgaaggcctggcacccactctggctctgtgatttaccagctgtgagccttgggggagctgcttactctcttggtgattcttttctcatttctatgatggggtagaggataatgcctatgcttacaaagtggctgtgggaagtaaaccggatgggataagaatggcttgctgtggaccacaggcaccgcaggataaccattcctcagaactcctcatactgctctagtgcttggaggtccgtgtattacctcagctattccaaccgcaccaaccacgggagccacgtgtctacgtctgacagataaagatgctgagtttagagtctgcaaggcttgacaaccacagatcagggacaggagctgaggtctcctgacctggagcccagggccacccggagctgcaagaaacctgcactcacaactgcctcctattttaaaatgctgagtcgatcccacaggtggcaaaccagttctgggcttcaatttacaagcagtcagaaaagctgggttgaaatcgccactgtccttctatgtggctgatgaggaaggatgacggtgcccaccgctccatctctccagctgaccccaagctggcactcacgggtgggcaggctcagacaggcccagctccaccaagtgcacttgaagccggaatgcaagacatccgatggtatacttactcgaacccgtccttttcacaacagccgcgggatccgctttctttggctgactgctcagagtcttcccttttcctgtgaccccattagacgccacggg

SEQ ID NO: 1625 - DNA, 2543 bp, Homo sapiens
gtaggtagtgatttttatttatttatttattatttatttattttttttgagatggagtctcactctgtcgcctagggtggagtgcagtggcatgatctcggctcactgcaagctctgcctctcaggtttatgccattctcctgcctcagcctcctgagtagctggaactacaggtgcccgccaccacgcctggctaattttttatattttttagtagagacagtgtttcaccgtgttagtcaggatggtctcgatcttctgacatcgtgatccacccgcctcggcctcccaaagtgctaggattacaggcgtgagtcactgcactcagccaggttttcaggtgctggttccatggctcttcctgagccgaaaataaggaaactccatagaccttgtccactggaactcgttcccatctaccctccactctatccagggtgatggatctctgcagtaagtggaagagttcttcatggcccccaaggttatatccatctagaacttcagcacgtaatttcatctggaaatagtgcctttgcggatataagttaggtaaaactgaagatgagatcatactggattaggatgggatctaaatccaatgaaaatgtcttcataaaaaacaggaaagaacccatagaaacacaaggaagaaggtcatgtgaagatggaggcagagattggagggatgcagccaccggcccaggaatgccagcagccacccagaagctggaaggaaatgagggattctctcctagaacctttagagagaacatggtcctgtgaacagcttgattttggacttgcccatagcttgtatactcttactttggatacaattttatccaaacttggctaaacagtttctcagcctatggaaaatttaaaatggagaagattcaactcgattcttacagattcaaagcaagaaaatgatgggaacataggaggagaccaagaaagcctataaaaagcaaaaatatgaagtgaacattgtggtagctttaagatgtttagtgtagctgcaggcaccctatacacatgaaaacccccaaggggaatccccatatcacagtgtagtgtgatatttgacattcgtgatcatctagagatgtacagaaaaggtgaatctgtgttctgtatattctgcctaaggcaaagaaatgtttagctctctttaaaatagttccataattttttctaaaaagctttgcttgaaaactgtaagcttcccatatctggagcatttcactttaaatatttggataaatatgttatcttcttacttggacatttcatgtgtttagggattgtcttctaaattcttcctaattcatatagctgctaacacttcccgcagagctaaaccattacagatatgaaataaagacctattgatttgacttacttttacttgtaaaaccttctgagtgttataacctcatttaatctttcagcatttacagtttcaagagtttgtgtcacaattagaagaattcagctgcacctccaagtgacagcagttgctctggttggtgggtgatctcaggaggcttgagaattgctttgtctgtgagggaagtaagacattttcagagccccactttagaaggtgtgaactggctagataatgaaccccagggctaacgctgctatagcagtgggaaggaggtgatgggttttcagtttggacctcaaacatcaataccctcctggtacggggaggaacagagtccctcctttacttctccattagaaagaatgagatggcaagacaatgaaacaggcaaagtgaacagagatgcaagacaaaattcaggtgagagagccagagcatcactcagccattcctgacatgtaaaacaggcaactagaaatttgcagaaaggaagcgaagtctccataaagatgtttttaaagtgagcttgaagtatttggagacaattcagtgttacataaaatctgcaaatctctggataaagaagcagagatcccagcatgggacaaatggagcctcaaaagtgggaagaagacagagaagaccagggcagaatgcatctcttcctttctcttggctttcctggataaggactgcatcattcctgtggaaggacaggccatcagctccgaaacactgtatgtattttccagtatatactgctagctgtgtgatgttgggaaaatttgttaccctgtctaacccccacttccctcatctgtaaaatggaaataatgatagtacctacctatctcataggtggcaactacaaggggcagcacactcagggaattaaggaagtttcagtgaacatcaactttatgaacacagtgttcataaaggcaggtcagtgcagtggtttgggagccaggagaagcacgtgggccggagtgtgcctgcaggagacaaggtcagagatgttgctaataatggagaataaaggatgcattctcattactgaccttggagtcgttcattcattcccagaatgtgttttgtcagcttactaaaacactaagttaaataatcccaggttttgtttatt

SEQ ID NO: 1626 - DNA, 2543 bp, Homo sapiens; identical to SEQ ID NO: 1625

SEQ ID NO: 1627 - DNA, 2261 bp, Homo sapiens
attaaattggaactttggaatcttaatagaaaaccaactgacttggcttggttttcaggtgctggttccatggctcttcctgagccgaaaataaggaaactccatagaccttgtccactggaactcgttcccatctaccctccactctatccagggtgatggatctctgcagtaagtggaagagttcttcatggcccccaaggttatatccatctagaacttcagcacgtaatttcatctggaaatagtgcctttgcggatataagttaggtaaaactgaagatgagatcatactggattaggatgggatctaaatccaatgaaaatgtcttcataaaaaacaggaaagaacccatagaaacacaaggaagaaggtcatgtgaagatggaggcagagattggagggatgcagccaccggcccaggaatgccagcagccacccagaagctggaaggaaatgagggattctctcctagaacctttagagagaacatggtcctgtgaacagcttgattttggacttgcccatagcttgtatactcttactttggatacaattttatccaaacttggctaaacagtttctcagcctatggaaaatttaaaatggagaagattcaactcgattcttacagattcaaagcaagaaaatgatgggaacataggaggagaccaagaaagcctataaaaagcaaaaatatgaagtgaacattgtggtagctttaagatgtttagtgtagctgcaggcaccctatacacatgaaaacccccaaggggaatccccatatcacagtgtagtgtgatatttgacattcgtgatcatctagagatgtacagaaaaggtgaatctgtgttctgtatattctgcctaaggcaaagaaatgtttagctctctttaaaatagttccataattttttctaaaaagctttgcttgaaaactgtaagcttcccatatctggagcatttcactttaaatatttggataaatatgttatcttcttacttggacatttcatgtgtttagggattgtcttctaaattcttcctaattcatatagctgctaacacttcccgcagagctaaaccattacagatatgaaataaagacctattgatttgacttacttttacttgtaaaaccttctgagtgttataacctcatttaatctttcagcatttacagtttcaagagtttgtgtcacaattagaagaattcagctgcacctccaagtgacagcagttgctctggttggtgggtgatctcaggaggcttgagaattgctttgtctgtgagggaagtaagacattttcagagccccactttagaaggtgtgaactggctagataatgaaccccagggctaacgctgctatagcagtgggaaggaggtgatgggttttcagtttggacctcaaacatcaataccctcctggtacggggaggaacagagtccctcctttacttctccattagaaagaatgagatggcaagacaatgaaacaggcaaagtgaacagagatgcaagacaaaattcaggtgagagagccagagcatcactcagccattcctgacatgtaaaacaggcaactagaaatttgcagaaaggaagcgaagtctccataaagatgtttttaaagtgagcttgaagtatttggagacaattcagtgttacataaaatctgcaaatctctggataaagaagcagagatcccagcatgggacaaatggagcctcaaaagtgggaagaagacagagaagaccagggcagaatgcatctcttcctttctcttggctttcctggataaggactgcatcattcctgtggaaggacaggccatcagctccgaaacactgtatgtattttccagtatatactgctagctgtgtgatgttgggaaaatttgttaccctgtctaacccccacttccctcatctgtaaaatggaaataatgatagtacctacctatctcataggtggcaactacaaggggcagcacactcagggaattaaggaagtttcagtgaacatcaactttatgaacacagtgttcataaaggcaggtcagtgcagtggtttgggagccaggagaagcacgtgggccggagtgtgcctgcaggagacaaggtcagagatgttgctaataatggagaataaaggatgcattctcattactgaccttggagtcgttcattcattcccagaatgtgttttgtcagcttactaaaacactaagttaaataatcccaggttttgtttatt

SEQ ID NO: 1628 - DNA, 2261 bp, Homo sapiens; identical to SEQ ID NO: 1627

SEQ ID NO: 1629 - DNA, 2375 bp, Homo sapiens
attaaattggaactttggaatcttaatagaaaaccaactgacttggcttggttttcaggtgctggttccatggctcttcctgagccgaaaataaggaaactccatagaccttgtccactggaactcgttcccatctaccctccactctatccagccccatgaggacaaggaacatgattggttttgctcactgccgtatcttccgtacctagtacgtaacaggacatcaataaatattagttgaatggaagattaaatcaacaaaatgggtgatggatctctgcagtaagtggaagagttcttcatggcccccaaggttatatccatctagaacttcagcacgtaatttcatctggaaatagtgcctttgcggatataagttaggtaaaactgaagatgagatcatactggattaggatgggatctaaatccaatgaaaatgtcttcataaaaaacaggaaagaacccatagaaacacaaggaagaaggtcatgtgaagatggaggcagagattggagggatgcagccaccggcccaggaatgccagcagccacccagaagctggaaggaaatgagggattctctcctagaacctttagagagaacatggtcctgtgaacagcttgattttggacttgcccatagcttgtatactcttactttggatacaattttatccaaacttggctaaacagtttctcagcctatggaaaatttaaaatggagaagattcaactcgattcttacagattcaaagcaagaaaatgatgggaacataggaggagaccaagaaagcctataaaaagcaaaaatatgaagtgaacattgtggtagctttaagatgtttagtgtagctgcaggcaccctatacacatgaaaacccccaaggggaatccccatatcacagtgtagtgtgatatttgacattcgtgatcatctagagatgtacagaaaaggtgaatctgtgttctgtatattctgcctaaggcaaagaaatgtttagctctctttaaaatagttccataattttttctaaaaagctttgcttgaaaactgtaagcttcccatatctggagcatttcactttaaatatttggataaatatgttatcttcttacttggacatttcatgtgtttagggattgtcttctaaattcttcctaattcatatagctgctaacacttcccgcagagctaaaccattacagatatgaaataaagacctattgatttgacttacttttacttgtaaaaccttctgagtgttataacctcatttaatctttcagcatttacagtttcaagagtttgtgtcacaattagaagaattcagctgcacctccaagtgacagcagttgctctggttggtgggtgatctcaggaggcttgagaattgctttgtctgtgagggaagtaagacattttcagagccccactttagaaggtgtgaactggctagataatgaaccccagggctaacgctgctatagcagtgggaaggaggtgatgggttttcagtttggacctcaaacatcaataccctcctggtacggggaggaacagagtccctcctttacttctccattagaaagaatgagatggcaagacaatgaaacaggcaaagtgaacagagatgcaagacaaaattcaggtgagagagccagagcatcactcagccattcctgacatgtaaaacaggcaactagaaatttgcagaaaggaagcgaagtctccataaagatgtttttaaagtgagcttgaagtatttggagacaattcagtgttacataaaatctgcaaatctctggataaagaagcagagatcccagcatgggacaaatggagcctcaaaagtgggaagaagacagagaagaccagggcagaatgcatctcttcctttctcttggctttcctggataaggactgcatcattcctgtggaaggacaggccatcagctccgaaacactgtatgtattttccagtatatactgctagctgtgtgatgttgggaaaatttgttaccctgtctaacccccacttccctcatctgtaaaatggaaataatgatagtacctacctatctcataggtggcaactacaaggggcagcacactcagggaattaaggaagtttcagtgaacatcaactttatgaacacagtgttcataaaggcaggtcagtgcagtggtttgggagccaggagaagcacgtgggccggagtgtgcctgcaggagacaaggtcagagatgttgctaataatggagaataaaggatgcattctcattactgaccttggagtcgttcattcattcccagaatgtgttttgtcagcttactaaaacactaagttaaataatcccaggttttgtttatt

SEQ ID NO: 1630 - DNA, 2375 bp, Homo sapiens; identical to SEQ ID NO: 1629

SEQ ID NO: 1631 - DNA, 2477 bp, Homo sapiens
cccagctgcctggctgccctcagcttcccaaagctcaaataagaggggccggcggcgcggggaagaggaggagccaggaggctcggccgctccattcactcagcagcccaagcccggccaggcagcgcgcgctgctccttgggggcgccctcgcagctggggtgagggcgggtccgagggagcgtccctctcggagacaccctcctcttcaacccaacacgcgctctcagctggccggtgtggcacaaccctccccccacctccccttcttggccttcgccagtgtgggagcctcgtctcactggagagtccgttcaggctctgtcactatttcccattggccaaacgctactggaagtggaaggctaagaagcccgatggtgcaatccatacacgtcagcctctggggccagagtgggatgaaaaaaggctcatgatggagcccgagttatatggcaggagatgatttccacggtctgtgaacactgaagatgagactggcttggggccacgtgccaaactgcacagccagtaagacctgcttccatcgacccacagcagctctgactttttttttttaacaatagagaagaaactaccacagggaagagagagaacaatggcattttgacaaatggaacaaagatagagtgtgactgacaattcaggtcagaaggaaaattaaagcacaggaagactgatgttggtcggcctccttgccaagaagcaaaaactcagggggaggcatccagccacatgcgaactggctcaacactggccattttgtttgagcaattttgttggatgttttctacaaaagagcactttttctcggacttcaaacattcttatatgcaggatcgacaccacacactgccatcatcccctggagtagtatccttgagacctgaggaggggaaaactggagggacgttgtgggactccattgagaaatgtggtcctttgtctccctggagatctttgaggacggttcagataaagttgctgccagtggaagcagctaggctcagaaacctccagttgccctttctagacttgtaatcctctgaaaaatggaaattaggaagcgttcatttatgaccttgaaaaaaatcgtttacaaaagtatattatatcactaaaatgagctggaaaaagggtttatgtgaaagttcatgtgagaaacacagctattagcacgcatgccattccccaccttgacctcagcaggaatgtgtaaattgtaacatatggaatgtaagccctgtcgagatgtttcataaatctgcctggcaatgagcatcacaaggccctgcatgagaacaggccccagaaatggagagacagtgagtattgtgcctgacaacttctaattttaataagtccagactgacgattgaaaatttccacataatgttctttaataatattgattatttcctgacaaaggggcactttttcatggaactcaacccaggtaatccatccatccatccatccatccatccatccattcaagatatatctactgaaggcctacaatattgcaggtggcatgctgggcactgcagatacaatggaggacaggagggatattgtgttgcccctgtagggtttactatatgtaggaaaacagatatgaaacaaataatagagtttgagaccagcctggccaacatggtgaaaccctgtctctactaaaaatacaaaaattagctgagcgtggtggacgggcacctgtaatcccagatactcgggaggctgaggcaggggaatcacttgaacccgggaggcagagtttgcagtgagccaggattgcaccattgcactctagcctgggcgacaagaactaaactctgtcttccaaaaaataatgataataattttataattgcaattttgatcaatgctgtaaaggaaaatagtagcttctactgatagtagcactctgccaaagtttctacatgcatgatctcatttaattctcataacaattctctgcagtaggtactaccaatagctccattttagacatgaatagagacatggaggtttacatgtatcacccaaggtcacgcagctctggagtggtggagttagaatacaaagtcagtctgagtccccatcccaagttcctgataccataccatttttttttttatataacctgggtgaggaagtgggtgctgatttagatttgaagattaaagaaaatatctttcaggatgagattttaggccaagcctcaaggataagtaggtattaaccaggcaaaataaagtagcaggagtattccagaattggggaattgcatgtcaaaggccctgaggcaggaaggtgggtggccgtgggtgttcatggggaggccagagtgacaggattgggtggcgtgtggggcaaggctggagaggcagaaaagagtcagagtaggtggggccttgtaaatcatgttaagatatcttgaactaaatcctgac

SEQ ID NO: 1632 - DNA, 1860 bp, Homo sapiens
agattttttcccttctggccttaaaagaagctgtgtatacagctttacataactttccctttaaacttaaacctttatggtagtcccattcaaccacttgacagctccattaatctatttttactattaaacatgccattttacaagatatttattccacttggtcgtcatccaaacgctttttgacattactgccctgggagtgaactgcttaaactcgctgccctcataaacagaaaatcaccttttgactcaaatcttgaagagctctcagaacctcacccccttcacttctacaggcattaatttctgccatatataaaggagagagtgagtaagtgtgtgtgtgtgtggttttaagagggtaattgtgggaggtctgggcaattcaagaagtgctgggggaaggaatcctctcctctaactccattctgctcatcggggcctgcctgagacctggagatctggtaacttaacagagagaaagtgatcagagagcagacaaacaaaaggccaccgcgaaacagttgaaggtagagacctactggctttgaagactatcaatcaggtggaaacctgaacaaatcacaatttggcttcctcatcaagttttctccccagcctgacaaaccctcctccgccgccgcctccacctcctcctccgcctcccaggctcagcacagctacgaggccaaagggaccgtcctgtgatgcctgctggtttccaactttccgctcatcttcgtctccgcagcctcctgcaaagcggctgggaaaagggcaagtttgcaaagccgaggatacaagtcctggggaagccacaaagaagctgcaacaccaacaaagattaacctcttgtggggcagacgaaaagcgccagctgccgttcaggggggcgaacgtgggctcgggctggcagaggctccggccagctggcagcggacagcagggccgggggtcccgcggccgccctcggccccccgccccgcgcggactccccctgcacctgagcgggggtgaggacagcgccgcgctccggccctgcccccgccaggtagctcggctgccgcccgcgctgcgcgcccgctgcctgcagccgccgggagcgacgagagcagaggcagcctcggcccacggcgtcatgcttcctgccaccacattacggcgaatcgtcaccgggagaggggagcgaggggagagggggagggaggggagcagacacacgcagccccccgcctgccaaaacgcgcggagacggggccacgtcccggtggagtccccgcgggacctgccccgtttgcacaaagcgccgcagtttggccaagaagggagggagacggccacgaaataaataaataaaaacagtcgggtctacgtaacgccctgtcgaaagcggacgccatatttttttgtggcttatgtcgacatagggaaacgtagacatgtttttcctcctcctcctcctcctcctcgctctggctcccatttatccaaacttgtaatcaaaactcttaaaaaaaaaatcttcttccctctctgtatccgctcatttcctcccacccgcaaaaagagcctgcacacccccccccttccgtaccccccttccaatcacaaacccggccaagtcccattaacaacacattttcgggagccgcggcggcgacggcggcggtgggaaagttgggctggagtggccggcgcccggcgtgcggggtttggggccggcggcgccggctggggggctccgcgccgaggcgaagtttcttacctgcgctggggctgtgaacgcggggacccgggctgggaacgcggagacgcggcacgggcgttccaaaatggaactctgctggctccccccac

SEQ ID NO: 1633 - DNA, 11636 bp, Homo sapiens
tcctccctcgcttttggagctccgacctcagcttcgcctgcgagctgggttgtgtaaaggctggtcattttggggcgcttaggggtgggtgccggggggcgcgctttccctcgtgaaggtcgctccaggagtcatgcgtacattcgttcattttgctctggacgcactgatgttcccggctcgccgccgtgccgcagtcacgaggctctccgaacgcctttcactgtgtttctgtttacattcgcgtctgcaagacccggcggcgcgaccgaggcccgaacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttgatttgtagcttgtgacagaccccaagccagaagagtcaggtaagcagtgcctgcactcctgacccatggcaactggcatgataaatgttttttcccatgaagctatgttttagagtaatttgttttgcagcaatagataactaattcactaggtaaaggttatatccattgtaatctttcaacttttctgtagatttgcagttttatgtgctgacaggtgaacacactgctgttggcaccatggccactgcatactacgtgctgtcatgctaacatttgatgctgcagcagtaagttatttctcaattgattctgagtctctggttcactagcaggatcatgtgcccaagctccagcttccaaggtgtgaggccagaaagtacctgaccctctcagcttccacagtgggaattgtggccctgtctctcaaatagggaggtattcagacactgagtagatgaaaaaaaaaaaagaaaagaaaaaaaaaggtgggggggggcggttggtaagaaaagaaaaaggaaaagaggggggagaaagtgaaaagaagagaaacttccacaaaggagcccctaagacccctaagtcatggacttgtacaggcattttgaggcttttataagggggcagtgttagaaacgcttgttccctggtgctgcaaagaagtagctctcgagttggagagaagtaaaagctcgaaccggcctgggaaggaccttacctagtgatcctaactactgaaactgcagtctggacagcagaaaaaggattgacccatcacacccgagtcaggaaagtgccaccccctccagagtcatgggccacggtcccaggggaaaaccctaccaaactaaagctaagaaaaatttaactctctttcatccatttgattatgacttctttcctcgctctattgctgaccacctagttattaatgtaaccaagtcaattttgcctcaaactattacatttgatgcttgccttgttataccctatggagacttgccaagtcagaggcaactctccacttcaggaaagtatctttatccttcctagcgctctgcagactaaaaatctgttaactgggataaattagtttgagaagagtttgacgaagattccagtataaactggaaatcttgtcctcctagagcagagcttctctgccaaagttggtccaatgctctataaaatattaaagagcaaggatcggctgccccaactagtacttgcagtttcttaaaaccatatattcattttactaaaggagttacccctccccattgtcagctagaccaatgtaactgaggacagatgaccatccctgctccccagagttcttctatggcataggagcagaagtctcaggatcctttgaaatgcacttcattgccttgtcacctcctgcacccccttctccctctcctaacttctctgctaaccaaacctcttgttatctacccaatgatgaaaccaaagtagttgtagaggttaaagatttaaaacaaactgtagcaactgaaacagagtatcaggacgcaaatgcttggctggaatggattaaatattctgttcgcacgcttaacaaaagcgactgttaactcttatgcgacaggcaggccagagacccagcttgtccgctttccagttgggtggtcctctcatggactgggcatgagctgtatggtagctctcttccacaaccccacagcctggggcgatgagtcatgcaagactctttctctgcggttcactgaggttaagagccctgtgggtcagcccccgagggccatgctgccaccagcccctgatgttaacttcacctcgtgcctttctctgcggggggtggggggggagttagcattccttgaagacttaacagggtgcagtgaaaccaagccttttcaagagcttaccaatcagtctgcccttgttcatctccaagcagatgtgtggtggtattgcaaggaactattgctgggtactctgctctgccaagtaattagagcagcacttgtgccctagtccaactggccatcccttttaccctagcattccgtcaacacgaagaaaaaaaaaaagagaaaagcgtaaaaaaaagaagtgcctcacatgggtcctttgactcccatgtttatataaatgctattagacctccacgaggagtaccagatgaatttaaagcccgagatcaaatagctgcagaatttaagtcaatattttgatgggtgacaattaataagaacatagattaggtaaattacatttattacaaccaacagcggtttattaactacattagagatgctgttaaaggaataggtgagcgattaggggctactagccagatggcttgggaaaatagaagagccttagacacggtattagcagaaagaggagtttgcgtcatgattaaaactcaaggttgtaccttcatcccaaacaccaccgcccctgatggacgtataacaaaggcattgcaaggtctaaccgctctgtctagtgagttagccaaaaacccaggggtaaatgatccctttacaaggtggctagaaaaatggtttggtaaatggaaaggaatcatagcctcgattcttacttctctcgcagccgtagtaggtgtactcattcttgttgggtgttgtgtcataccatgcatctgtgggctggtgtacaaactcatacaggcagcacttactaaaacctcccttaattctcctccaccttattcagagaagctttttcttttagagaatcaaacagaacagctaagccaagacatgttaaggaagtttgaagagaaagaactataaaaattcaagaagggggattgttaaatatagtagaccccaagtttctcttcaaagaatcagtatgtcagtatgttcagttctcttattctttgattctccattttaaagtttaacttcctggttctcttcacccctttgcttctagtttcagtaaacaactttctcgcgagtcctaatcagtagttcacatctgttcccctggtcacctgctccatcctgactcatcctggtcacctgctgtgacctaagtcacctttagttacctgttcctaaccgtccttcctgccacactactcaccctgccactctggctcatacctttgctctctttaaaatagccagttggaattagcttagactgtgcggtccaaccctagccaatagggaaacaacacagcagtaggggctacctgcctcaggaataagaactccttgcccttccctgtccaggtgtgctgttgccattactccattcgcgagttacactcttctatagaagtaaaaattgccttgctgagaaaattaaatttatgtttgagtgctgtttcttcgtggcactggggaacaagcatttctaacagcagtgtagaggaaagaacttggctgggaccttaccctcctgcctcactgatggaatgagacatctgcagaggaagctgatttggggtaaagacaatgagttgatttggggcatgaaagtgaaagtaagattcccagatggtgctgccttttgtctttttttaatttttattttttgagacggagtcttgctctgtcaccgaggctggagagcagtggcatgttctcggttcactgcaatctccacctacagggtttaagtgattctcctgcctcagcctcccgagtagctgagactacaggtgagcaccactacacccagctaattttttgtatttttagtagaggctgggtttcaccgtgttagccaggatggtctcaatctcctgacctcgtgatctgccagcctcggcctcccaaagtgctgggattacaggcatgagcaccgcgcccggccctgccttttctcttgttggagacatggagctcaagttaggaagtcagggatggagatgaagatgggatggtcgatcatatagatgtaatgcttaaagctacagacagggaagagatttccataggcatggaagtgtaaagctggaaaagccaagggcagttgctgtaacactattccttcagccgttttcaccagaactttggaaacttgcatctggaatgagtaggtgaagtgaattagattttccaactgtatggtgcaggctgcatcaacatctatgtgcaacccacagacttcatgtccaacattcacatcttatgacattgtctcattgttaagcatcttgaggtaggataactttttgagctacaaatgtggaatttcctcttgtatttccccacttttcctcctcaggcaggcttcgttttactttcctcaggagctggcaggctgaaggcagaaattgcctgcaaaacacttcttttcctggctttgttttcaaaagcctaagtcccctgatgtgtctgagtgtacagtgtactggagggagaggagacaggaagcagctctgacggaaaccctagcaggcagtggtggatttcccccagggtaaaagattgctccaagccaggggaggggtccagggtcctgcaatagctgggacctgtgctctgccctctgacaacaccccaggggagtggtcagatctcagagaggaacagttacagggctcccagcctcaccaaatatccatatgtcccaagggtggcgtgaaagctagtgggctgttagaactgagggaaccagataaattgggccctggtggccttgacagtgaccagtaatgatctataactgcagggtcttcctaggaccttgaaggatggcctgaagtagaaaatcctgttgggtttggagtagaaattaagttggtttaaatttattattattattatttgtttttcttttttccttttttttgaggcagagtctcggtctgttgcccaggctggagtgcagtggtgcgatctctgctcactgcagcctctgccgcctgggttcaagcaattctcctgcatcagccttctgagtagctgggattacaggtgcgcgccaccacgcctggctaatttttgtgtttttagtagagacggggtttcaccatgttggccaggctggtctcaaactcctgaccttgtgatccatccgcctcggcctcccaaagtgctgggattacaggcatgagccaccactcccggccttattatttgttttgtttagagagggggtcttgctctgtcccaggctggagtgcagtggcatgatgatagctcactgcagcttcaaactcctgggctcaagcgatccttctgccttagcttaggactacaggtgtatgccaccatgcctggctattataatttaatttaatttaatttttttttttttttagacatggggtcttactatgttgcccaggttgatcttagacttctggcctcaagcagtcctccctccttggcctcccacaggcctgggattacagatgggagctaccattcccagcctcgtaatggaaatttaaaaattttataaggaatagctatactacatcaataatactgcctgaccatctttgtacatataacttttttatatacaggaattttttttttaaagatagattcacagaagtagaactactgattgaaagggtatagacatttttaagcatcttgatacatgtggcttaaatgccacatgtatggcctaaactgattgagtcttttcaggtttggattttaaaactagaaccctctcttcagtggagtgggatgggggaaacactggaaacctcatgggaagcagttgcaatatttcatatgaaatgcgaggaagggccagactgagattatggccatggggagagagaaagggataaaatcccctatcattcaggaggtgctatcaataacccatctctgcatatgggtgaagaagtgaaggggaggcaacaatcaagatccccttactaatttccagttgaaaatcgagtagatgaaaatcctatcaactaagaggcaatgtggcttggtggtaaatgcctgtgttttggatctaactgaccaagttcaaattccaactgtcccaactaattagctgcatggccttgggcaggttgttaaaactctctgagcgcatatgcctagatttccttatttgtgaaatgaggatagtagcgtttatgcctaccaaagaactgtaaggattaaatgtgaatttttttttttttttgagacagagtctcgctctgtcgcccaggctgcagtgcagtagcatgatctcggctcactgcagcctccacctcccggattcaagcaattcccctgcctcagcctcccaaatagctggcactacaggaaagcactaccacgcccagatgatttctgaatttttagtagagacggggtttcaccatgttggccatgctggtcttgaactcctggcctcaagcgatcctccccccttggcctcccacagtgcccggccataagtgtgaaaatgtctttaaccgcctggcccattgggactttgaagaaattaatgaaaacagataatactaatagaagaggatgtacagagggttaaagaatatatttggtttgagatccatttgtttaagatgcatgaaatctcacgaaatggactttatcttggtatgcttttatttttttaattttaactttgaaataatttttcctttatacttctttctgtacactgctgctttcatttttttttaagagacctaaaggtatgatagggacaaggaaagagagggtggtgatcctgttgcccttgtgggtaaggactgcggaggcagtggtgcagttctcaagcatgaccacaaggtggagtccgtagtaagtggaaatggtttaccctgcgtgggaggagactgggcaggatcctggagcagattcggtggcagccgcagagccctcggtccagttctgcaggcgagtcccatctagcctcttctgccttttggtgactgacttttcacgatgtaaagttaatcacagttacacataacagccaccacacactcccaggaccccaaagaaaccatgaagaaaataatcacaagcataacagttcaccttttggtggttctccattgccagttgcatgagctcccaactccttgactttcagttctgggacttccagtctatgagaccccacttacctttctggaatcttctcctaatacttttctacctggcccataggctccagtcaactgcctactcacggatccccaaaaatgcccctcattttcaccttgccttttgcttgttctgttccctgtttctggaaagtgatttctccatttctgcttattgaaacctcagtaatactcgaagaactcgttacatctgtgagggctctttatgtttcaagtaacacccggacaataaagggaatctaatggctcctatactgagaaatatcgaggtatctagttagcttcaggtgacgtctgttcagcagcttggacagcaccacaggtgacttggttttactccatttttgtcttctgccttttgctgtgtcggcttgcgttcagaacccctagtggctctttcagtcctcccctagcaggtaggtgtgctccgtatcttccttctgcttcttaacgtctctattcttctcctccctgctcagtgcccttggaggatgacctggcttagatttgcgggcttccttgccttctgtcttccacttgggtttggccagtgaggagcaccagcatgggctccacggatggctgggctattaattaaatctctgtcttccatggtgcacagcacaggctgccttcatccctcatctatgaggtgacagtctccatatctctatctctgcattccagcaaccaccctctgtaggcctagggtggtaatggccccaagatatttcattattccttaagttttccctacacatgctcacacttttgcaaactgtccatgtttttttttttttttaaatagagatagggtctcactctgtcacccaggctggagatcatagttcactgtggcctcgaactcctgggttcaagagatcctcccgcctcagcctcctaagtagctgggattacaggtgtgcaccgccaacagtccacttactaactgctcctcaaattgtccagtttgagtgtgccatctgcttcctgctgggaccttgactgatatagcaatcccgaatcacacatcttcatactacactgctcagtggtagaaaggcgggagaaagaggttctcttttggccattttaacaggaaagagagtatgcttcttgcccggcaaacaacttttaaattcttttttattttattttatttttttgagacggagcctcgccctgtcatccaggctggagtgcagtggtgtgatctcagctctctgcaacctccccctccgggttcaagccattttccggcctcagtctcctgagtagctgggattacaggtgcacgccaccacgcccagctgattttttctattattagtagagatgggatttcaccatgttggccaggctggttttgaactcctgacctcaagtgatctgcccgtctcagcctctcgaagtgctgggattacaggcgtgagccactgtgcctggccccagcaaacatcttgattatttttggcctcagttgtaatctgcctaaactaataagagactttcttggtgccaagggtgggtcatttcaagccaaaccccatgactgaaataggcaaagggtggttcccccagaacagaatcaagatgcagcagtgctaactggaagaaggagaaaattcagcaccttcttcccaaatgccatctctttctttgaagcttgtccttattcccccaagaggatacaacatgatggccaacaagatggtgtagttcccaagatggagattatagtgtagttggggaaacaattatttaatttaactttttcttttttagggtctcactctgacacccaagctggagttcagtggcaccatctcagctcactttagcctcgacctcccaggctcaagtgatcctcccgccttagcctcccgagtaactgggactacaggtctgcaccaccacacttggctaatttgtaattttttttatagagacaggatctcactatgttgcccaggctggtctcaaactcctggacacaagtaatcctcctgcctcagcctcccaaagtactgggattacaggcatgagccactgcacccaccatggggagacacttaaatacacaaagaataatgatctattacattaagtactgggaaggaaacaaatgaggtgctgagggaagaaaaacatggatgacctattaaagatcatgtgaccagggaaggctcccctgaggaggtgacatttaagctgaggctggaaagatgagaaagagacaacaagtgatgggaaaggacaggaattccaggcattctttttatttgtttgtttgtttgtttgagacagaatcttgctgtgtcgcccaggctggagtgcagtggcacaatcttggctcactgcaacctccacctccaggttcaagcaattctcctacctcggcctccagagtggctgggattacaggcacgcaccactatgcccaactaatttttgtattttcggtagagacgggggttccccatgttggtcaggctggtctcgaactcctgacctcaagtgatccacccaccttggcctcacaaagtgctggaattacaggaatgggccaccatgcccagctgaattccaggcattctgaggtgcactggctagagaatgaatagataccaaatgtggaggcacttaggtgaggccactgtggctgaagtgaggtgggcaaagggtagagccatctgggtgaggcaggagaggcaggcggggcttcctggaccagtgtttggattccagctgggtgcagagaagagaccctgaaggatattcagcaggggtgaaaatctgatttctgttttaagatcaccctggaaatagaggcactcatttggaagatgctgtgttgtctaggtgacagatggcagagacgtagagagggtgccagctgtggagatggagaaaaccaaacaaatcgagctgtattttacaggtagaatcagcatgatgattagcagctggaacggggtggttgggaggtaaagaagagtgtagagtaactcctcagttgctggtttgattattgagttgtggtgatgggggagggatggcaatcaggaggtcagcggccagaggccacccagcatctctgggtcaagaaattaaccaaatcagagatactcagcatgggcttgaggaagatgtgttttgacatcattttctccaaatctctcgaagtttgtgacaagtctttttctgctacactttcttctagttcctgttcacagttttgacctcttcctccattttctctgatgtttagctgatttttaccgtctgttccatcatccagttctccaaggtgttcattttgacatccagcctgacacttccttcgcacttttgtggcacctctagcactgccacttgcttggtttttgacagctggtaccatcaacaaacaaatgctgtagctgatgcatgttgtaaaagtctgcatgaactctgttcttcagtgctgcaatttctgatgtgaacagcaccatcagctttacacagaacaatactcagtgtggcatatgtacttttattatgcaaaagagcggatggcaggacgtttgaatatagggaagttgaaagtcacctggaaatgcttcatgcaaatagcactaactaggaagagaaggcacctgtgctaagaaagggatgtgaagcggccagtccaggatttgcagccttgtttgtgtgttactatagaatcgcctgggctcttttaaaaaatatttatttatttatttatttatttatttatttagagacggagtctctctcttgcccaggctggagcgcagtggcgcaatctcagctcactgcaacctctgcctccagggttcaagcgattctcctgcctcagcctcctgagtagctgggattacaggcgagtgccaccatgcctggctaattttttttttatctttagtagaggtggggcttcactatgttggccaggctggtcttgaactcctgacctcaggtgatccgcctgcctcagcctctcaaagtgctgggattacaggtgtgag

SEQ ID NO: 1634 - DNA, 11636 bp, Homo sapiens; identical to SEQ ID NO: 1633

SEQ ID NO: 1635 - DNA, 4836 bp, Homo sapiens
ttttgcattccctgaaacaaacgacactatggtgtattttcttttggggggcagtaaataaaagtcttttatgttgacaatgataatattatattctacaatctatttgcatttctctatcctgtggattttattgcttagtataaatccccaggctgaggtgcattaagcttcactcagagagaaacaatgcattttatcatagggccggacagctatatgcacaagatgctacctgcagagattggtttttgcccagatgtgcaggagagatgcacagagaggaagaaatgcatacatgtgtgcaggttttggcgtgtgcacaagaagcctggaaggattttctttggatctacagtcaaaatggatttccgagaggaagctgtctgaaaacacacctcttccctgtgctacatacggtcccatctctgccagccaggttgtcaggaaagtgatcagcactggcttcaactctggctagagctctttggccaatgtgatgggcagaaaactggaatgaggacagaaaagcacctcagaggtttgaagagtctagtctctcaccaccttgctcgctccgagtttgcttctgcatggaaggggaagatggactagagctgatacctcctgcaccctggtgaagaaatgcaccctgaggccagaaaatagtacaaacccatctggctgcaacagtccagcagcatgaagatcaaagtcacgtagtagagccagagagaaatttgccctgggcctaatattcatgaagcctttccaattcagactcggtattattgccaagtcggtgtgtttgggagaaatcagaagccaacacactagaaaagttgcaagagattcctaggggaacccacaaattcagttccttgccagaaacctgctcctccagatgaatctagtgcatcagatgggctcagaagcacaggtggcgcaggcagacctctactgagaagaacaacagtggaaggcagatgaaactcacattttggagtctgagagccatgcgggcccaccccagttacgtctacccctggtcggtgaccagagaatcctttagcagcaacagcagtgatgtttatttcactggtatgtataaagcgactgattgaaaacaagctgtatgcccaacaacttggaactggttaaatgatttttggttcagccgcacagtggaatatcatgcggccattaagaataaataaaaaatcctatactttccatgttcaactttagactgcaaacaactgaaaaaacaccttcataattaggcttcctcagattagaacgtgaagtcaaatcaacgtgtgtcagaaagttaacaacagctaactgtttgttgtggtgttctgagtaacttgtattatttttcagtttttttcccattcctaatgtgcaaatgtactatttttattgtaaaaaaaaatacatgtttgtaaagagcaataacataaatctctgcataggcaaattgaaaggaaatcagacaaaatgataccttttggtagtggaattctaaatcatttttttcttcattagagtttctgaattttctgcatttgatatgtttacctttataaagggtcaatcatatttaagatgattttttaaaagacaagtggacagggaaagagaggtctgctgttgcaaaaccaaagctggaggctctccgaagcccacttatgttagtcaattgatatttcatgaaactctagaatgtgcaaatcactttccacggggattgggggggtgagaaatacagagatgaaggagatgcaaacactttaatcaaagaaatccgtctggttgggaagagaaggttctgcattatataagttgcaaggtcttatccaagaggttagtctgtcaagagtaatagcaataattacacaacaatatgtcagagaggctgggagctccagcttcaaagccaccttgcctggggagaaacttaaccatattgggcctgagcctcagttacctacctcttctgtaaatgtaaactacctcttggggtccttgtgaggattaaatgaaacttgagcctaaaggggctgagctaggtgctttgcaaataacccaaccttagcatgaggcacgttatcatcattacggctgtggtgtttgtggtcacctatctgcaagtcacgctttcatagatatggctgagctgggatttgaacccacattgatctaattccaaagccaatgattccaccccaaccagacactgcatttactctctatgcctaactgaaatttgttctaaacctcaccctaaggtcttgccagaaagaaaagctaaattttcattaaaagatgaaaggagaaatgaatctgtttcaaaggacatgagaggaagaaggaaatatcccttcatgaaggattttgcaactttgtccatgcttctgcagggtgtaaaagtaaaaatcctatacttcccatattcaacgttagattttaaacaactgaacaagcactttcacaattagccttcctcagattggaatgcgaagtcaagccaacgtgtacctcttactgcagaagatttctgcactgtgaatgtgataggatttgcctccttaaccagagggtgctggtttttcctggctggagggtagaaggtcatgaatagaggacaaagcacagggaaggggcagcatgtcgggaagagccccaaggatctcagtatgaaaataaagaggtgtgagccaactgcccataggtttgggctatgagtctggggaaactgtttcaaaatcaatggaggcccaaaggcagagggaaaattctgtgtatggacttccatgtcattcagaaatgttaactccttgaaaagagttaatatatttttttcttttttaaacatttcaataggtttttggggaacaggtggtgtttggttccgtgggtaagttctttagtggtgatttctgagattttggtgcacccatcacctgagcagtgtacattctacccattgtgtagtcttttatctttcactcccctcccacttagaataatgttctccaattccatccaggttgctgcgaaggacattatttcattcctttttatggctgagttgcattccatggtgtatatatatataccacaatgtctgtatccactcattgattgatgggtatgcaggctggttccatacttttccaattgcgaattgtgctgctataaacatccatgagcaagtatctttttggtataatgatatgttttcctctgagtggatacccagtagtgggattgctggatcaaatggtagttctacttttagctccttaagtaatctccacactgtttttcatagtggtggtactagtttacatttccaccggcaatgtaaaagtgtttcttcctgtccctctggtcatctgtttttttaagggatctacctaaactcaaccataacccattccatccacctcatcttgcctcaagctaagaaataggagtgcagagaagaaaacagtacagataagaatgctagaaggttgtgtgtttgaataagaaggaacatggatcaggtttcaagtacagtacctgaggcaggtatgaggtagtagctaatggggtgaggtaggcagaaaaggcttctaaagaagcaggtacttgagttgggtcttcaaggccatagtgagtggtttcccggtggatctgagaaaggaaggtgagtttagagaaagggaagagcccgcagtgaggcatgaaaatgtacactgtgccttcagcgagcttggtgggtggcaatgtctggatccaagtgcgtgtggaggagactttgcacaataaggccactaggcaggtaggacggcccccagagggttttggctgacaagctgagggacatgctataagggtaggggccaggggaagagatggctccctggcagtgggtcccctgtgtgctcggcagctcatggataacagaggataacaggcctgtacctccatattgcccaacatgttatcacatcttcagtttggagagaagaattaaattcgtctaagtttataatttaccagatgactttggataagcacatatttggaacctcagataattcatccattcatttgctcattcagaacagttcttgcgcatcactttatattcagtgctgctgaagtttctttgggggctacacaggttagtaaggcttggttttcatctcaggaaccttatagccagaatgagggagaggtgagtactaactccacagtgttatcccagtcgctactcatttcccttaccaccacgccttcaaacacttcagtgtactttcagctctcaggaaaaatgcaaactttcatctgggcctaagaatctctatatgaactacccctgctcacctccggagaggcatccccttccaccaccctcccctccttcttctctatcctcattgctcctttcaatggtcctgacaggatccctttcagccacaggcccttagcaaatgctgctctcacggcccaagtcatcttccctggttcatgcctacttcggattaaagttacccctccggagagtgttcccgatcaatctgaattgaccaagtccttattacacactctcaaactccatgagatgtccttcatagctctcatcccagttataattagtttgcatttatttacacaatggctgtattaatttctgtattctccaccagaatgagagcttcatgagagccaggatgtgtgttttctcaaaatctgctttattgtggtctaatttgtgtataataaacacacccatgttaggtgtacccatcaatgaatttttagaaatttattaaaaat

SEQ ID NO: 1636 - DNA, 4836 bp, Homo sapiens; identical to SEQ ID NO: 1635

SEQ ID NO: 1637 - DNA, 837 bp, Homo sapiens
gtgtcttttggctgtgtaaatgtcttcttttgagaagtgtctgttcatatccttcgcccacttgttgatggggttgtttgtttttttcttgtaaatttgtttgagttcattgtagattctggatattagccctttgtcagatgagtagatgcaaaaattttctcccattctgtaggttgcctgttcactctgatggtagtttcttttgctgtgcagaagctctttagtttaattagatcccatttgtcaattttggcatttgttgccattgcttttggtgttttagacatgaagtccttgcccatgcctatgtcctgaatggtgttgcctaggttttcttctagggtttttatggttttaggtctaacatttaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacattgccaagtcagtcctaagccaaaagaacaaagctggaggcatcacgctacctgacttcaaactatactacaaggctacagtaaccaaaacagcatggtactggtaccaaaacagagatatagaccctcagaaataatgccacatatctacaactatctgatctttgacaaacctgacaaaaacaagaaatggggaaaggattccctatttagtaaatggtgctgggaaaactggctagccatatgtagaaagctgaaaatggatcccttccttac

SEQ ID NO: 1638 - DNA, 837 bp, Homo sapiens; identical to SEQ ID NO: 1637

SEQ ID NO: 1639 - DNA, 1505 bp, Homo sapiens
atcctactttgttggatccgaagcaactggatccacacactcaaagacactatctttaagccttacatgccgtatggagataagccaggggcatatggagaatccaccctactcagaggctcgaagccagaggattcccaagcgccagtcaacactaacagggcagctccaagtcatgagtgtgcagttgggctcaaaccgtacagaagtcatttccaggatgttatccttactcttctaggagcccacatcgcccagatgaggaaggccaccgctgccgccaacgccgactaccgtgagcagcttcctgctcccctgtcgtcgcctctgcggtcggggcactttccccaaagcgctggccgcaggaatctttccccttaaatcggggaagaagtttctctaatccattttcgcggtgaacgacctcgggccaagtttgcttttgttgctggttccctaagcttaattgcaagcaaagttaatttgaaagaaaatacatgatacagctctagggcgaattctaacgagccttgggcaatgagggaagaacgtgtctaattatccacagcccggggacgcctgcacacgacgctggcgggtgcagggcccggagagggacaaacgatttttctgtgttcataaagtgaagaagaaaaaaataaaaaaggcacctccagtctctgagcccccagatgagggactgggaggggtttgcaaattcctagggttagaaggttccaagacatacagcggaatgttctcaggatcccacagtcacgcgggctaagggggccgcccgcgaccccgctgtggatgaggccccgggcggcgcgcactgtctccgaggtactcgctcccctgcgcggcgcccattcccacctggcccggccggtgcgcgagctcttggtgtcgtcggccggtgggaggccgagaagggctgtcgctctgtcttcaacgccttgatcccaaccctcgcgcgtctccgtgtcccttggggcacctgaagcacacaaccaggtccctccccgcagcgtcctctctctcctgatgctgaccctcgcctttggcacaatcttacctgtcccgcaagttgacaagtagaatgggggacgaaaatgtccgctctttcccaccctgtctttctccttcccggggctttatcatgacactccaggaggctttgttacaaggcagcgcttatttaaagcctttcagccctgctatgctctgcgctttgcagtttacaaagcgcttttcacctctcctctcgtttaacttcaggaaaattatctgaggtagcagtcacaaattcccatttcacaaatgacgacccgagaggagaagggactggcttaagattagtggtgctgtcaaagcactggacttgctcattaggaaacagagaaagcctcaactctggcactaagggcaaaaaccagccttctccagccccagtcccacgcctgggctcttctgcagcccagaacaaaactcctgggtggaga

SEQ ID NO: 1640 - DNA, 615 bp, Homo sapiens
ctcctgaatttttctgaaacaaactttgcattcagctccatcaaggagcccgatgagctgccagctcaccacagtgcggcactgagcaccagagagttcctgtcccagattcctccggtcaagtcacatgagatgctctcttcagtccggggcttggttgaacggactcaccaggaaacgtgactttcgtgtccgacctctgctgtatcaggattcgattcttggtgttaaacaagacaacgctgaaggctcggtgcagcagccctgcaaaggtttttccagcgctcttgggaggtgggctgtgccactgcctggcccacctggcccacctggcccaccattacctgaagggaagcatgaacagcctttgacgtgggagtggcgactgctgagagggaactgtctgtacacaagcaatgtagccttatgggacctgagtggagccccaacccacgcagggcgtgtcttcatggcttttcctggccaatctgataccaagatgcagtggccagaagtacctgcacttccactcctgtcaagtctctgcatggctatggtgaggaagagctctgcactgggcaaggaagttggccgtcgagtgaaggaaatggtgat

SEQ ID NO: 1641 - DNA, 615 bp, Homo sapiens; identical to SEQ ID NO: 1640

SEQ ID NO: 1642 - DNA, 2565 bp, Homo sapiens
aaataagtatattttattatagaaggatttgtatataatttatgaggttattgccaaaccatttgtttgtttgtttagacttttttctgggtccctcaggagtggcatttggcatatgtgcaaaaatatctgtatatcctagatggtgccctaggactggaattgctaggtcaaaaggtgtgaagtctgttcttttggtaattattgccaaatttcctctgtagagggtgaaccaatttacaaacctatctgtaacttatgagtatacccatgttttttcatcttggtcaatataatatgaaaagataaatatctgaggagagttttaacttggatcttttatgaggaatgaggttgaatattttttaatgtttctgagaactgtctgttcataccctttgtccatttttatataggttatttttttcttatgaatttgaagttctttgaagttagccttttatgttatgagtagcaactgtgatttttttttggccatatggagatttttgatcttgaagcagtggaattaatatctttttatttaaaaatgcatttgacttttgtatcacagttagggaggccttcccagagtttatttcagtatgtttaaggtttctttttctttctctctgaccctccatttattccttttacatttcatccatttgcaatttgtatatgaagtgtgaatctcatttttttcctcagatgcctactcagtgcactatttgttgaataatctatcattttcctgttgtgttgaaatgtcacgttttccttaagttaaaattctccacatagctctatttattttgggactttctattttcttccttgggtctgtctgttaatatcttaatatcacactgttttaatgattgagactttttttttttttttgagacaaagtcatgaaagtggctcatgcctgtgattccagcactttgggaggctgaggagggtggactgcttgagcccaggagttcaagaccagccaacatggcgaaaccccatctctactaaaaatacaaaaactagctgggcatggtggcacgtgtctgtagtcccagctactagagaggctgaagtgggaggattgcttgagcctcggaggcagaggttgcagtgagctgatatcacatcactgcactccagcctgggtgacaaagttgagacctgtctcaacaacaacaacaaaaacccttggggaaaatttgaaaaatcacattaaagttatagacaagcaagaaagaacacacccttataaagtcgaacattcttttttttttttttttttttgagacagagtctcgctggagtgcagtggtgggatcttggctcactgcaaccttcgcctcccgggttcaagtgattctcctgcctcagcctccctagtagctgggattacagacacgcgccaccatgcctggctacattttgtatttttagtagagacggggtttcaccatgttggccaggctggtctcgaactcctgacctcaggtgatccgcctgccttggcctcccaaagtgctgagattacaggtgtgagccaccatgcctggccttgaaagtgtttttatttactcttcctcttgaatgatagcttagctggaaatacttttctctcctcaatctatagatattatttgattgtcttctggcctttatttttgcatgcatgaagtctcctgttagtctactttttgttcctttgtaagttattttttctgtctggtttcctcccgtctttccttccttccttccttccttcctaccttccttccttccttccttcctaccttccttcctccctccctccctccctctctttctctctttctttctttcgagacagaatgttgcttggtggcccaggctggagtgcagtggtgcaatctcggctcactgcaacctctgccttctgggttcaagagattctcttgcctcagcctcccaagtagctgggattacaggcatgtgccatcatgcccgactaatttttgtatttagtacagatggggtttcatcatgttggccaggctggtcttgaactcctgacctcaggcgatccacctgacttggcctcccaaagtgctgggattacagatgtgagccactgtgcttggcctctggttgcttttgaagtgtttcctttgtcttcattttcaactgcaatgtttcaagttgtattttctcttttttttttttttttaattttgttagtatttattgatcattcttgggtgtttctccgagagggagatttggcagggtcataggacaatagcggagagaaggtcagcagataaacatatgaacaaaggtctctggttttcctaggcagaggaccctgcggccttccgcagtgtttgtgtccctgggtacgtgagattagggagtggtaatgactctttaacgagcatgctgccttcaagcatctgtttaacaaagcacatcttgcaccgcccttaatccatttaaccctgagttgacacagcatatgtttcagagagcacggggttgggggtaaggttatagattaacagcatcccaaggcag

SEQ ID NO: 1643 - DNA, 2565 bp, Homo sapiens; identical to SEQ ID NO: 1642

SEQ ID NO: 1644 - DNA, 6794 bp, Homo sapiens
ggcagctccagggctcggctgcctctttttggttatttggtttcttgttcctcccagtgactgaaaacccctccctccctggctttttatagaagctaagaaaagagcttattttgtgactgcatccggaccttgagttctttggctcttgtgtgagtggatggtgacaccaggccagctggggattcttcccaggctgggctcacaggctggggctgggcacacggagcagctgcgggaaaaggatctggacaccagccccccagcgtgtcaccggcaggaaggtgaggtgggaacagagtgacgtccatgcatgttcagagacaaggtttccctacgttgcccagactggtcttgaactcctagcctcaagcagtccttctgcctcagcctcccaatgtgctgggattacaggcatgagccactgcacttgaccaagggtaaatattttctgactaagccagtggatcacaaacatcctggagagcagtgactctgtgattccatcacaagaatatgaaggactgagaagatctccagctctgcccattgcaccttcccattgagaagcagcatggcaccctggtggcaggggctgatactcagccgggccagggtgctctcctgttaaccataaccaagctcacaggacatgggatgagcccactgtgtgacacagggagcgggacacagtctgttaagtcttgcacagccatgctctgccacgcaggcaggcctttccttggcctccctctccctgttcgtgctcatgtgaacatccacctacgtggatagactgggctttggttcattattgctctgtgaattcctcgaacttccgcatctgcccaacctcccccaccccattgttttcattgtgtttcaccaaatggaaattctagagtaagcatatagaatcttcaactcggaggcaccagtctctctcacttgaggaaagaatgcgaaggaaggaatggcctgacttcctcatgtgtgccctgtttctcggtaggcaccatgtgggggctgccacacatgtgccgaagctttgggaacgttccgtttaaataccaatttcgatgccaatgcctaacatggagcacaaatatccagctattgcaggaggttgagatattcaaggtgatagaaaaatatctaagaccaaattcctgtcctgaagaagctcacatagttgtgggagccatagataagaaagaagcatttacgaagcacatcaaaagtgtctcagaagagctgtatacttggccatgggggcagcagctcccgctcaagcatcccctcagcctgcacacctccaggacttgctgctttctgtgctgttctcaacaccagggtcctttcctccagaagtgggacctcttaagtgtgagaaaagaacttgttcttttaagatggtacctgaatgacttttgaaatttaattagaacctgtagtttttcaaagcctcctgttatagaccgaatggtaccctcctacattcatataccgaagccctgaccctggcgtggctgcatttggagatagggtctctaaggaggtgattgaggttaaatgaaaccataagaatggagctccaatccagtagtgctggtgtccttgcaaagaagaggaagaggcatcagagatgcacaagcatggagaaaaggccatgtgaggacacagcaagaaggtggctgtctgcaaacctggaagagtgtcctcactagaagccatccatgctagcaccttgaactccagaaccatgagaaaataaatttctgtttttaagccacccaatctgtggtattctgttacggcagcccaagtagactagtataccatgcaaatagaccaccatcatacactctagcatcaacgggcacagggggattccctcagctctccatgttggggcatttcctagtagtttggaaggtgctttctatgggataattcatactcatattcctaacaatgacttttaatttgtttttaaaagtgctgattagcctatgatatattacagatggctaggctgccatgtttgtatgtgcagctgtttcttgaattgacacttctacgttttcctacagccaagtgtattcattacaacattcacggtcaacaatagtccattaagcaacacacttctgactgtgggcagtggcttttggagttatcactaattgtgaaactccagaaaggacagggctaatgtctttggataatgaaggtcaccttctaatgacacatgagcctctctggccagtcccgtgtctggtctggcccccagcttactgacttgtaaggatggtttgcacttcggtttcgtctttcagttccggggttgtgcacctgttgcttgctcaggaagttttgtgtgataatttgtggcccaactgctgacttccgtgcccatcaccaatggctatggccagcacactcctggtccaaagtggtaggaaacttggtccaaagtggtaggggaagcttgaggatttagtttatctttctttctagagaaggctacttgcatattagggagtaccgacactctggtgtgaataaacagacaccaaactgaactctttagagcactgctggggctatttactctacttaaataattttgtaaaactaggcttgttaaaatggacactaaaataaaaaccccttgagtttctttgataaggagagtatcctgaccaaagcacccttttcaagtctaaccacctggtagatgcaggaacatccttgtagattcagcatcttttccactgtgtgtggttacagccatggagaaaaagttacatccctgtacttccactgatttttttctttaataatactttccgtgttttaggatgttagatatcagagatttcacaagctctgactgtaataggagaatgcataatgtgaattatgcactgcagaggtgagtacacaagttggctaatgataggttacatggcttgcaatttgggagccagaagcaagtcagcccaggggatccctgtggtgtggagcagctctgtgtcttgactatggtcatgggtgtacaaatatagatgtgatgaagctgtatagaattaatacgcatacacacacacacacagagtacaagtaaacctggggaaatctgcataagacaggtggattgtctcaatattagcatccttgttgtaatattgtactatggttttgaaagaagctaacattggggtaaaatgaataaaaagtacatgggctctgtccctattatttgttacaactgcatgtgaatccatgtttatttccataaaaattttaatttatgaaagttagatttacctcctaaatataattttaaaatctctagatgttaccaaaacagtgggcgaaatattatctgataaagcacaaaagtgcaatcgctctcttaattactttaactgtggataatgttttccagactgttctacggatgggcatgaaaaatcaattaacatgcactcctgttaggctgaaagatggtatccctatcccatggaagtcttggggcagataagtgaagacatttgaacatttagaactatgctgctgaaacaatttcaaattttttctgattataaacatgaaatcaaccataaagaagaaaaaatctattatcccaagattcagagatgaccatggttaacactttattatagtttcatcagtctttttctcttttcaaatatatatttacttataataagtgtttccccgttttctaggaaaccctcataaacgtttccacggctttctgaagcacattcaaagtgtggttgcacaagtctggtactctcacagtgcacatctgtgtggctgtcaggctggtgtccatgctgatgggctggcatgtgttccaactggacatgccatgctttatgaaatacagctaggaattattttgaatatcacccctggattgtactatttggattaaccatctctttgatgttgggtaggaaagttgtttcgaagttttcattatgataaaccatgctgtaatggaaatatttttgcctaatgccttttctgaattttaggttatttatttaggatagattcccaggagtagaattaatggataaaaatgtatgactgtttttcaggcttttaatatgcattgccatatttctttccaaaaagggtgcagtcttcagacatacagactgtgcaggggtttccaacagtaggcaagctctctctcctctttgtctcaacttttctgacgttatagctaaaatttgatacatacctcgttgctttaatgtgaaatgaggtcaggtattttcttaaatgtttgttaatgacatttgtgtttttcttgcttatgaattgcttacgtatatactttgtgtattcattgggacaggggccaaatcacgccacactaatgttacttgtcatgaatatttggatattaatggctttctttattgagaactttagtactttgtaatacttaaaagtgtgagagactggggacattcaattcttttttgtaaacttaactgtcatcttcttgctatttccatgttgcatttagaatacagataccccttgacttacagtgaggttaaaatctgataaacccatcataagtggaaaacactgtgagtcaaaaatgcatttaatacatctaatctaaccaccatctcataatctagcttactttaaacatgctcagaacacttacaatagcctacagttgggcaaaatcatctcacacaaagcctgctttgcttgactatctcatgtgacgtattgaatactgtgcattatgtcaaagttgcgatggtttcgtgccattgtgaagttgaaaaattgtaaatcaaaccatcatgagtcaaaggctgtctgtgcagtgaggagagtgaggtttgatgtgaagcccaaactacgggcagtgaaggagtaagcgtgtatgtggtgttatccaagtccaggctgccatctcagtgccccaatcctggctgatgcaaggacacactttaagagaataaaatccactttccgaatccccaacccacctgtctgtaccctgcttactcctttctgggccctcatcctctcccctctctcctctccacaaagagcacattgagaatatgcactctcagaccccattgcctataagatgtggagttttaaagcattagtctctgttggagattttgcatgtcaatagattcaagtccctacaacacactggagaaacagaatgtgaacctttaggcggcagctgagaaatgaagcaggatttggaggttgctcaattgttcttgagtcaactctccaagacctaatgattggaacccagttggtaatcacatcatgagaatgaaagcgtgattctatacaatgacactttacatattaatatgttcatgccactgatgatcacatcaagtgccagaaaaaaaaatttgtcaccagatttctctattctcaagtcatgtctctaattcttgaaccccaaaaaagtaaacaaatatttatttttccgtatgaataaggacatttgggaaattgtggtcttagctctgtatttgtaaactgttatgactcactcgttattgcattaggcctcagcattaaaagctgcccagatatttacgcttagtacatccccaaagtacaatacatgaacttctttcaccagttggaagcaatagcagaaaatatgtaggatttaatgatgacctttctctataccttgattttggccatggagtaaatagatggaaatgacagtgtcttttgccacttcatttcttcctaaatgtcctgcaagtctccctggaggtgctgctttatctgcagaacttttccaggcccaactgggttatggcccctccaggtataacacacaatactgtgtctgggcggctgtctgcagggaacagcatgtggtagatttgggggaactcatctgtacctctatttgctgtctccccaatgtctcggggaccatgtcctgctcactgctctgtccctggagctataagctcttctggtatataatgggcacaaaatgaatatttttatcagtgagtgaatttagtggtagtgtgtgcctgcaaagaccgagcctgagtcagaagcctgctcggcagggctgggggtgcagccctggagggtgggcctccccagccagcagaccccacctcactctctgcatcattgtcctcaccaagagcactgtgctgcttcctctggggaagcccagcagtggacattagatggctgccaccaccctgtagagttttacctaaaaacttctgtatcttgggtgaggaggtattttttattttttgttttttattggtttttgtctaggaggacaaatcctagcatatgtcacaagaagcttgacatggaaaggactcttaagtccattaggcttaatcaacatcctatatccatcacagagtgtatgtcaggtgttttaataattttttaaattgacaataactatatttatggagtacaatatgatgttttgctttatgcatacattatggaaaggttcaatcaagttttgtttttctctattacatcattgttcttattttttaagaggagctttctccctaatgcaaacagatccatgcttaccgtgacaacgaccttcttcgacatgaaatccggtgtgggtactgactattgcagggtctgttttgattaagcaagattttcaatggtcaattttaagccattgatataaatgtacaattgatgacttttctttattgtttaagcag

SEQ ID NO: 1645 - DNA, 1317 bp, Homo sapiens
caaaaagcccggactaaggggccccgcgccagagagccagggccggctctagagataaggaggcccgcagccccgcctcctcgactccaccctggagaggaaggggaggccccaacagagggcccgggagtactgcaaaaagggattccgctccccaggtcaagaataagattccaggcctcattagaaaccaaatgtttttttctggagaggagtctttagttttcactagagacccagaaggtcatagaaagtccgatttggaccagaacctcagggtatggccatcaacccacaatgttttcttgggggaggaagtgggaggatcaggctgtggctgcttagaaaggactccagctggatgtgacacctcccctcaactcacacaaggctgaggcagttgagaaagctttattaactaacacaaaggaagtctgggcaatgttgcgagaccccgtctctggaaaaaaaaaaaaaatcaaatttgccaggtgtggtgttgtgagcctatggtcccagctactcaggaggctgaggtgggaggatcacttgagcccaaaaggtcaagactgcagtgaaccatgattgcaccactgcactccagcctgggtgacagagcgagagcttgtctacacatacacacacacacacacgcggatgaggcttccaaagctgggagggagtcctccaataccttggcccccttccccactgcttgcaggaccctgatcactgcaggaaactggagctgcatagtgcaagctcccagtgaaatgcaaacaggacaagaggacaaggcatagcttgggcatattccctgggcactcatgtccagacatgaccgctgagtgtcattgtgaacactggcagaaatgtatgtgggtggggaggtggctaacaaaggtgtcagttttggggggaagggaggaataaggcctcactgggtaatctctgaacctgtaaccattaccagtccatatagtgcttttgtgccgatagaaaaatcactccttctggggaaaggcaggttggccaatgagaagtcccagccccatttgatctttttgccaggcactctcctgcagtgtacaacctgtacaactgtacctggtgaccttgaatgtgattaggactgggagctccgtgaggccagagacctatgttcatttagcctacataaaagacactcaataaatagctggtaaaataacaaatgaataaatacatatcatcaagggttggggtcagtagacagcagtgcccaagctggcatccatcaatcatgtcttgagtcttgctccttcctcttggcttagt

SEQ ID NO: 1646 - DNA, 1317 bp, Homo sapiens; identical to SEQ ID NO: 1645

SEQ ID NO: 1647 - DNA, 1317 bp, Homo sapiens; identical to SEQ ID NO: 1645

SEQ ID NO: 1648 - DNA, 3839 bp, Homo sapiens
ttaatatcagactctgtatggttcttagccctttctcatccctgcagctaaaggcatgtggtcctctgttcctataccaaacagtatcagttaagatggagatttcaggggccttgtttttacatactgttgaaatcaatcctgctttagctaagtctgttttgggcctaatttccagattcctaattcttgggattgttttctccagctgaggaattcttaaccaaacaagagacttgttttttcatttcctaatctgatgattcccttttctatcacctgtttttaagacttaattcctgcctctaaactccagctaagtgttgccttttgagcctaatccttatatctctggaagtcagtattttctacctgtcaggcctctgagcccaagctaagccatcatatcccctgtgacatgcacatacacatccagatggctggttcctgccttaagtgatgacattccaccacaaaagaagtgaaaatggcctgttcctgccttaactgatgacattgtcttgtgaaattccttctcctggctcaaaagctcccccactgagtaccttgtgacccccactcctgcccaccagagaacaacccccctttttcctttacctacccaaatcctataaaagggccacacccctatctcccttcgctgactctcttttcagactcagcctgcctgcacccaggtgattaaaaactttattgctcacacaaagcctgtttggtggtctcttcacagggacatgcatgaaatttggtgccgtgactcagatcgggggacctcctttgggagatcaatcccctgtcctcctgatctttactccatgagaaagatccacctacaacctcaagtcctcagactgaccagcccaagaaacatctcaccaatttcaaatccggaccctactgaaaatcagactgttcaactcacctggcagccactcccagagcccctggaactctggcccaaggctctctgactgactccttcccagatcttctcagcttagcagctgaagactgacactgcccaatcgcctcagaagcctacaggaccatcacagatgctctagactcagcccgcctgcacccaggtgaaataaacagccatgttgctcacacaaagcctgtttggtggtctcttcacacggatgtgcatgaaactacctacacccatacggaagggaacaaatcatgaaaagtaatggaatgctacagcctagtcagttttgagaaaaggctaaccaacaacaacaacaacaaatcatagtcatgctcagattgcacatgaacaaaaaaatgttggagagaaaccattgaaataactcaccggtcctcttgtgttgctgcttatctgattatctgaggtcaagggaactgaggacaacaaaggaaattaggtctttcatagttctcattaaatgctggaggagtctgactactgctgagctgagcacttcagcggctttggaaaaggaagtgtggttacttatttcaccaccttcattgtgctggaggaaataagaaatagctctgagactaataataacagaaacggcatccacagcagcagagcccagttgcacttcctaaaggcagtataaataattaagtgtctctataggcaagccactaggaataaacgaaaaagagctgcaattgctgatgtggtttcaccccagtcctgcccatgtttcttaacaggaaagggagttgcaatgccaataataaaatcttagagctggaaagaacatttatttgcctgtttattcattcatttactcagtcattattgggcacttacggtagactagtcgttatgttacctactaggagcttggatatcacccacttttatgtcttcattctttgagcgaagagctatctacatggtgagtccaaaagtgcacaagaggaaacctggcttgtccaaaccaagggctataacttagtttcctaactgcccagcaaaaatattttcagttaggctccactttaactcttaaaaatgtggcttgtgaattacttgatgaataattttactttcttgattatattaagcacaaaaaggaagagaaacacaattacaatattaaaattgtgaaaggcatctcaccaaggtgcttcttctgagaactccatgtctccattgcttatctgaaacctttattttgcttggcctctgggtcccactgcctctggatttacttctcacctgctgactgctccttcttttttactttttctgtgtgctctccatcttcctgacctctttaatttgaatgtcctgggactcagccctttggcttctctttgcaatcagtgcacacactctagatttacccatccaatgccacagccttaaataacatcaatattcttctgatggctctcaaagtaatatattttgctctgacgtccctctttaattctacatgtatatcagactgtctgtctatttggcagccccagtgtgatgttcctctagaatcactaccttaacatatgtgaaacaaactcttttcaccccacccctcaccaaaaaaatctattttttatatacgtatccattcaagaaaaggaaaccttctttcatttgctcgggtaaaacactctgagtaaccggttcctctaatttctctatttcccatattcagtccatgagcaaattttacaactgttaactttgaaataatacacacagcatccaatcacttatctaaactctgtcgctgccgctcgggtctaagcaccatcatgtctcacctggattattgtgacagtcttcttaatgggttttctgcatttcctttttgctccactgtagtctatgcttctcagagcagcctaagtcaatcctctgctcaaaatgctccaatgcacactgcactctatcaaagctctaactattgctaaaatgacccattgtctcctttattcctgctacctctcaagtcacatgccctatcccctatgcctcctccaactgtccctctgacgcagctatcgagtaccttgctgttcctcaaacacagtaagcacaccctatcttagggtgtttgcattatctatgcaaaaacactgcatggtgtgcttttttttgctatgcacccgcatggtttatcttcacagagatcttggctaacactagcaccttttcattctatggtcctttcctctgctttatttttctctttgcacctttcaccgtctgatccatactttttgattgttttcccctcaaggacataagcaccatgacaataggaatgtcactttatttatttatgtctccttctacgtaagtgcattggccccagaaatctagacctctaattataaagaggccatttttttttcctccagcttcaaaataattgcacttcaaaattgtaatactttgtgaacaaaggaaaaagatttaaaattatgggtctagggtcaaggcaatggtggaagataaaaaggaaagatgttacattccttgggggacaaggttggtcttgaagaagaaagaaaacaatgaggatgttgaatgaagtaaaaaacaatgttggccaggcgcggcgactcacgcctgtaatcccagcactttgggaggcaaaggcgggtggatcacaaggtcaggagtttgagaccagcctggccaacatagtgaaacctcgtctctactgaaaatacaaaaattagccgggcatggtggtgcacgcctatagtcccagctactctaggggctgagccaggagaatcgcttgaacccaggaggcggaggttgtggtgagctgagatcacgccacctcattccagcctgagcagccaaccgagac

SEQ ID NO: 1649 - DNA, 863 bp, Homo sapiens
tcttgtattcactgaatacaagaatggttacttgtattcatttctttattaagaatgcctctaatgtttccaataaatgtttgctacatatgctgtatcaagttgtaaaagtttaacccgagccagtcatttgcttatttgctctcagctctattcccacccttctgtgttccttgtttttcagaaggcaaactacatttatcatttccattgtcagatggcttctgattagattttgtcactgggtggtattggttaaagttggatggaaggaataaattatatatttttccataatcttggtttctggtaatgttttcagtagtggcagtgatagcagaagatgagtaccgcttcagggttcctggtgtagcagtgcagttccagcaagcatgtcagaagtcttgctagtgtggtactggtgggatcaggctttgatggtggcatctgcagtggccagaaggtcatgacagctggatcttagacagacattctgagtcatgaggaggaagccaagttctgaggatggtggagcaggaagatagaagttggaaccccaatgaccttgtgaactattctactgactgtgaactgccaactccgcacttttttacatgagcaagaaataaacctctttcttgtttaagccattcttattttagtgtctctggtacttactgtaacactgaaatccagcgggtttagagatcatccacagaaatggcgtgggtgaaggagaggagggtcattcaggaagagtaagcctgaagtccacgactgagccctgcgagagtgctcacatttatagaagagacaccatcaaaagaaacagaagagaccaagcagtaagagtgcaagagagg

SEQ ID NO: 1650 - DNA, 1686 bp, Homo sapiens
ttacttttttcatttttcattccagtgttttgaggtactccactgtctgtttccatttctgactctgattttatttgggatattgttttttttaaagaagccatgctagctttttgtagcgctaaatactcttttttcaaatccatccattcgctcctacaaggaaagaaatggtgataacagatgactaaatataaaaagtaaatagggaaatatctaaatatatacattcacaatgacttggagcaactcctccaccaactttcctgtttctttaaacacatattcaaaatatttcctaggttctaaagacatttagcaaaataagctaagggagttcctcttcccccaatattcagattaaatgttttaagattgccaattaaatttttgagtgtctgaagtattttaatttataaaagtaaaattttagcattaattccttaactagtaacatttactaaatcagtcatctctgtgggaaaagggcgagattaaagatttgttaaactgcttccaatttgagagataacattccttagtatttacttgaatcaaaaagaatttctaagtagaacaaaacaccccgtggaagcaatctatttatttacatacatttaacatgtagatgcttcttcaaacagagttcctccagatagaaacacaatgcctttctcggctcagtgggagcactcattgttaccctaatctatgccatcaaacaagcagataggagattttctttttctttttcttttttttttttaagaggaagatatcttgtggtaatggttttagctgttaacattgacatctgtatacttcaaaaaaaaaaaaaaggatccagacccacccaggatcatacattccctgagagctgatacattaaaataacaaaaggcccttgtaatgattctctgagataaaaaggcaaaaggaattcaagagttaagaatagtataaatagaagtggctgaagtccctgccttttacccttctggaggagaacacgaatctttgggaactagttcaggaaggatctggacttacctcaattgcttttgctgcttgttcttttgtttcaaattccacaaacgcaaatccctttggatctccagtagacttataatgtggtatacttatataaacaacattgccacatttcccaaatactctttcaatccagctgtgattaacatttttgggaagtaactcctattataaattaaaagcaatattagagtttttcacaatcagaatgtcaataaatttttaacttaattatattgtttctgtgccagtttctgactggggacccgggttcttaagcttaccacatacactgtgcgttcatcctcatcctttggtctttcccccagaggttttttcctccggattctggtgccttccaaatcaagctttaaaatagtatattacattaataaaactaatattatttataattgtaagctataatcatataataatcattacgttaacattctttataattataaactataaatataaacagtagttattcttgattcttacctctacaacagctgaacttctcaatgctctggcaattaacttcccatcagtagtcaattttttcattttgttaaaagacacaagtagtgatatatcaacatctaaagaaaatgaaaaagttaatatgttagt

SEQ ID NO: 1651 - DNA, 1196 bp, Homo sapiens
atttacttgaatcaaaaagaatttctaagtagaacaaaacaccccgtggaagcaatctatttatttacatacatttaacatgtagatgcttcttcaaacagagttcctccagatagaaacacaatgcctttctcggctcagtgggagcactcattgttaccctaatctatgccatcaaacaagcagataggagattttctttttctttttcttttttttttttaagaggaagatatcttgtggtaatggttttagctgttaacattgacatctgtatacttcaaaaaaaaaaaaaaggatccagacccacccaggatcatacattccctgagagctgatacattaaaataacaaaaggcccttgtaatgattctctgagataaaaaggcaaaaggaattcaagagttaagaatagtataaatagaagtggctgaagtccctgccttttacccttctggaggagaacacgaatctttgggaactagttcaggaagggattctgcatcttcagagctgcttctcttcctcttccctgttctgacttcaggatctggacttacctcaattgcttttgctgcttgttcttttgtttcaaattccacaaacgcaaatccctttggatctccagtagacttataatgtggtatacttatataaacaacattgccacatttcccaaatactctttcaatccagctgtgattaacatttttgggaagtaactcctattataaattaaaagcaatattagagtttttcacaatcagaatgtcaataaatttttaacttaattatattgtttctgtgccagtttctgactggggacccgggttcttaagcttaccacatacactgtgcgttcatcctcatcctttggtctttcccccagaggttttttcctccggattctggtgccttccaaatcaagctttaaaatagtatattacattaataaaactaatattatttataattgtaagctataatcatataataatcattacgttaacattctttataattataaactataaatataaacagtagttattcttgattcttacctctacaacagctgaacttctcaatgctctggcaattaacttcccatcagtagtcaattttttcattttgttaaaagacacaagtagtgatatatcaacatctaaagaaaatgaaaaagttaatatgttagt

SEQ ID NO: 1652 - DNA, 5572 bp, Homo sapiens
ggagaaaccaatatgttgaatgatggggtattacatacagaaggaccaagaccttattttctcctacttaagatggaatcttgttaagatgaaaggacagctttttaaaaggagaaggtcataagacagtttgaggaaggcattggaagaggaagaggggcaatgtctcctttgttttattgttggtatataaacttaaaatctcagttctttttatggcacttgtggagccacttcctctcctcaccaaaaaatgcccagtaccctgaatccgatcaaattactctcctaaagtataaggcttagtttctgtgtgctgcttcgcgagacagttcccacaaatcgagagtgttaatcagacttttgtgttttcttttttggattgctgttgtttgttttcatttatcatttgtctttgcctaagccaggctcatcaagaattaacagccatcaggctgccgatgtgctgacagcagacccacttagagtcctgtgtttgtaattccatgcatttgttattttacctgttttgtccctgccccttctagtcctgtgcctcctgattgctgagtgttcacctggaccttctgactaccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccgtgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaagttactttgagttgggtttctgttacttgaaattgaatccacactaatatatctaccaacattgagacttgacagatccaagtatttattaagctagaggtcatggtcactgaaattactttccaaagtggaagacaaaatgaaacaggaactgagggaatatttaagatcccacagaagcgtaaaaatgacatggtagaaagtaatagaaaacctaaatgtctgtcattaaaggataggttaaggtgtggttcagccatataggaatatctcgtatctgttaaaatgaataaagtacattcattgtgtatggaaaaatggccatgatacattaggtgaaacaagttattaatagaaaagtgtacagtgtgaactcattttaaaatgtgtgtgcttatgtttataaatgcatagaaaggtctattcacagctttctttgaacagtgtagatcacatgaaactttcaactttatacatttctgtattaatattttacactacccacattatttttaaactttattttaaataaagaatttttaaaattaaatttagtgcttactgtttgaccttggcaagttattcaacactgagcctgttttatcaaatgattta

SEQ ID NO: 1653 - DNA, 1846 bp, Homo sapiens
aacatcacaaacatcattatagaagagagctccaactctctctctctcacacacacacacagacgcacaatttgaccaagttgatgaaataaatcagataaagaaatgcacagcagaagttaaaaagttatggcaactgtgaaggtaaggttggcatcacaattcccttttacacatgacagaatgaaagcctgggcattcatccaaagtcacatgaaccagtggcagtgctgtgaaggtttgagaaaaagaagtcaagactgagaggagagagactgctgaactggaataaactgcagaagctggattagaagacattgagctggccaaaaatacaatacatttttaaattgcagctttccaaactagccttgacatctcaccccaggcactggcaacctatcccatagccagctacaggcagcctgctggggaatttcagtgccacatcagccattcacccgccctcggcaaagtacgctccctcaccttcctacctccttcttaccggcctggtcctgcaggcacccaggggctggcactccaccaggccattcctccaaacaaagtcggcctttcatcaatggtcccaagtgcaagattccccttcctacacactctaggcatcaacacatcttcatgccttatccgatcttggttatcaaactctagatgagaaaaatgaaacccagtttatttataccttagaaaagagtttgttaaccaaaacacatttctcagaagtggagtatgacttattagactttatattattccgtgttaatttttctccatctaatcatcaaaagtgaaatacaggacatccacatgactcatttgaacacagctgcacccctgtgttagcaagtgacttgtaccagtgccattgggctcagtcaaaacaaagaatcatcacttagaggaggtgaggtttgaccaacaaattctttagaccctggtagtcagtgcaagagcttctgaatgataacaatgataaaagtaatagcagcagctaatatatacacaattaaacaatgcacattacatggattatctcatttcatacatgcaacaatcttttacaattatagcagttccacaaagtagggaatttctgttttaactagtccttcaagaggcaattacttttctctagtgttctgctcttaggactggaaggatgagactttgcgaccagaaagactcatcattagagtgggcagctccttccttcctcatgccacacccacaggcagctgccttccctttcctgcagcaaacaggtcccatcatatcccacagatgcaaccaaatgatttcgtattgctttcagcaattacatgaagaggcatatgactaaatcagcctattatcctcatttctcaacagccctcacaatattgcatttatagaattttggtgttgtggccttcaaaacacattggtattgtgaccttactagaataatcctttagagtcacagacatttattaaaacaaagaccatgttttctggtaataaaagctaagggagggtatgagaatttattctccaggttaacaaggacaagataaccctcagcatgcatctgcaagtagaatgctgtgtgaaacactcccttatcaaactctttcctgaatagcaaccctcaaggcagcctgaaatgtcttattatttttatgcttctgcatgtgcacctgtattaccaataataccctgtcaatgcattgagtttgtttgctgtttatttcctaacaagaaactgttcatggtatggagtagagaaggagtattttcatgggataggcattttggagaagaaaaaaagcaaatgagagaagtggga

SEQ ID NO: 1654 - DNA, 2305 bp, Homo sapiens
gtaccagattttgcataactcctctttcttcttgccttttattttctttttattggatgagaagactttgaaagacacagaaaaacacagagaataacataaatacctgtgtagccacattctaggagtaacaactacaagcaaagtggatcagcaaaggctgcagtcaccagcatcttttccaaccttaatgaactgtatcctcaaaagaacactatcagactggtaagacaagcattattgtcccacttcacagatgaagagcttgggggccctgtggatgtgtaggagagtcggccttcctttttataggccttttgctgagctcagaggacagagcagaagacaaagccgaaagcagccctaagcagacactatcccagcccaaggagctatgcagacagctcctgcctagaggagaaacaattctctccttcagccaggcatgtggcacagaggtgaacaggaaatgcttagggagacagttcacagatatatatgtacttcacagggcacaatttaatccataaatcaatcatggatcactgctaaagaaaacaaaatatgctgccactaatttgccaccaccctgtgagcatgattggatgatgtttattttgattaggagattgctccatttataaatcttcaatacatcctgtccccctaaaacggcatctggatcttttgagggttaaaaaaaaaaaaagtgaaattggatgagggatgagagctggacttctgtgtgtcccggggtctctggatccacagcctggtgcctagcatcagttaagcccacgctggggtcgcatcacatcccgcaaagccacgtgctctgtgaggccaacaggagccccgccgggtggaccagctggaatctcagagagcgccgactctgaaaatacccggctctgcagaagcacgctgggcccagggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctccagcgcccgagaagcccagcctcgccggcggccaagttcaccgcgaggccacgcgctgcctgcgctgcgctcccggacccgcaccgaccgcagcgcgcgccgccggtgcttctcccaccccagcctggaagctgcctccctccgcctatccctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtatctctccctcctaagccccggaggggagaacttccaaagacagaaaaccacagggttcctggcacagagctttccctttatcagctaaagcagaatcttttctggccttaacctggccccttcctctaactgtaggcagagaggcagacagaaaagcacttgctgaaacacaaagttttgttctgtcctcaacgaactgtctagagttgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgttatttctaaaacccattatcactgtatgagagattcctttgcgctgcatcctcgacagtgcttcctaagatgaggaaactgaatcccagaatggtggagtgatttgacgaatattgcaaaactataatggggagatgagatggggatccaagtcttgtgcccccaaagacagggcaccaggcagcgtagaggtggccagtaccagagcaacagcctaacaatg

SEQ ID NO: 1655 - DNA, 2305 bp, Homo sapiens; identical to SEQ ID NO: 1654

SEQ ID NO: 1656 - DNA, 32743 bp, Homo sapiens
ggcccgcccctcgcagccttgccgcgccccgtgcgccctgtccgcccctcgctcgcattgcaggcatcctgagtctcggcccttttcgccaaatcgctgctctgccgcgcgcctacgcaaggaaagattcaagggtccctccacttcagggagtggagcccgcgcctcggcacggatcagctgtgcgtctcctttggcctactggctcctctgcttgtgtctatagctagctggacgcatcgtgactttatcttctcatctttcctggcgcccccagacgcatttcctggtccctcgaggcagcggcgtctggggagtgcactttgcacagacagggaaaccgaggcactcagcggtctccaatggagacgctgtaatcgcattccacgaccagctagcgctataagcgctgcctctaaagcggaaggcctcccagtccttctcgacaggaagcaatatttgcatatctaaggagaacaagattcggcaatgtgctccgggagcaagtgcaggcatggaacggtatgggctggagggggacagaccttcagaggcggctgcccgttccctgtagtgtcacataagatttttagaagataggagttttcacagtggcggcagagccctctgctaaatcctcatattagatgtcaaaggtggcatgtcatttgacccaatggcttttttagtcatttatcttcctaacacctatgagagggctacagttaccaaaatggcatggtactggtacataaacagacacacagaccaatggaacagaatagagaacccagaaataagactgcacacctacaactgtctgatctgtgacaaacctgatgaaaacaagcaatgggaaaaggttccctattcaacaaatggtgctgggataactggatactcatatacaaaagactgaaactggactttttccttaaccatatacaaaaattaactcaaagtggattaaggacttaaatgtaaaacccaaaactgtaaaagcctggaagacaacctaggcaataccattcaggacatagacacagacaaagatttcgtgacaaaaatgccaaaagcaattgcaacaaaagcaaaaattgacaaatggaacctaattaaactacagagcttctgcacagcaaaagaaattatcaacagagtaaacagataacctacagaatgggagaaattttttgcaaacagtgcatcgacaaagatctaatatctagcatctataaagaacttaaacaaagttgcaagaaaaaaaaatcaccccattaaaaactgggcaaaggacaggacatgaacagacacttttcaaaagaagacatacatttggccaacaattatatgaaaaaagctcaacgtcactgatcattagagaaactcaaatcaaaccacaatgagatactgtctcataccagtcagaatggctaatatgaaaacgtccaaaaatgacagatgctggtgaggttgtggagaaagggaacactttacacggttggtgagagtgtaaattagttcagccattgtggaagacagtgtggtgattcttcaaagacctaaagacagaaataccattccattcagcaatcccattactgggtaatatacccaaaggaatataaatcattctgtcataaagatgcatgtgtgtatgtttactgcagcactattcacaatagcaaagacatggaattaacctaacatcaatggtagactggatgaagaaaatgtggtacatatacattgtggagtactatgcagccataaaaaagaacaagatcatttactttgcaggggcttcaatggagctggaggccatatccttagcagctaatgcagcaacagaaaaccaaatattgcatgttctcacttataagtgagagtcaaatgatgagaacacatatagggaaacaacacacactgaggcctatttgagggtagagggtggaaggagggagaggatcaggaaaaataactaatgggtactgggcttaaatacctgggtgatgaaataatctgtacaacaaacccccatgacacgagtttacctatgtaacaaacctgcacatgtacccttgaacttaaaataaaaatttaaaaaaagaaaataggttgcttgactctgcacctttccttctctgcttctcacttcccaactgttctaatttcatatgggaatccatgcagttatggagaatccaccttcagcaatgggaatgaacctagcaccacatgacctgggctggatcaatcatcacatactatcccctgacccagtgattggttcagggatggacatgtgacctaagagagtgtggttagagtaaacctcaggacttctgctgataacattggcaaaaagattttttttttaaatgaatgagggcatgtagcctcacagaacagctggaagccattttgcaaccacagagatctgccaaagtctccctaagatgaagaaacactgagatagcagagccaggaaatggtgaagggaatgttggtccctggtcaagttgtttgagctagccctgaagtttttcaaatctctgtgggcttttcaattgcatgagctagtaatttccctttattacttaagccaatgtgaaccagcttttctgttacttagaaccaaaaacattctgctacatcattgatacacgtcaaacacccccttccttttacagaagaaaagactaaatctcatggatgctacgtggctagttaggaggaattgccttcccagttccaggcctttctccttttactactctagccacttgtgatgggtttggtaacaatgagtaaaatgtgcattctccttatttctaaccacggattggatatgttcagaaatattaaaactgattttcctcaagtgtatcttctggcaattaatgtcattgctttatagccactctgtactacgggcccttgtgattcattagaaaaaacaaaggatcaaatagttagagaaggtataaggaccttgtttaaaattttatttaatttgcagctaatttaccagcaacttaggctcaaccacgtatgctgctttgctagtttcttcaaaacttgtcatgcactttcatttcttggtaatcatccctcattaccatttcttatctttcaaaaacacagcctcaccacactgtattcttacctttggtgcctccctctacagctagaatttccagattctgtgggctcttcctctgtaaactctaaaaatccttccatttttatctatacatactatttcccccactctaacagatcttacctatcaccaaccctaaaattacctaacaaaatgctcatcacatcttcaaggaaatgtcccacagtgagagaaaagagaaaggaacctgtgtttattgtgctaggaagatactagatactttacagacattaactcatttaattttcatgaccacaccatggtaagtaggtagtagtatctcagtctaaaaataaggaaactgaggttgggtgagtcatagggttgaattccaaacctaggtgtgtgcagttctaaagatactttcttccactgcttctgttggacaatagattttgccccttttgtaccagctccaaaggatagtgaccgcctggatctcgtgttgagaagactgaagcctcatccaggttgacagggaaagacaaaaggatgtcttgccaaagcttgccaagggggaaagtggcaatccacacaccacttatttcacatttcttcaggcctgtgcctggggcagttctagaggtttcccaggagaaggacaggtgcaccagggagtctggctataaagtttgtacactagaatctgttggcagattctgttgcttaaagttgagtttgcattcatactttatatctgaagaaatgggaagttagggagttaaccactgtctattgggaagtgattcatgaatcagaacaggtgagaatgtcaggctctgaaatgaacagcacacttctgtatggaatgtactggggcagcatacctgccttctttctcagatcaatgttgacacacttaaatttgtgaataaggccttccaggatatcttgtttaggaagaaccagttcacttgctagtatctaggctttctaggtatcacgagggctttctgtcaaagcataaacaagcagtgagaaatcatcagtgttctctctctgaagagagagacaccaggaaaggagagagggtagcaagttagcaggcatggaaagctgctgctttgcagatgtgttcatcaggcataatccttagctggatgttagacagtaccagaagttgcatggtgacttgtctgatggttgcaaagatattggtcctcatgtgggattattcaagatattcagaagggaagaagctgaatctggttacaaaaggtgttccttaaatacgtaatgaatgaatgaataaacagttcaatggaaattggggcaaattaaggattcagtagatgtgaggtgtatttgtctcatgtcctcatctgatgaacatctaccatattcagttgtctagtgaggactcttttagtgtagaaaccaaggaggcacatttggggttcatttagagatggggtatttggggctggggggaagccagcatatgaatgatgggcttcaccaggagacaaagggcatctgtctaagggatggatgctgagggtggacctggcaggctgagcaggtgaaactcttccattggagcagactgtgggtttatttgagcttaagaaaaggaggtcattcccaagaatgaatagcagtggatttgtagactttgaaattaacagatcaaagacaccagatctctgtagagaacttaatatgatctctagattctgaagctccaattctcagccctggctgcaccctagaatcacctgggagcttttcaaccctaccactgccagggtttctcccccagagctttggattcaggcagttcagagtgaggccctggaatcagtattttcaaaaagacctccaagtggctctgagaatatcactgcagttgagactgtccactctagacataactcaaagcaggcaaattttcaggattccatggctagactatgacatttccaacaacctcaagagagacattttaggattattcattcatactgtgtgcatccttggtttctcactagcccctgttcttaaggcctggcagattcccaggtgacttctatccatgagagtgtcccaagaagggccactgggaaacacacttatagagagtttggattatgatcccaaaagacacattcctgaatgccatcatccccgaggttgaaatcctgaaagatcaaaatttctaaagactaaatccttaacatctaaaatcctgaaaatcacaatcataggatagttgcatcatgttaggtgaaactgttaccttgttgtggtctttatttggaaattaagtatggtttaaggagatgcatatagtgccaagttgacagggatggatttattgacttaatttgagatgtcaacttgactgattaaggaatgcctgaaaccctggtaaagcattattttgggtgtgtgtgagggtgtttccagaggactgagtagactcggtgaggaagatctgcccttgatattggtggacaccattcaattggccaacaatctggagataacaaatatagaaggccaactggtctctctctgagagctgggacagacttttcttctgctgccttggacatcagaactccaggctcaccagcctttgcactccagtacttaacagcagcggccatctgggtcctgaggcttttggcctcagagagtaacaccattgtctgctgtggttctcaatataaaaacattgaaacttcctcaataaatgaacagatttcctttttgtgtatctgcatttgtgaaagaccaaaatttcttgagatcttgcctttttgggccactgcatatgcagtggtgacctatagaggtttttgattgatcttgtcaaaagacaggttgtccatcacagtatttcggatgactggagttataaagctaggtacacacaactaccaaccatcatgatacatgtttatacactttgtttttggcatattgccttatgaatacagttcatctgcttgtaattgttgtaatcatgtgactgttgttagaatagctgagtgcttatgtttgcaaagatatatatgttattattgccaattttattgtgtaaattggcctctgaagtgctctgtcagtttttatatggttctcaaataaatctcccttaaaaatgtaaataaatgttttaaagataatttcttcttattttttccagaattatatttttgggattttgatctttcaggatttcaatatttgggatgggtctttcaggattatgatcaaccccctatgtggaaccatactggggaaactatgaacaagaataaaatctcagaagcctgggattttgacattggaggcaaaggaaaatcacatcagagagccctgctcagtgcaaagagcgctaggccgggtgctggaagtgctgactttcactcatgactgcagctgccccactgtgatcctggggaagtgaccactgtgatcactgtgggtctgagtactgtcatctgttcacttccatgtccttccacttctgtgactctgtgaggctaactctgtttctatttttttttttttttttgagacgaagtctcattctgtcgcctaggctggagtgcagcggtgcaatctcggctcactgcaaccgccgcttcccgggttcaagcgattctcctgcctcagcctcctgagtagctggaactacaggtacacaccaccacacccggctaatttttatatttttagtagagacagggtttcacgatgttggccaggctagtcttgaactcctgacctcaagtgatccacacccgcccccccccggtttggccccccacagtgctgggattacaggcgtgagccaccacaccccgtcgcctaactctatttctaaaagctctgccagttggagatttctctagcccactagagtttctggctttgggggacagggagggaagggaggggaagctgtgttataagaagaaagtttaaaaagtaagcataaattatttgagcttttaagagacattaacaagctaccatactgagggtattaagaacactaaaatttgtttggctttggatagggaagctactgaaattgaagaagaaaagatgggactgaatgagcactccttgggttggagaaaaaccaacatgatcattatctaatcatcatcataataatgataatggacatttgtatagcacttggcagtttacaagttactttcttataataataattaccactatatggtacattacagtaacaaatactttttagggctttaccccgttccactgtaaaagttggtattagtggaggatgtaaatagacttatctacatgattaaggaactaggaggagtggaggttcaacaccagcagttggacagcaaacatcttagaagaccaggcacatcttcagccacacccttgggttcaacttggtggtctcctggttggggtcaggagcagaagtggggccatggcctccacttcccttcctgggcaatgtgcctttctttcatcaccatggagtccttgcctttgttttgtttctccttgtcatttatttccattaacatgcagtggtttttgtcctttctcttcccgattgtcactttcctcacctagatagagaagaaccagccctcacctagctcactagtctgtatcaggctcaaatgaggtgatgtatgtaaaaaggttttgagacgttaaaaagcacagtccagaaatacctgaaagcatgtaaactcttacgatttgggggcttagcaggaccaggaatttgatctcattgcctccaggtcatatcatgaccctctaggatccctcctccctgtcacacatccctctatgggcacattgattccaggatttccagagtacatcagggctgagccgacctcatggccctcgtggattgtctctgatatggtttggctctgcgtccctacccaaatgttatcttgaattataatccccacatgttagggagggacctggtgggaggtgactcaatcgtggtgcggtttgccccatgctgttctcgtgatgatgagtgagttctcacgagatctgacggcttaaaagtgtggcacttcctacctcactctctctctctctcctgctgcattgtgaagaaactgcttgcttccctctcaccctctgcagtttcctgaggcctccccagccatgcggaacggccagatgcagtgcctcatgcctgtaatcccagcactttgggaggctgagggaggattgcttgagcctgcttccatatcgtaaactgccttggaaccaattaccactaccagggagacaaactattgcttagaggatgctgacaggagcagcatgccaaaattggaagaatgttgtctctcagctggtgccacgaataggtcttcagcaggctgttccattccaccattctgtctggcccactgcttcttacaagattaagatagcagatcccatgggtgtagctgtagaccaagacctggaattaacacatcagaagattctatgaggaaacccatttaaaaataggatgcatttttttcttttctgcacagggagaaagtttaagctctcctcactatgagttttcaagtataaaagactttttcttccacgattttgagaacaactgaggactcttgtgaccaggacaacagggaagcttgcagcaagatagctccaggttggattcatgcttcgcaccccaagggctgccagccagagaggaggagaagcaatcactcctgcagtttctgaacactacacagacgccaggtagcttcttcaggagaacagccctctgaggaggcaggaagaggaggcttatctttcagcagccggagctgctgagatctctgggcagattaagctctctctaatggatgggctccagcctggcacattcagtggagagggatccactcatccatcatcaacataatatggtcctccctgcacttcacagtgtcctcttgctattgaaaaggcttttttgccttctcaagtttctttgtcaacagtctacaggaagaagctcaggccgccaccggcagaggtgaatgcaagctcacgttttatttctgactgcttaatcattgcctcgatcactgctcaagctctgcctttgtttccaaaggttacctgtgggaaaacttctttttctatgctgaaattaatagggaggcaaagatgagtccactgataagcagagccttaaaactcacatagagaaacaactttgctggagtgtgtgtgagtgaaccactaaggaatcagatagtgtgatggcagttatcattgcaggttaagacatttctacaaatatttcgacatctccatatactcactcctttcccccctgagtggagagactcagctaccaagagaggaagctcaaaaaaaacagaagcttcaaacaaacaaccaaccaaaaaaaaaaaaaaactgtgggttcatcagaggtggtagggaagacaaaaacatgggaggagcagctgggcacggtggctcaagcctgtaatcccagcactttgcgaggctgaggtgggtggatcacctgaggtcaggagttcgagaccagcctggccaacatggtgaaaccccatctctactaaaaatacaaaaaattagccgggcgttgtggtacgcacctgtaatcccagctactccggaggctgaggcagcagaatcgcttgaacccaggaggcagaggttgcaacgagccaagatcgcaccattgcactccagcctgggcaacaagagcgaaactccatctaaaaaaaacaaacaagcaaacaaacaaaaaacacgggaggagcaataaaaaggaatccatgctttgatttttttttttagtgagaggaagggaaggctgctgcctctcacttctccctgttttgttgttcttttaagtagcatgtgtcactctgtatatatcctgtccatgtgttttcttttattattatttgtccacttgcctagaatgaaaactccatgggagcatggctatagtgtcttgttcactcctgcctctccagggcctgaaacagaagtaggtagacagagcctgaaacaaaagtaggcagtccataaactttgctgaaggaatgagtgaatgaatgaagaccccaaggatggacctcaggaaggtgagcctgggcaaaggttttcagtcctagtccatcatgaccacatagctggaatacacttatttcactttgtcacatgaattagagattcatttggggaaacaagcaactgttagagttgcagacatctctgaggggtaaatggctgttcaaatcttgcatcttaccctgatcctcactctatctgctttccaaaaacatggagctaagatcccagcactgagaagatgggcattcctagcagggggcatttaggtgtagacagcctcagtgactcctgggtttaggatcagtgagataatctccagtatctacagtgggcaggtggaagagtgtctgatgcaaactgtatctatttacaagctttccagacagctgggcttgtgccttggaaatacaataatatttgtttctcctccttcctcttcactccttggcctcgtgttctgcagtactggaacctgggtcagatttagctacctcattcattcatttatgaattcatttagccagtgattatggagcacaaatttgtgccggaaactgtgcctcagtgtcctcaacaggttctgacttgtgaattccaaaagcttttgtgatctactgggtaaaacattgttttctaaggaaaatgacatgctgattgctgaacagcatattctaattaccttgtggatcccaggccattcttaaattgggttttgtctttattgccttagactgttaatgaattgtttcccagtctgattgaatgctccttgaagacggacccgggtccagccactgcagtaaatattgctaacttgggggtgtaattctgctgcttttgtggttgctgctttgcttatttttttatgtctgctgtttcctgtgagattgtttctgtgtttcatatgtggattgatgttcggtgaggtttatggaatttctgtgcagcttgggttaagagtatctcttcaaaaaggtttttgcatttgcttctgccaaccttgttatcagctcaagttgtttcttatgttgaattattggggatgacctcccccacactcaagtagtataaattagaacctcgctgggtgtggtggctcactcctgtaatcccaacaccttgggaggccaaggtgcgcagatctcttgagtccaggagctcaacaccagcctgggcaacatggcaaaaccctgtctctagaaaaaatgcaaaaattagccaggcatggtggcacatgcttgtagtcccagctattcgggagcctgaggtaggaggattgcttgagcccaggaggaggaggttgcagtgagcatttatcatgccactgcactccagcctgggcaatggagtgagaccctgtcccccaaaaaatttttttaaactcaaaccctatggtattatacctgctgtgggtataatcctttagttacgattggatgcttgctatgatttctcagaaggaaaacattttttcctacccagagctctttacagctaagcagaatttccccaaatgtgcctttaaaaggtattggcttatgcaggcttctcagtttgatgtcttgttcctgaatgagcaatgaaaccccaaacggacaaccttgccctcaaggacagccgaagtatcagatactccttgcaactccttatgtcagctcacactccatttgtggacatggagcatttccttccttttttcttttccttttgcaaatctagttatgcatttaaaaggatgcaatgtacccattatttccaggtgttttatggcactaatgtgtatggcagaaatgggtgttctctaattgttcataattcaaggtaattatagacatattgtttcaaaattaaatcaatagattttcaagccatgctatgtataaagctccatgcgggacacaaaaagggaaaaaacactatgtaccatgcacccttaagcaatttcacacatgctgtcttatctaattttcacgacagtcttatgagacagttattatccccattttatagatgaggaagctgaggctgcatgatgagtggcttgctcaaagtcacatatctaatcaataagacagctggcataaaacccatatctcactcgaaagtctgtgctttcccattgcacaggttcatgacatagtccaagggagaagacatagctgacaaaaggatcaatagcagtgtaagagtagacaaataaaacaataaggactgcattgcaatagatgttatgaagagggacggacatgattcattgctagtgaatataggccaaagggctataacttcagagtaggcagagatttgtgggccacagtgggaaagatggaggagaaagttagcttgggccttgaagatattgtctcagtgaatgaaggggagaagaccatgcctggcagtggagagagcacaagcagaaggtgggaaagcgtgtgcaggttatgggctccatgagtaggtaggtcatggctatatacaagtatgctgggagataagatggggaaagtttgagtccaagtatggagggctttgattggtaatgaatttggattttatttggtaggcaataaagaaccccagaagacttttgcctaaagaatgatgtagctgaggcagtactttaaaaagatgtgtatggaaaaccatgtacaaattaattgtcaggggagagaatgaaggaaaggagagagcttggattaaggggaagcagtgaaaatcaaatggaacagatggatacctagatatttctcatactgagggtgccaaggccaattgttcttaattaagcaccaatctggttgattccatgggaatttgagatgtcatcaaggtatattgctattgtcatcttccacagactgagcaccagtcaggccactgggtctgagtccctggggctggagcgggtccagtgggcaatttattaaaagttgccaggagaagaagggtgaatgcaggccacatcctgggaaacacacactgaacgtcaatgctggagaattctgagttgtacctctaagttcatggatgagcatgatataaggaagggaaggcaaaaataaaagtagaaagacaggtactgaagtattgtaaatgaacgggtccagtatttgtgaatggaacccacaacttgttttaattagctttaaggtgtctagtacattgtgggtcagcttagtttaaagatataggactaaggcgagcagctttaacatctgagctgaaagggatataaagatgacataccctcttctaaacttccacgactctaccacagcacttatcataatgcatcatgattatcaagttttatatctgtcttctcactagactgtgtactctctgtgggcagggactgtgtcctgtttatctacattcctggcatctggcacaaagcccagcacagggtagatgcccagctaagagttaatgatggcttggaccagggtgatagcagtgggagtggtgagaattgatcagtctttaaatacattttgaagataaagccaaacgggtttcctaatggattggctatggagtatgtaagcaagagagcagtgaagaatgacgcaaggatttgggtttgaggaactagaaggtaaagttgcaatcatctgagatggagaaggctgcaagcagaacaggtttcagagaaaagatggcgggttcacatttgaacatgctgatgctgggtgtctattatgttcaagtggagatggcaagtggcagtggtttcttacatttgaaatctgagagagaggtttgggccaaagatacaagtttgggagtcatctgcataaagatggtattaaagagttctaaacggggtgttatcaccaggggagtaagtgtagacaaagaagagcgccaaggtctgagtcctggaatattacaacactcagaatctgtgagaagaggaaacaccagcaaataaaactgataaagagcagccaaggagataggaaagaaactaagagaaaggggaagtcctagaagccaagtgaagagaaaatatagcaaggagaagggggatcaactgtgtcaaatgccactgatactcaagtaagatgaggagtgggagctgcccattagatttagcatgtgaagatcattgatgtccatgataagacttgggtgcctggttggggcaaaagcctgagtggggtgagtttaagagaaaataggaggacaggcattggagacaagcagtacagacaactcattataggagtgctacaatgagaagcatctaaatggggtggaagctgatgggcaaagtgggattgagagaagccacttgttcatttagatggaagaaacatcagcgtgtttgtattctgatccagtacaatgaaaaggctaagagcttagacctgctaagctcacatactcaggcttccatcttctagtgatgactcctattgtgagttcattgaggatgagagctaaatgtctacccttacctcttgacataagatatatagaagatgcttagcaaatatttatcaaataaatgactatgcataaaatactttgcaaactctctgagccgcagtttcatctgttaaatgaaagtaatatcacctacctcagagaattaaataagataaagtacatatagtatataacaaagagcttagtacttagtatatgctcagtaaatagttagttttattgttagttcaatgctttcattttacagataaggtatctgaggcccagaaaatagtttgttcaagattgcacagttaatgacagagctaccagtttcctagactcatattccttagctttttccacataaccagagaatttacctacaattcccaggtaccacagatgtgggtgctttcaagcctctgtaaattcactaagttgatgagaaacctggatattagtaattaatggcagatctgaaatctctctagaaccttcctatgtggccaacatatgtcttcctgtctaatttgtcaagatactctgcaaagtcaatcctagtacaaggctccatattcatcttgaagctttttcttgttttaccagaattctggttttaattttttgagtagcaatccatgttactctttacatacccaagtcaagggacaaagctaagccacatgcttgttttgttcattatccaatattatgtaagtctagatgactgactccattagtttaactccaggtgacaatgtagatatagatccaaaatatgtttctggacaatattaatagaaatttttatgaccttggaacacaccctccctcattgtacttgcaatagatgaataacctgctcttgctaggatgagtgaagaatgtttacctttgtcaacatttattagtggagtactatatgcagctattcctttaataaaacagtaaatcttcagcaaagtttataggttgtctttcatccaaagacctcaaagaaactttgctaacactgtgtcattattcatcatacaacttgccaagggaggcaagtggtgattgtttcaaagagagaaactgaggttccaggaaggtttctgtgacttctaagggtcatgaacagggtaaaaaagaaaaaagaaaaaaaggaaagaaagagagagagagagagagagatctgggcactgagcccaaattcctgttgctcaggccaaagacccagcgctcctcctagagctctctaaacatttctttctgatagaaaatgtaatttactaccttgatctgttaagcagaaatgaactctcaacctgtcttcaatgacagggaaagccaacctttatttctgaagttacttcaagtcataaaatgcttgattcactgtattaaataatacagtattaaaataagtaaatagctttgtagtcataatgatagcttggatttaaatggtgcctgtgctctgaaaagcagggtagttcacaggcttctgcagacctttggtctcatttggctaccctcctctacccttcttcttcttttttttttttttttagacgaagtctcgctcttgacccccaggctggagtgtgatggcgtgatcttagttcactgcaacctccgcctccccagttcaagtgattctcctgcctcagcctcccgagtagctgggattacaggcgcctgccaccacacctggtgaattttcgtatttacagtagagacagggtttcaccatgttggccaggctggtctcgaactcctgacctcagatgatctgcccgcctaggcctcccaatggctacctttcttgacttcaagtatccctttccttcccacaggtcttttcttcaccaacctgctttcttcactcacacccttattctttcattcaattattttttcttctgcactagcagctctcaagtgaaaagaaactccctgctttagctgtatatgaagaaagacctccaggccctctggaagagctgtggaaggccatcctatgtagatcctccaagaggctcttacaggaatgagttaagatcccatcttgtttggaggttaatgatcaatgtttcagagactgactagaactaatcaaacattcaagttctcttctaaatttcccagtccctcttctatttagatctgggccttataactagttctggccaataaaaagaaaggcagttgagaattatattcttcctccatcgccctcttaacttgctacagtgaccttggaggtcacatcttccaagacactacagctacaagatggaggatggttgcccacctgacttctgactttgcatgagcagtaaacaaactgtcatccggttacctggagatcaaaacccctgagattttgattgtagcagctgctgtcaattatcctgactaacagcaggagtgaaatattgcaatagtttaaaaaaatctaagagatgtggcattagcttaccagttaggctggatagatggaaatccatgatatgcagtggcaaaaaatttaatgaagtacggctggcgataacttggaaagcagaccatgagccaactgagtttatacatttaacacagaggccagccaacttttccataaaaagccagataatgaatattttcagctttattggacagactcctttgcaactactcaactaccattgtagcatgaaaacagccatagacaatatgtaaacaaatgaacatggttgtgttcaaacaaaactttatttacaaaaacaggtagcactctggatttggtctgttggctatttgctgacccctagtctaggggaagagtttagataatatgttgccattggctgcatttgacaaggaattaaagttaagagatgagtttagaaagtgttggccggcttgcaggcagaaattaaagagagaaatcaggaatttggattcccaacttttcacaagctgtaagtggtctaaaaatgctgtacagactccagtatccacttagatagggagaaagaggataaatacacaaaaataaacctcctgataagcagagtaggcatggaggagcatgaatgtaaggcgagcaggttaatatttgaacaaagacccgaaaaaagtaagggacaagccaggtgactatatagggaaagagcagaattatagcaagtgcaaaagccctggggcagcagtgcacctaatacctgcagggaactgcaaggatgccagtattgctggaaccgtgggcacaaagggtgggaaggggggtggtagtaaaagataatatcagagggagggcaggtgggcatggggcagtcttcaaaggtaaatcatacagggccttgtaggtcattatgaagatgccagctcttattctgaattagtgggaaagccatagagggtattgaggtgaacagggacacactccaacttatattcttgaaaagataattctataatatggcaaaaccccatctctacaaaaaaaaaaaaaaagaaatacaaaaattagccaggcatgatggctcacgcctgtagccccagctacttgggaggctgaggtgggaggatcatttgagccccaggaggtcgaggctgtggtgagccatgatcacactgcattatagcctcggtgacagagtgagactctgtctcaaaaagaaaaaaattcattctggttgccggactgagacaaaacaaagggggtggggagtaagcaataagaccagccaaaagtcttttgctgtaatccaagcaagaaataatcattcatttatacattcatctgttccctgagtgggtcccagagtctctgaatcatctcaaccattttgcatctagttctcaactattcgcaactagttctcaaacttggctgcacattagaatcacctgagaactgtgacgatgactgctcctagggttctacctccagagattctggtttcttgagtatagaccttggctggggtggggttggagtagatattgtgtggcccgacatcaggatttttaaagctccccaggtgattttcttgtgcaacccatttggagaaccactgatctatataatacaccctctttgagctgagctcagagcctggtggagttcccagtgttcaataatcttccaggtctctggcctcattttttgactgcagggagcatcttccctcttattgacagctttgcagtccccatctggggtgcaagagactacagggtgctcggaagtgtccatcctggaggcatcatcaaaactacctacttgttttgggggtttttccaacttttattttaggctcaagggtacatgtggaggtttgttacatgggtaaattggcatcatggggatttaatgtacagattatttcatcacccagtaatcaccataatacttgataggtagtttttccaccttcaccctccttccatcctccactctcaagtaggccccggtgtctgtttttcgtttttttgtgtccatgggtactcaatgtttaactcccactaataagggagaatatgtgatatttggttttctgttcactgtaatgtgtttaggataatgacctccagctccatccatgttgctgcaaaagacatgatctcatccttttttatggatgcataatattccatggttaatatgtaccacattttctttatcaagtccaccactgataggcatttagattgattccatgtctttactgttgtggatagtgctgtgatgaacatatgtgtgcatgtgtttttggggtagcatgatttatattcctttgggtatatacccagtaatggaattgctgggtcaaatggttgttctgttgtacattctttgagaaatctccagactgctttccacagtggctgaactaatttttctaatgaactaattacattcccaccagcagggtatagggatttccttttctctgcagcctcaccagcatctgttagtttttgactttttaataatagccattctgactggtatgagatagtatctcattgtggttttgatttgcatctctctaatgattagtgatattgagcagtttttcatactcttcttggccacatatatatcttcttttgagaagtagaaacatctattttttccagagtttctatagcttagcttagcactagggaagtgggtggggattgctgggtgtgctgtgggaagatgacccttccataaaagacagcagggtgggaaaaggccccatgttttcagaatattagtatatatacatatatatatatatatgtatatgtatacgtatatatatatacgtatatatgtgtgtatatatatacacatgtatatatatatttatatatttatttatatatatataaatatatatataaaaatatatatatatttagtcgacatccctgttctatcccaaaagcctaggcctgtttctctagcagcctggaaaatccaaatgtagcaagaaacacttgtctgcatctgaaactggccatcagaggacaggtccttgacacacaagcacagagtggtctttcctacagctcggacatgccctttgctccttccccctgtaagtcaccctccttctatgttttcctaaagaaagttatttttacccactttggaatgccagttcggaacagcctctggcatcttggaaggcactgtacaggtacttttcatctctaattgctcctgcttctccatttaaaagaaatattttcaaagcaatgggagcaagttactcattcaaatgctgttaacaaataacaggacttgagtgtgtaatctgaagttactcagctttgaaaagttgccctgaggagttaaaatttctgcttcactggaaattagaagggaggatgggggggatgtccttatgcgaggaattttcagcccctggaattttatgtctgatctccctcacatctgagctggaacgtgagatccagtgcaagattgcaggagagagcgggctggggacagttctggggcctgcaggtgttccgtttctgtgccaaccagcaagggccgctccccctgcaccaccaaacacccgccaggacttgctggagcccatgtcagtggagtcagcttataaattactcgggatcatcattccatgttggatcgaatcatagagggtggagtgtagaggtgctgcagcctgggcttcaggtggagggctttctggaggaactccacaagcaaaggctgacaacgcagccatgacaagccacagactcccagcgaactcagccccaagcctacactttctctcatgccacaagagcaactgagccaaaagctgggagcctgggccccttctcccatttctgttttaattactgctttttcttttaatatatgtttcccggcatgctgtaccatgagaagtagggacagcaatgccctccagggaggctgcacatagtaagtgttcaatataattaagtgtcagtaaatgtcaattcccttctgtggtttaagaaaatatgcaggccccagggtggtatggaagagatgtgactggtgagtcctaaagtgacgtcagtaataagggaaggaaaatgttaaggaggtcaagactcctcattagggaagaaaagggacttcacctgtgcctgccaatcaccaaggactctcaggtttggctcttctgtggacaggtccaagcttaaaagagtactcatggcataggaattctgaaaatatttattaaagagagaaaggatgattcaattagaggtgggagggaggggccatgattaaaggaagagatagaagaaaaggacttcaagtttccacttgaaggtggctcctcatcctgttggcaaagttctgaggaagaaaaggtatatatggaatgccacttactccactttggagcttcaaagagggtgtggggaggcagaaggaaaagaggctgaaggagaaagagcaggaagggaagagtcaagggtgaagtgctcaagttctcccattctgtgctaagaatagcaggctctcttcaggggaaattcagtccctcttcccaccatggacttgacctcatcaggctctccagcctgccccagaccacctaccgacagggactcatgatgatagtttgagagtgaatacattcaaggcccaaccccagtactttacatatctcccctccaaatctagaaaccaatgccttggctccctatgttcctacaacttggctttttctgcataaatcccctttcaaagctcttgtcttagagccagttgatactgatcgacacatattttaattaaatttgcatttacctattgattttcatacccagtctcattccaaaaaggattggaggcagcttctaacatttcaatgtgataatcactttgataaatctgccttaccacccctgttcacaaacacctgtatctacatccacgaaatatagatgatcttcatagtttaattgtaaaacaatacacaaaacacctttgaaacctggctccaagttttaaaataggtgcattgtactttgtatgctaagaagtttcagacaggattgggcgtcctggccacagaaatagagtcttgtgggagacccccagtttggattcagagtttgggatggccagaagtatgaccacattgattttctttccttgttaggtgtagagaaaaagaggtacacaggttgtgttgaagagcagagtttcgtccaaaccaggtgtttggagcattggaggagggaaattttcctcccttccaggagcccctccagcatcccagatcttgccaactcagaccctttcccagacaaacttgcctctcatccctcagggagtcagttgatcccagctggaactgtaatcctttgctaaaaggcctcttggctgaagcccagctcagcagggaagggttcagctttgtccttggggggcttctgcaggaggtcccattcttggggactctgacactgtgggaatctggcaggtgccccttcccaggttcacagaggttgctttggggggttgcaacaggacttgcttctctggtgtttatctcagtgaaattcaagaaagtccatgtgcagtttcatcctgggataaaggagggtcttctcttcctaccagcaactccaggcaagatactctcctcagcccaaagggctaaagagaaggcaaagggaacaaaggaaggccattttactcattgttgttgaacttaaaatgtgtaattatcttctgaaaacagctgaagggcttatgtaaagcatgacacaggagaaggtatttaaacatgaaacaaggcagcatcttttgctggagcagaatacctgctttccaaactccagatcgactttggaggaggagaatagcatgacagcctccatgtgtgagtcctgtcaacacttggcatccaccttcccattcacttttcacaacactgcatggtaaaccatttcacagataaagaaatggagtctcagagaactggagtaaattgcccaaagatgcacagctactcaataatagaacctgaatttgaacctgctgggtaattctagagccctcagccttagccactacacagcgctccttcccatactgtcactacccatagtcgttcagccatgcattccctagccactaaggcaaagcaaaagataatgggctcaatgaacctcacccctcagatgggctaagtcacacggcacttttgttttcattgtgaatgcccatcagtgaggcacatactgcctgttacagcagatctgcttcgtgcatttgtaagttttgcctgaccctggtgtgcatttgagtttgcgattccaggactacaacatttctaataggaaaaatgtcagctctgtcttattctgatattgacatgctttggggatgccttaggaggctaggaagccttctaagtagcttctgaatttaacacatttctatagaactgttacaagctggttgggaatgtggaagcatgctcaccaaagacggttttcattaggctcaaatcaatgatgagcttttcctgagaacttgaggctttaggagagagtagcatgggccgttggattattataacaacaacaacaaaaagattttaatacatttttctctcattgttttgcctgatgacagatgcaatcccagatcacaggcatttggtgcatgagagcttttctgtttacaggtgtccactgtgccttggagagggctggggcaccgccctagggattgttatttcagacaagaacttcaccctacaaagtaaaggcaagacaaaatgtcattgtcccttttatgcatcacagaggcacattggacttgtagaaggagcataccttttagacactaggtggactaggtaaaacctggatttgaatccagctttttctacttcacagttgtatgacctaggacaagttacatcaagtacatttttgagtccagtttcctcatcagggaaatgcagataaaaatacagactttgttaaggtaccgtaaggattagaggtgatatatggaagaccccatgcagggaagaccccctggaagactctttgtagttgatctagatattatcaggagcagcgtgggacatgcggcactgcacatgctggccactagcttgcacagcaggtcctcaaataatgtcatgtttttgtttttgtttttctgagacagggtcttgctctgtcacccaggctggagtgcagtgacacaatgctggctcaacctcctgggctcaagagatccttccacctcggcctcctgagtagctgggatcacagaaccttccactggccactcagcgaaaggcagctgattcagcacctggagaagaccggcaacagggctgagtttccttgcactgcagaggaggggagaggcaaggagtggacatgagcacggaggatccagggcactcccttgatggtgatgccctcgaagggctgccccgtgcccattgtacagaatgtggattccaccccacgccatgagagctctcgcgcaggcccagaccactttataagccatatttcccaccaattcctgtttctggatctgtcaggttatttcatatttctaggcccttagctttgcttcctcttccctgaacgccctttgcccacatcatcccagctctccttctcctcctgccttctgtcttctcttcctctcatttcttgtcacccaggctggagtccagtggcgtgatcacggctcactacagccttgaactcccgggctcaggtgatcctcccacctgagcctcccgagtagctgggactacagatgcacaccaccatgccagctaatttttaaaactgtttttagggatggggtcatcttcctgtgttgcccaggcttgtctcaaactcctgggctcaagtgatcctctcacctcagccttccaaagtgctgggattacaggcatgagccacaacatccagccccttttctcttttcttacccttctttcctattttcttttccattttctttccctcccttcttctttctttcctaactattaaggagtagattgaattcaaggtctttatgtgtgtcagtttttgttttccaacaaatatttcttaaaaaccaaccattgaaacgtaatggtaaccactggcccctgtctccacctccacacctaagaagccccaaatccagatgtgtccattaaaatcagtccagatcttctttaccaagccactagatgtcatattaatttcacagcagaatagggaagcccatgccggagctgaaaacctgcaacaacaaaaaagcatctaaatactgcaaaaaaaaaaaaaaaaaagagggagagaggcatcttaatatttgtccttaacacatcataccagacttctgcttccaggaatgactggatgtggtttttctaggtggacataatacaaaatgcagctacctgaaaacaatggaaagtggacagagcaggcagattctggtgggaagtccacgcaataaagaaaagatgttacaggaagtgagcgcccatttttgctgtttttagcttggaggcaggtgcagccattgtgcaaaccaggtgtggtgctggtggaaaaacagccatctttttggactatgaaaatggaaggttgagttcagggcaactataactgccaaaagagagaagaaagagttctggaagagaaagagccaaagagggaattcccaaattctttctgctcctgtctgtggctgatcccaaaccacggacacacacagcaaaaacaaaagcatctcagccagagacaaaagagtctaaaagagactggacctgccacctgagaaacagagtttgaagttagagttcaatcacaaaaaaatgcctgctaaaacaaaataaacaaaacctattagagaaaaggtgttctcttatcagaatgtagggcctccacaacttaacgtttataatgtgtacaatccaaacttattcgacatatgaagaactggaaaagtgggacccattctcaagggaaaagatagcggagattcactccaagatgacccagatgttggaattatccaccaaggattttaaagctactattataactgttctcatgctataaaatccactatttagatcatacttaattgtgaagaaatgaattctttcctcctaagattagaaacaaggacggcatgaatacccactttcactactaacactgaattttgtacgaaggtcccagtcagttcaatatttttaaaaagattttaaaaaaagcaataaaaggcatacatattggaaagggaaaagtaaactgtctaaatttgcagatgacaaggtcatataatggtttaaaaaaagctactagaacaatatgtgagtttaccaaggttaaaggatacaaggtcaatatgccaaagtcaagtgaatttctatatatttgcaatgaacaattcaaaatggagttttaaaacatttttatttatgatagtctccaaaatactttttaagaaagaaaatgacagaagcaacccaagtgtctactgatggataattaaattatagtatataaatacaatggggccgggtgcagtggttcatgcctgtaaacccagcactttgggaggctgaggtgggaggatcactcgagcccaggagttcaagaccagcctgggcaacatggtgaaaccccatctctagaaaaagtacaacaattagctgagcatggtggtgcacacctatggtcctagctactaggaggctgaggtgggagatcaccggagcacaggaggttgaggctgcagtgagctgtgattgtgccactgcactccagcctgggtgacagagcaagaccctgtctcaaacacatatatacatacatatgtggaatacaatggaatatttacttaaaaaagaaagaaaattccgacaacatggatggaccttgaagatattatgttgagtgaactagtcacaaaaggacaaatactgcataattgtacttttatgaggcacttagagtaatcaaactcagagacagaaagtagaatgctggttgccaggggctggtagaatggaaagttattgtttaatgtttataaagttttagttttgcaagataaaaagatttctgtggatggatggtggtgatggttgcacaatgtgaatgtacttaatgccacttaaaaatggtcaagatggtaaattttatgttatgtgtattgtaccacaattttctttacaaggtctcaagttggacattaaaatgccaggcaattaaaagtatttatgtttaaaacttaatttaaaaaataattgacaagtatattctaaaatttgttcgagaaggcaaaggacctagaatagcaagaatactcttaagaaaggaaaacaagtttggaaggacttaaactacctgaattcaagacttatcattaagatacagtaatcacaacagtgtgttactggcataaagatagaccatatgagatcaatggaacaaaataaaagctttaaaatgcaccaatacttatatggtcaattgattttcaacaatggtgccaaagtaatttaatggggaaaagatagtcttttcaaaaaatggtgttagaacaactggatatatatatatatccattatatatatacactcatttatatatacatcatatacatgtatgtatcatatatatgtatatagcctcaactcttatttcatatcatatacaaatatttgaattgattgtagacctaaatgaaggagctaaagctattaaacttttagaagacagcataaaagaatttccttccttctgccttgccttgccctgccctgccctgccttgccctgccttgccctgccctgccctgccctgccctgccctgccctgccttgccttgttttgtaacagagtctcactctgttgcccaggctggagtgcagtggcgtgatctcagctcactgcagactcaatcacctgggcttaagccatcctcttgcctcagcgtcctgagtagtttggactacaggcatgcgccaccacacttggctaattttagttttgtttttttgtttttgtttttttgtagagacaaggtttcattatgttacccaggctggtctcaaacttctggactcaagcaatcctccctcctcggcctgtaattatttcttaaacagggcacaaaaagcacaaatcacataagaaaaaaagataaaacagacttcatcaagatttaaagcttttcctcctcagataacgagttgagaaaacaaagacaagccacagattgggagaaaacattggcaaaacagctattaaaaaagccttctatccagattatataaagaacccttaaaactcagtaataaaaagacatacatagtaagtaatgggcaaatgatttgaacaatcactttataaaagaagataaatgaatagccaacaaacacataaaaagatgctgaacatcacaagtcattcaaggaagtgcaaattaaaataataataaaatactattaaatgtccactagagtggccaaatttaaaaaaaatgaaaatcaccaggtattgtggctcacacctgtaatcccagcactttgggaggctgagatgggccaatcacttgagcccaggagttcaagactggcctgggcaacatggcaaaaccctgtctttacacaaaatacaaaaattagcctggagcatatctatagttccagctactcagggggctgaggtgggaggatcgcttgaaccctgggaggccagtctgcagtgagtttagatcatgccactgtactccagcctgggtgacagagcaagacactgtctcaaaaaaaaacaaaaaacaaaaaaaaaccccaaaaaataaaaatgtgaggaactctcacacatttacacattgctgaaggcaatgcaaagtggtacagtcaggccggaaaacagagtgacaaggtcctataaaggagtggtcccaacctttttggcaccagggaccagtttcatggaagacaatttttccatggacagtgggggaagggaatggttttaggatgattcaagctcattaaatttattgtgtactttatttctattattattacattgtaatatataatgaaataattatacatctcaccataatgtagaatcagtgggagcactgagcttgttctcctgcaactagatgatcccatctgggggtgatgtgaaacaatgacagatgatcaggcattagattctcataaggaacacacaacctggatccctcgcatgtgtagttcacaatagggttcatgctcctatgagaatctaatgcctttgctgatctgacagaaggcagagctcaggcagtaatgcgactgatggcaggtggctgtaaagagagatgaagcttcattccctttcctgccgcacacctgctgtgcagccccattcccaacaggccaccgacaggtactggtccaataaagtggaagatatccttaccagtaacccaacaatcccttctcctagagaaatggaaacacatgttctcacaaagacaagtatgcaaatgcacatagcagcattattcattgtagccaaaatttgaaaacaacccaaatgtccatcagctggtgaatagatccattgtggtacatctatactgtgggatactactcagcagtaaaagggaatgaactattgatacacaaaacattatagatgaatttcaaacacattatgctaagtgaaaggaatcaaatacaaaagactacattctgtatgactaaatttatatgaaattttagaaaaggcaatattacagggaagggaagcagatcagcatatacctgaggctactaagccaggtgaagggcaggttgcaaaggggtatgagaggcttttagcaagtgatggatgtgttctgtatctttattgtggtgacatttacatgactgtatacaattacccaaagtcattaaattatacaattaaaatatatgaattgtactgtattgtaaattatacttcaatacagctgaagaaaaagtcaacaacaaccacaaaatcacagccaaagggctcttctctatggctgaaagatattgggtccacatattccagagtcccttgtactcatatcatggtctactatataaataaatcataatttatttttaaagttaatcattgctgaacatttgtaatgtttataatttctttcttttttgagtggaccaatggaggggtgtaacgttcttctatgagtccctggagcacttttgcaagtaattctacatataaaatgtgttgggttatagattataaatgtactcatgtttcttttttcatatgattttattcttttttagaatttcatttgaatagaatcctaccttatgtagtctttcttattaatacataatagtatatatttgggggttatatctggtatactgatactttcatgtaatggtaaaatcagggtaattgggatatccatcaccttgaacatttttctttatgctgggaacatttgaattattctcttttagttacatatttatcttttatgctgggaacatctgaattattatcttctagttattgtcaaatatgcaacagatatattattaactatagtcaccctactgatcgattgaacaggtcttatttcttctacctaactgtattttggtacccattaatcaacctctctttatatccccctcccctccacacttcctggcctctaggaaccaccaatctactctccatcttcatgagatccactttattagctcccacatatgagtgataacatgtggtatttgtctttctgtgccaaacttgtttcacttaacacaatgaccatgttgctgcaaatgacaggatttcattcttttttatggctgaataatattccattgtgtatatataacacgttttctttgtccaatcatccattgatggatacttaggttggttccatactttggctattgtgagtagttctgcaataaacatgggattgcagttatcttttcaatatattgatttactttcttttggatatatacccagtagtaggattgctggatcaaatggtagtcctatttttagttttttgaggaacgtccacactgctttccatagtggctgtactaacttacgtccccatcaacagtgtacaagtgttccctttttccccacacccttgccaacatccaatattccctattttttaaataatagccatcttaactagggtgaaatctcactgtggttttgatttccatttctcggatgattggtgatgttgagcattttttcatatacctgtaaaccatttgtatgtcttcagaaatgtctattcagatcttttgtccatttttattgggttatttttttttgctattgaattgtttgaattccttatgtattctagctattgatcccttgtcagatggatagtttgcaaatattttcacttattctgtgggttgtatctttattgattgtttcctttgctgtgcagaagctttttagtttgacataattgtatttgtctaatttttgcttttggtgcctgtgcttttgaggtcttactcaaaaaatctttgcacaggccaatgtcctacagcacttctccagtgttttcttctagcagtttcacagtttcaggacttacactaagtatgtatgtatgtatgtatgtatgtttttatgtatgtatgtatgtatttatttatttatttattttgagatggagtctcactctgtcgcccaggctggagtacagtggcacaatctcgtctcactgcaacctctgtctcctgggttcaagcgattctcctgcctcagcctactgagtaactggtgcacaaccccacagccactaactgtttgtattttaggagagatggggtttcaccatgttggccaggccgggctcgaactcctgacctcaagtaatccacccgcctcagcctcccaaagtgctgggattataggtgtgagccactgcgcctggccacatttaagtctaatccatttttggtttttttcatatggtgagagataggggtctagttttattcttctgcatatggttatccagttttcccagcactatttattgaagagattgtcctttccccattgtatattcttgtcaccttgtcaaaaatgtgttggctgtaaatgcgtgaattgattctaggttctccattcagttccattggtctatgtgtctgtttgtatatgagtatcatgctatgttggttactgtggctttgtagtatattgtgaagccagagtgatgtgatgcctccagttttgttttgctctggattgctttggttatttgggtcttttgtggttccatatacattttaacattgttcttttctatttctgtgaagaacgtaattagaaaattcattgtgaaagggattgcattgaatctgtaagtagctttgggtagtattgacattttaacaatattatttctttcaatccatgagcatggaatattt

SEQ ID NO: 1657 - DNA, 32743 bp, Homo sapiens; identical to SEQ ID NO: 1656

SEQ ID NO: 1658 - DNA, 22404 bp, Homo sapiens
ggcccgcccctcgcagccttgccgcgccccgtgcgccctgtccgcccctcgctcgcattgcaggcatcctgagtctcggcccttttcgccaaatcgctgctctgccgcgcgcctacgcaaggaaagattcaagggtccctccacttcagggagtggagcccgcgcctcggcacggatcagctgtgcgtctcctttggcctactggctcctctgcttgtgtctatagctagctggacgcatcgtgactttatcttctcatctttcctggcgcccccagacgcatttcctggtccctcgaggcagcggcgtctggggagtgcactttgcacagacagggaaaccgaggcactcagcggtctccaatggagacgctgtaatcgcattccacgaccagctagcgctataagcgctgcctctaaagcggaaggcctcccagtccttctcgacaggaagcaatatttgcatatctaaggagaacaagattcggcaatgtgctccgggagcaagtgcaggcatggaacggtatgggctggagggggacagaccttcagaggcggctgcccgttccctgtagtgtcacataagatttttagaagataggagttttcacagtggcggcagagccctctgctaaatcctcatattagatgtcaaaggtggcatgtcatttgacccaatggcttttttagtcatttatcttcctaacacctatgagagggctacagttaccaaaatggcatggtactggtacataaacagacacacagaccaatggaacagaatagagaacccagaaataagactgcacacctacaactgtctgatctgtgacaaacctgatgaaaacaagcaatgggaaaaggttccctattcaacaaatggtgctgggataactggatactcatatacaaaagactgaaactggactttttccttaaccatatacaaaaattaactcaaagtggattaaggacttaaatgtaaaacccaaaactgtaaaagcctggaagacaacctaggcaataccattcaggacatagacacagacaaagatttcgtgacaaaaatgccaaaagcaattgcaacaaaagcaaaaattgacaaatggaacctaattaaactacagagcttctgcacagcaaaagaaattatcaacagagtaaacagataacctacagaatgggagaaattttttgcaaacagtgcatcgacaaagatctaatatctagcatctataaagaacttaaacaaagttgcaagaaaaaaaaatcaccccattaaaaactgggcaaaggacaggacatgaacagacacttttcaaaagaagacatacatttggccaacaattatatgaaaaaagctcaacgtcactgatcattagagaaactcaaatcaaaccacaatgagatactgtctcataccagtcagaatggctaatatgaaaacgtccaaaaatgacagatgctggtgaggttgtggagaaagggaacactttacacggttggtgagagtgtaaattagttcagccattgtggaagacagtgtggtgattcttcaaagacctaaagacagaaataccattccattcagcaatcccattactgggtaatatacccaaaggaatataaatcattctgtcataaagatgcatgtgtgtatgtttactgcagcactattcacaatagcaaagacatggaattaacctaacatcaatggtagactggatgaagaaaatgtggtacatatacattgtggagtactatgcagccataaaaaagaacaagatcatttactttgcaggggcttcaatggagctggaggccatatccttagcagctaatgcagcaacagaaaaccaaatattgcatgttctcacttataagtgagagtcaaatgatgagaacacatatagggaaacaacacacactgaggcctatttgagggtagagggtggaaggagggagaggatcaggaaaaataactaatgggtactgggcttaaatacctgggtgatgaaataatctgtacaacaaacccccatgacacgagtttacctatgtaacaaacctgcacatgtacccttgaacttaaaataaaaatttaaaaaaagaaaataggttgcttgactctgcacctttccttctctgcttctcacttcccaactgttctaatttcatatgggaatccatgcagttatggagaatccaccttcagcaatgggaatgaacctagcaccacatgacctgggctggatcaatcatcacatactatcccctgacccagtgattggttcagggatggacatgtgacctaagagagtgtggttagagtaaacctcaggacttctgctgataacattggcaaaaagattttttttttaaatgaatgagggcatgtagcctcacagaacagctggaagccattttgcaaccacagagatctgccaaagtctccctaagatgaagaaacactgagatagcagagccaggaaatggtgaagggaatgttggtccctggtcaagttgtttgagctagccctgaagtttttcaaatctctgtgggcttttcaattgcatgagctagtaatttccctttattacttaagccaatgtgaaccagcttttctgttacttagaaccaaaaacattctgctacatcattgatacacgtcaaacacccccttccttttacagaagaaaagactaaatctcatggatgctacgtggctagttaggaggaattgccttcccagttccaggcctttctccttttactactctagccacttgtgatgggtttggtaacaatgagtaaaatgtgcattctccttatttctaaccacggattggatatgttcagaaatattaaaactgattttcctcaagtgtatcttctggcaattaatgtcattgctttatagccactctgtactacgggcccttgtgattcattagaaaaaacaaaggatcaaatagttagagaaggtataaggaccttgtttaaaattttatttaatttgcagctaatttaccagcaacttaggctcaaccacgtatgctgctttgctagtttcttcaaaacttgtcatgcactttcatttcttggtaatcatccctcattaccatttcttatctttcaaaaacacagcctcaccacactgtattcttacctttggtgcctccctctacagctagaatttccagattctgtgggctcttcctctgtaaactctaaaaatccttccatttttatctatacatactatttcccccactctaacagatcttacctatcaccaaccctaaaattacctaacaaaatgctcatcacatcttcaaggaaatgtcccacagtgagagaaaagagaaaggaacctgtgtttattgtgctaggaagatactagatactttacagacattaactcatttaattttcatgaccacaccatggtaagtaggtagtagtatctcagtctaaaaataaggaaactgaggttgggtgagtcatagggttgaattccaaacctaggtgtgtgcagttctaaagatactttcttccactgcttctgttggacaatagattttgccccttttgtaccagctccaaaggatagtgaccgcctggatctcgtgttgagaagactgaagcctcatccaggttgacagggaaagacaaaaggatgtcttgccaaagcttgccaagggggaaagtggcaatccacacaccacttatttcacatttcttcaggcctgtgcctggggcagttctagaggtttcccaggagaaggacaggtgcaccagggagtctggctataaagtttgtacactagaatctgttggcagattctgttgcttaaagttgagtttgcattcatactttatatctgaagaaatgggaagttagggagttaaccactgtctattgggaagtgattcatgaatcagaacaggtgagaatgtcaggctctgaaatgaacagcacacttctgtatggaatgtactggggcagcatacctgccttctttctcagatcaatgttgacacacttaaatttgtgaataaggccttccaggatatcttgtttaggaagaaccagttcacttgctagtatctaggctttctaggtatcacgagggctttctgtcaaagcataaacaagcagtgagaaatcatcagtgttctctctctgaagagagagacaccaggaaaggagagagggtagcaagttagcaggcatggaaagctgctgctttgcagatgtgttcatcaggcataatccttagctggatgttagacagtaccagaagttgcatggtgacttgtctgatggttgcaaagatattggtcctcatgtgggattattcaagatattcagaagggaagaagctgaatctggttacaaaaggtgttccttaaatacgtaatgaatgaatgaataaacagttcaatggaaattggggcaaattaaggattcagtagatgtgaggtgtatttgtctcatgtcctcatctgatgaacatctaccatattcagttgtctagtgaggactcttttagtgtagaaaccaaggaggcacatttggggttcatttagagatggggtatttggggctggggggaagccagcatatgaatgatgggcttcaccaggagacaaagggcatctgtctaagggatggatgctgagggtggacctggcaggctgagcaggtgaaactcttccattggagcagactgtgggtttatttgagcttaagaaaaggaggtcattcccaagaatgaatagcagtggatttgtagactttgaaattaacagatcaaagacaccagatctctgtagagaacttaatatgatctctagattctgaagctccaattctcagccctggctgcaccctagaatcacctgggagcttttcaaccctaccactgccagggtttctcccccagagctttggattcaggcagttcagagtgaggccctggaatcagtattttcaaaaagacctccaagtggctctgagaatatcactgcagttgagactgtccactctagacataactcaaagcaggcaaattttcaggattccatggctagactatgacatttccaacaacctcaagagagacattttaggattattcattcatactgtgtgcatccttggtttctcactagcccctgttcttaaggcctggcagattcccaggtgacttctatccatgagagtgtcccaagaagggccactgggaaacacacttatagagagtttggattatgatcccaaaagacacattcctgaatgccatcatccccgaggttgaaatcctgaaagatcaaaatttctaaagactaaatccttaacatctaaaatcctgaaaatcacaatcataggatagttgcatcatgttaggtgaaactgttaccttgttgtggtctttatttggaaattaagtatggtttaaggagatgcatatagtgccaagttgacagggatggatttattgacttaatttgagatgtcaacttgactgattaaggaatgcctgaaaccctggtaaagcattattttgggtgtgtgtgagggtgtttccagaggactgagtagactcggtgaggaagatctgcccttgatattggtggacaccattcaattggccaacaatctggagataacaaatatagaaggccaactggtctctctctgagagctgggacagacttttcttctgctgccttggacatcagaactccaggctcaccagcctttgcactccagtacttaacagcagcggccatctgggtcctgaggcttttggcctcagagagtaacaccattgtctgctgtggttctcaatataaaaacattgaaacttcctcaataaatgaacagatttcctttttgtgtatctgcatttgtgaaagaccaaaatttcttgagatcttgcctttttgggccactgcatatgcagtggtgacctatagaggtttttgattgatcttgtcaaaagacaggttgtccatcacagtatttcggatgactggagttataaagctaggtacacacaactaccaaccatcatgatacatgtttatacactttgtttttggcatattgccttatgaatacagttcatctgcttgtaattgttgtaatcatgtgactgttgttagaatagctgagtgcttatgtttgcaaagatatatatgttattattgccaattttattgtgtaaattggcctctgaagtgctctgtcagtttttatatggttctcaaataaatctcccttaaaaatgtaaataaatgttttaaagataatttcttcttattttttccagaattatatttttgggattttgatctttcaggatttcaatatttgggatgggtctttcaggattatgatcaaccccctatgtggaaccatactggggaaactatgaacaagaataaaatctcagaagcctgggattttgacattggaggcaaaggaaaatcacatcagagagccctgctcagtgcaaagagcgctaggccgggtgctggaagtgctgactttcactcatgactgcagctgccccactgtgatcctggggaagtgaccactgtgatcactgtgggtctgagtactgtcatctgttcacttccatgtccttccacttctgtgactctgtgaggctaactctgtttctatttttttttttttttttgagacgaagtctcattctgtcgcctaggctggagtgcagcggtgcaatctcggctcactgcaaccgccgcttcccgggttcaagcgattctcctgcctcagcctcctgagtagctggaactacaggtacacaccaccacacccggctaatttttatatttttagtagagacagggtttcacgatgttggccaggctagtcttgaactcctgacctcaagtgatccacacccgcccccccccggtttggccccccacagtgctgggattacaggcgtgagccaccacaccccgtcgcctaactctatttctaaaagctctgccagttggagatttctctagcccactagagtttctggctttgggggacagggagggaagggaggggaagctgtgttataagaagaaagtttaaaaagtaagcataaattatttgagcttttaagagacattaacaagctaccatactgagggtattaagaacactaaaatttgtttggctttggatagggaagctactgaaattgaagaagaaaagatgggactgaatgagcactccttgggttggagaaaaaccaacatgatcattatctaatcatcatcataataatgataatggacatttgtatagcacttggcagtttacaagttactttcttataataataattaccactatatggtacattacagtaacaaatactttttagggctttaccccgttccactgtaaaagttggtattagtggaggatgtaaatagacttatctacatgattaaggaactaggaggagtggaggttcaacaccagcagttggacagcaaacatcttagaagaccaggcacatcttcagccacacccttgggttcaacttggtggtctcctggttggggtcaggagcagaagtggggccatggcctccacttcccttcctgggcaatgtgcctttctttcatcaccatggagtccttgcctttgttttgtttctccttgtcatttatttccattaacatgcagtggtttttgtcctttctcttcccgattgtcactttcctcacctagatagagaagaaccagccctcacctagctcactagtctgtatcaggctcaaatgaggtgatgtatgtaaaaaggttttgagacgttaaaaagcacagtccagaaatacctgaaagcatgtaaactcttacgatttgggggcttagcaggaccaggaatttgatctcattgcctccaggtcatatcatgaccctctaggatccctcctccctgtcacacatccctctatgggcacattgattccaggatttccagagtacatcagggctgagccgacctcatggccctcgtggattgtctctgatatggtttggctctgcgtccctacccaaatgttatcttgaattataatccccacatgttagggagggacctggtgggaggtgactcaatcgtggtgcggtttgccccatgctgttctcgtgatgatgagtgagttctcacgagatctgacggcttaaaagtgtggcacttcctacctcactctctctctctctcctgctgcattgtgaagaaactgcttgcttccctctcaccctctgcagtttcctgaggcctccccagccatgcggaacgggtcttgctctgtcacccaggctggagtgcagtgacacaatgctggctcaacctcctgggctcaagagatccttccacctcggcctcctgagtagctgggatcacagaaccttccactggccactcagcgaaaggcagctgattcagcacctggagaagaccggcaacagggctgagtttccttgcactgcagaggaggggagaggcaaggagtggacatgagcacggaggatccagggcactcccttgatggtgatgccctcgaagggctgccccgtgcccattgtacagaatgtggattccaccccacgccatgagagctctcgcgcaggcccagaccactttataagccatatttcccaccaattcctgtttctggatctgtcaggttatttcatatttctaggcccttagctttgcttcctcttccctgaacgccctttgcccacatcatcccagctctccttctcctcctgccttctgtcttctcttcctctcatttcttgtcacccaggctggagtccagtggcgtgatcacggctcactacagccttgaactcccgggctcaggtgatcctcccacctgagcctcccgagtagctgggactacagatgcacaccaccatgccagctaatttttaaaactgtttttagggatggggtcatcttcctgtgttgcccaggcttgtctcaaactcctgggctcaagtgatcctctcacctcagccttccaaagtgctgggattacaggcatgagccacaacatccagccccttttctcttttcttacccttctttcctattttcttttccattttctttccctcccttcttctttctttcctaactattaaggagtagattgaattcaaggtctttatgtgtgtcagtttttgttttccaacaaatatttcttaaaaaccaaccattgaaacgtaatggtaaccactggcccctgtctccacctccacacctaagaagccccaaatccagatgtgtccattaaaatcagtccagatcttctttaccaagccactagatgtcatattaatttcacagcagaatagggaagcccatgccggagctgaaaacctgcaacaacaaaaaagcatctaaatactgcaaaaaaaaaaaaaaaaaagagggagagaggcatcttaatatttgtccttaacacatcataccagacttctgcttccaggaatgactggatgtggtttttctaggtggacataatacaaaatgcagctacctgaaaacaatggaaagtggacagagcaggcagattctggtgggaagtccacgcaataaagaaaagatgttacaggaagtgagcgcccatttttgctgtttttagcttggaggcaggtgcagccattgtgcaaaccaggtgtggtgctggtggaaaaacagccatctttttggactatgaaaatggaaggttgagttcagggcaactataactgccaaaagagagaagaaagagttctggaagagaaagagccaaagagggaattcccaaattctttctgctcctgtctgtggctgatcccaaaccacggacacacacagcaaaaacaaaagcatctcagccagagacaaaagagtctaaaagagactggacctgccacctgagaaacagagtttgaagttagagttcaatcacaaaaaaatgcctgctaaaacaaaataaacaaaacctattagagaaaaggtgttctcttatcagaatgtagggcctccacaacttaacgtttataatgtgtacaatccaaacttattcgacatatgaagaactggaaaagtgggacccattctcaagggaaaagatagcggagattcactccaagatgacccagatgttggaattatccaccaaggattttaaagctactattataactgttctcatgctataaaatccactatttagatcatacttaattgtgaagaaatgaattctttcctcctaagattagaaacaaggacggcatgaatacccactttcactactaacactgaattttgtacgaaggtcccagtcagttcaatatttttaaaaagattttaaaaaaagcaataaaaggcatacatattggaaagggaaaagtaaactgtctaaatttgcagatgacaaggtcatataatggtttaaaaaaagctactagaacaatatgtgagtttaccaaggttaaaggatacaaggtcaatatgccaaagtcaagtgaatttctatatatttgcaatgaacaattcaaaatggagttttaaaacatttttatttatgatagtctccaaaatactttttaagaaagaaaatgacagaagcaacccaagtgtctactgatggataattaaattatagtatataaatacaatggggccgggtgcagtggttcatgcctgtaaacccagcactttgggaggctgaggtgggaggatcactcgagcccaggagttcaagaccagcctgggcaacatggtgaaaccccatctctagaaaaagtacaacaattagctgagcatggtggtgcacacctatggtcctagctactaggaggctgaggtgggagatcaccggagcacaggaggttgaggctgcagtgagctgtgattgtgccactgcactccagcctgggtgacagagcaagaccctgtctcaaacacatatatacatacatatgtggaatacaatggaatatttacttaaaaaagaaagaaaattccgacaacatggatggaccttgaagatattatgttgagtgaactagtcacaaaaggacaaatactgcataattgtacttttatgaggcacttagagtaatcaaactcagagacagaaagtagaatgctggttgccaggggctggtagaatggaaagttattgtttaatgtttataaagttttagttttgcaagataaaaagatttctgtggatggatggtggtgatggttgcacaatgtgaatgtacttaatgccacttaaaaatggtcaagatggtaaattttatgttatgtgtattgtaccacaattttctttacaaggtctcaagttggacattaaaatgccaggcaattaaaagtatttatgtttaaaacttaatttaaaaaataattgacaagtatattctaaaatttgttcgagaaggcaaaggacctagaatagcaagaatactcttaagaaaggaaaacaagtttggaaggacttaaactacctgaattcaagacttatcattaagatacagtaatcacaacagtgtgttactggcataaagatagaccatatgagatcaatggaacaaaataaaagctttaaaatgcaccaatacttatatggtcaattgattttcaacaatggtgccaaagtaatttaatggggaaaagatagtcttttcaaaaaatggtgttagaacaactggatatatatatatatccattatatatatacactcatttatatatacatcatatacatgtatgtatcatatatatgtatatagcctcaactcttatttcatatcatatacaaatatttgaattgattgtagacctaaatgaaggagctaaagctattaaacttttagaagacagcataaaagaatttccttccttctgccttgccttgccctgccctgccctgccttgccctgccttgccctgccctgccctgccctgccctgccctgccctgccttgccttgttttgtaacagagtctcactctgttgcccaggctggagtgcagtggcgtgatctcagctcactgcagactcaatcacctgggcttaagccatcctcttgcctcagcgtcctgagtagtttggactacaggcatgcgccaccacacttggctaattttagttttgtttttttgtttttgtttttttgtagagacaaggtttcattatgttacccaggctggtctcaaacttctggactcaagcaatcctccctcctcggcctgtaattatttcttaaacagggcacaaaaagcacaaatcacataagaaaaaaagataaaacagacttcatcaagatttaaagcttttcctcctcagataacgagttgagaaaacaaagacaagccacagattgggagaaaacattggcaaaacagctattaaaaaagccttctatccagattatataaagaacccttaaaactcagtaataaaaagacatacatagtaagtaatgggcaaatgatttgaacaatcactttataaaagaagataaatgaatagccaacaaacacataaaaagatgctgaacatcacaagtcattcaaggaagtgcaaattaaaataataataaaatactattaaatgtccactagagtggccaaatttaaaaaaaatgaaaatcaccaggtattgtggctcacacctgtaatcccagcactttgggaggctgagatgggccaatcacttgagcccaggagttcaagactggcctgggcaacatggcaaaaccctgtctttacacaaaatacaaaaattagcctggagcatatctatagttccagctactcagggggctgaggtgggaggatcgcttgaaccctgggaggccagtctgcagtgagtttagatcatgccactgtactccagcctgggtgacagagcaagacactgtctcaaaaaaaaacaaaaaacaaaaaaaaaccccaaaaaataaaaatgtgaggaactctcacacatttacacattgctgaaggcaatgcaaagtggtacagtcaggccggaaaacagagtgacaaggtcctataaaggagtggtcccaacctttttggcaccagggaccagtttcatggaagacaatttttccatggacagtgggggaagggaatggttttaggatgattcaagctcattaaatttattgtgtactttatttctattattattacattgtaatatataatgaaataattatacatctcaccataatgtagaatcagtgggagcactgagcttgttctcctgcaactagatgatcccatctgggggtgatgtgaaacaatgacagatgatcaggcattagattctcataaggaacacacaacctggatccctcgcatgtgtagttcacaatagggttcatgctcctatgagaatctaatgcctttgctgatctgacagaaggcagagctcaggcagtaatgcgactgatggcaggtggctgtaaagagagatgaagcttcattccctttcctgccgcacacctgctgtgcagccccattcccaacaggccaccgacaggtactggtccaataaagtggaagatatccttaccagtaacccaacaatcccttctcctagagaaatggaaacacatgttctcacaaagacaagtatgcaaatgcacatagcagcattattcattgtagccaaaatttgaaaacaacccaaatgtccatcagctggtgaatagatccattgtggtacatctatactgtgggatactactcagcagtaaaagggaatgaactattgatacacaaaacattatagatgaatttcaaacacattatgctaagtgaaaggaatcaaatacaaaagactacattctgtatgactaaatttatatgaaattttagaaaaggcaatattacagggaagggaagcagatcagcatatacctgaggctactaagccaggtgaagggcaggttgcaaaggggtatgagaggcttttagcaagtgatggatgtgttctgtatctttattgtggtgacatttacatgactgtatacaattacccaaagtcattaaattatacaattaaaatatatgaattgtactgtattgtaaattatacttcaatacagctgaagaaaaagtcaacaacaaccacaaaatcacagccaaagggctcttctctatggctgaaagatattgggtccacatattccagagtcccttgtactcatatcatggtctactatataaataaatcataatttatttttaaagttaatcattgctgaacatttgtaatgtttataatttctttcttttttgagtggaccaatggaggggtgtaacgttcttctatgagtccctggagcacttttgcaagtaattctacatataaaatgtgttgggttatagattataaatgtactcatgtttcttttttcatatgattttattcttttttagaatttcatttgaatagaatcctaccttatgtagtctttcttattaatacataatagtatatatttgggggttatatctggtatactgatactttcatgtaatggtaaaatcagggtaattgggatatccatcaccttgaacatttttctttatgctgggaacatttgaattattctcttttagttacatatttatcttttatgctgggaacatctgaattattatcttctagttattgtcaaatatgcaacagatatattattaactatagtcaccctactgatcgattgaacaggtcttatttcttctacctaactgtattttggtacccattaatcaacctctctttatatccccctcccctccacacttcctggcctctaggaaccaccaatctactctccatcttcatgagatccactttattagctcccacatatgagtgataacatgtggtatttgtctttctgtgccaaacttgtttcacttaacacaatgaccatgttgctgcaaatgacaggatttcattcttttttatggctgaataatattccattgtgtatatataacacgttttctttgtccaatcatccattgatggatacttaggttggttccatactttggctattgtgagtagttctgcaataaacatgggattgcagttatcttttcaatatattgatttactttcttttggatatatacccagtagtaggattgctggatcaaatggtagtcctatttttagttttttgaggaacgtccacactgctttccatagtggctgtactaacttacgtccccatcaacagtgtacaagtgttccctttttccccacacccttgccaacatccaatattccctattttttaaataatagccatcttaactagggtgaaatctcactgtggttttgatttccatttctcggatgattggtgatgttgagcattttttcatatacctgtaaaccatttgtatgtcttcagaaatgtctattcagatcttttgtccatttttattgggttatttttttttgctattgaattgtttgaattccttatgtattctagctattgatcccttgtcagatggatagtttgcaaatattttcacttattctgtgggttgtatctttattgattgtttcctttgctgtgcagaagctttttagtttgacataattgtatttgtctaatttttgcttttggtgcctgtgcttttgaggtcttactcaaaaaatctttgcacaggccaatgtcctacagcacttctccagtgttttcttctagcagtttcacagtttcaggacttacactaagtatgtatgtatgtatgtatgtatgtttttatgtatgtatgtatgtatttatttatttatttattttgagatggagtctcactctgtcgcccaggctggagtacagtggcacaatctcgtctcactgcaacctctgtctcctgggttcaagcgattctcctgcctcagcctactgagtaactggtgcacaaccccacagccactaactgtttgtattttaggagagatggggtttcaccatgttggccaggccgggctcgaactcctgacctcaagtaatccacccgcctcagcctcccaaagtgctgggattataggtgtgagccactgcgcctggccacatttaagtctaatccatttttggtttttttcatatggtgagagataggggtctagttttattcttctgcatatggttatccagttttcccagcactatttattgaagagattgtcctttccccattgtatattcttgtcaccttgtcaaaaatgtgttggctgtaaatgcgtgaattgattctaggttctccattcagttccattggtctatgtgtctgtttgtatatgagtatcatgctatgttggttactgtggctttgtagtatattgtgaagccagagtgatgtgatgcctccagttttgttttgctctggattgctttggttatttgggtcttttgtggttccatatacattttaacattgttcttttctatttctgtgaagaacgtaattagaaaattcattgtgaaagggattgcattgaatctgtaagtagctttgggtagtattgacattttaacaatattatttctttcaatccatgagcatggaatattttttcaatttttgtgtgttctcttcaatttctttcatcagtgttttattattttccttatggagatccttcacttctttggtttaatttatttatagatcttgtatatttttggtagctattgtaaatgggattgctttcttgatttccttttcagattgttcactgccagcatatataaatactactaatttttgtgtgctaattttgtatcctgcaactttactaaattcatttatcaattttacccatttttggtggagtcgtcaggtttttcaaattataagattatgtcatttgcaaacaaagataatttgatatttttctttccaatttttctctttctttctcttgactaattgctctggctaggacttccagtgttatgttgaataaaagtggcgaaagtgggcatccttgtcttgttccagatcttagaggaaagactttcgattttttcccatttggtataatgctatctgtgggtttgtcatatacagcctttattgttttgaggtatgttccttctgcacccagtttgtggaaagttttttgtcataaaaggatattgaattttatcaaatgctttttcagcatctattgaaacgatcatacggattttgaccttggttttgatgtgatgtattatattattgatttgtgtatgttgaaccagccttgcatcgctgggatgaaacccactggatgatggtaaattatctttttaatgagctgttgaattcagtttgctagtattctgttaaggatttttgcatctgtgttcatcagggatattggcctgtatctttctttttgttgtgtccttgtctggttttggttatcagagtaatgctggccttgtagaattagtttggtcctcactcttcaatttttttgaatagttggaacagaattggtattacttcttcttcatatatttgctggaattcaacagtgaagccatcagattctgggcttttctttggtggaaaactttttatcatggctttgatctcattactcattattggtttgttcaggtcttccatttctttgtggtttaatcttggaagattgcatgtgtccagaaatttattcttctgttttccaatttgttggtgtatagttgttcataatagtctctgattctttgcatttctgtgctgcctgtacttatgtcttcattttcatttctaatttgatttgggccttctatatttttttcttagtgtagctaaaagtttgtcaatttatttatcttttcaaatagccaattttaaatttcattgattttttgtattttttttagtctcaatttcatttgtttctgttctggtctttattatctctttcctgctaataattttgggtttggtttgttcttgcttttctagttccttgaggtacatcgttaggctgtttatttggaatctattttttgatgtatgcatttattattataaacttcctcttagtcttgcttttgctgtatcccatagattttggtatgttgtatttccatttttgtttcaataaatttttaaaccactttcttaattttgtcattgacccattgattgttcatgagtatgttgtttaatttccatgtgtttgtatggtttccagtttcctcttgtttttggtttctagtttcattccattacgatcagaaaatatatttaatataatttcaacttttttgaatttgttgagacttgttttgtggcctaagatatgatctattctggacaatgctctgaagagaagaatgtatattctgcagcaattgggtgaaatgttctgtaaatgtcagttaggcctatttggtctagtgtgtagtttaactccaatgtttctttcttcaatgatttgtccgttactgagagtcggaagttgaagtctcccacaattattattttgcagtctctttctttaaatctattagtgtttgcttcatacacttgggtgctccagtattgggtgcatagatatttataactgtaatattgtcttgctgagctgacccctttatcgttatgtaataccttggctctttttacagtctttaacttgtagtctattttatctaagtatagctaatcttgcaattttttggtctctatttgcatggaatatctttttccatcccctatttcagtctatgtgtgtctttgtaggtgaagtaggttttttataggcagcacatagttggatattgtttatttattcagcctctgtatgtcttttacttggagaatttaatccatttacatttaatgttattattgatagggaaggacttactactgccattttgttacttgttttctagttgttttgtaactcctctcttcctttcttactgttgtcctgtgtggttattttctattgtagtatgttttaatttgttgttttttatttttagtcaatctattgtaggtttttgctctgtggttaccatgaggtttaggaaaaaaccactgtattgttactaaaagttattattttaaaaaggtgacaacttatctttgatcataaaacatatagaaacaaaggaaaaactgaaaaaaaatctacattttaacttcatcactactcccaccctgccccattttaacatttggattttctacatatagaagtttatcatattagcataatgacagattgaatttcaatcttcatttatttatttttcttgccttactacactgtctagaaccttggtatgttgagtagatgtcttaatgtaggcattcttgtctcattcgcaacatcaaaagaaatgtttttattgtaagctgattttttttttagtagatactcttatcagttcagaaaggtttcttctagtcctaatttgctaagtttttaaaaatcatgaatggacataaacaacatttgtttctcacaattctaaaggctgagaggttcaggatcaaggtgctgacagattctgtatcttgtgagcaccattttctgagtttgaaaatggcctccttctcgccatctcctcatatggtgaacagaaagggaggactctagccttttcttcttataagggcactaatcctatcatggagtccctaaccccatgactcatctaaccttaattacctcccagagactccacctccaaatatcatcacattgggaattagagattcaacatatgaatttgggaaaggaaggacacaaatattaattccacagcagacattggattttatcaggtgtatgtgtcttcatctactcagatgatctatgatttttctctcatcttttaatatgaattacatgggttgattttctaagttaaattaaccttgcattcttaaaatgaaccccattttgccttcattatgctttatatacatcgttactcttaaattgctaatattttgtcagtttctattatgcatgagattagcctatattcttcctttttcatattgtcttcttgttggtattttagccttatcaaataaatgggaaagcatacttagaaacacactttgtgtaccttctcagattcccttaactgcctccctctttccttcccttggtgggcaccccacacatgccaggtttccccttcacttttgaactttaataaaacaccacatcatagtacatggatctcaattcctgaacagctgctaagtcggcatgatgcaacacagatgaaatggcagtaatatccttgttgggtgaatgttactcaatgagaactgggagatgggagcttacctgacaggaagattacccccttttctctcttccactgactactccaagatattgttcctccttgcaacctttccaaaaacatccacattccaagaatctcacatactgagtaacctaacatgtcccttttgacttactatgaagtggtagtcaatatagtaatgcatcatatcacatttcattggatttcccttgctttatttctacttttctctcattcatactgtgctgaatttgcatttcccaaataaaatattagcatctttttcgagatggagtctcactctgtcattcaggctggagtgcagtggcatgataccagctcattgcaacctctgcctcccggcttcaagtgattctcctgcctcagcctcccaagtagctgggattacaggcaggtgcccaccatgcccagctaatttttgtatatttagtagagatggggtttcaccatgttggccaggctggtctcaaactcctgacctcaagtgatctgtccacctcggcctcccaacgtgctgggattacaggcatgagcgactgcgcctggtcaaatattagcatcttaatccttgcctcaggctccactttctagaagacctaaactaagaccaaaattgcctcctttgttctatgcactggagtattttatgtaagattccataattttgttcctttaaagtttgatagagcttataaaccatctaggcctgggtttttctgtgtggaaatactgggaagtactgttatctttaatgattttaagactattcagtttttctacatcttcatgagacaattttcctaagttatagtatttaaagaattcaccctgttatctatacttacaaatttattggcataaagtttatatagtatacttttattacctttttaaatacttgtattaatctttatatgacctgtaggaatgctcatattttcattcttatcgttttggttctttcagtcttgccagggttttatatattttatgagtatttttgaagaaccagttgctgactttgttcatctctattgtgttttctatttccaaggttgctcttacctttagtagttcctttttttttttttttggtttccattttgttattgtttaactttgtgtattgaatgactcatttttagtctctcttttctaatatgcacatttctaagcaggtctgcctatatgctctctaaatactgctctagctgcattccacatattttaataggatttgacagttttaatttccatgactttttcccatgactaattagaaatgtttattaattctcaaatacatggagctttcctaaagatgccttttatactgatttctatctgaaatccattgtggtcagagaatactgtgtgttttgtagcaatcctttgaaatacattgagacttgcttaatttgcaagtacaggttttcatatttttccatatgtgattggaaaaatattaatttgacaatttggggatatagtatacacacaatacacacaaacatatatgtattttcagtacttcaaaatttctacatatttcctggtatttgtctgcttgcttcattaattactgagagatgtacgattttgagttgtactttcttttgttgctctctcatttttctttcatatccttatggcaattgtattaagtgcataccaatttaaaattatttcaccttcatgaatgtcaccttttattacacaaagtgatattttctattaattcgcctaaataaactttgcacttgagtcctttttcagggtctgcttcttgggggaacctaaactacgacagttcgtctcccctggtatgttgtagcaccacgatagctaagactcccacctgtggtaaattggtattgggcccatcaggaaggggatacactcacttacgtaatctctagaatgatagagagatgggggtggtgttaattataaggatggtggaataggttggttgtt

SEQ ID NO: 1659 - DNA, 22404 bp, Homo sapiens; identical to SEQ ID NO: 1658

SEQ ID NO: 1660 - DNA, 22404 bp, Homo sapiens; identical to SEQ ID NO: 1658

SEQ ID NO: 1661 - DNA, 32743 bp, Homo sapiens
ggcccgcccctcgcagccttgccgcgccccgtgcgccctgtccgcccctcgctcgcattgcaggcatcctgagtctcggcccttttcgccaaatcgctgctctgccgcgcgcctacgcaaggaaagattcaagggtccctccacttcagggagtggagcccgcgcctcggcacggatcagctgtgcgtctcctttggcctactggctcctctgcttgtgtctatagctagctggacgcatcgtgactttatcttctcatctttcctggcgcccccagacgcatttcctggtccctcgaggcagcggcgtctggggagtgcactttgcacagacagggaaaccgaggcactcagcggtctccaatggagacgctgtaatcgcattccacgaccagctagcgctataagcgctgcctctaaagcggaaggcctcccagtccttctcgacaggaagcaatatttgcatatctaaggagaacaagattcggcaatgtgctccgggagcaagtgcaggcatggaacggtatgggctggagggggacagaccttcagaggcggctgcccgttccctgtagtgtcacataagatttttagaagataggagttttcacagtggcggcagagccctctgctaaatcctcatattagatgtcaaaggtggcatgtcatttgacccaatggcttttttagtcatttatcttcctaacacctatgagagggctacagttaccaaaatggcatggtactggtacataaacagacacacagaccaatggaacagaatagagaacccagaaataagactgcacacctacaactgtctgatctgtgacaaacctgatgaaaacaagcaatgggaaaaggttccctattcaacaaatggtgctgggataactggatactcatatacaaaagactgaaactggactttttccttaaccatatacaaaaattaactcaaagtggattaaggacttaaatgtaaaacccaaaactgtaaaagcctggaagacaacctaggcaataccattcaggacatagacacagacaaagatttcgtgacaaaaatgccaaaagcaattgcaacaaaagcaaaaattgacaaatggaacctaattaaactacagagcttctgcacagcaaaagaaattatcaacagagtaaacagataacctacagaatgggagaaattttttgcaaacagtgcatcgacaaagatctaatatctagcatctataaagaacttaaacaaagttgcaagaaaaaaaaatcaccccattaaaaactgggcaaaggacaggacatgaacagacacttttcaaaagaagacatacatttggccaacaattatatgaaaaaagctcaacgtcactgatcattagagaaactcaaatcaaaccacaatgagatactgtctcataccagtcagaatggctaatatgaaaacgtccaaaaatgacagatgctggtgaggttgtggagaaagggaacactttacacggttggtgagagtgtaaattagttcagccattgtggaagacagtgtggtgattcttcaaagacctaaagacagaaataccattccattcagcaatcccattactgggtaatatacccaaaggaatataaatcattctgtcataaagatgcatgtgtgtatgtttactgcagcactattcacaatagcaaagacatggaattaacctaacatcaatggtagactggatgaagaaaatgtggtacatatacattgtggagtactatgcagccataaaaaagaacaagatcatttactttgcaggggcttcaatggagctggaggccatatccttagcagctaatgcagcaacagaaaaccaaatattgcatgttctcacttataagtgagagtcaaatgatgagaacacatatagggaaacaacacacactgaggcctatttgagggtagagggtggaaggagggagaggatcaggaaaaataactaatgggtactgggcttaaatacctgggtgatgaaataatctgtacaacaaacccccatgacacgagtttacctatgtaacaaacctgcacatgtacccttgaacttaaaataaaaatttaaaaaaagaaaataggttgcttgactctgcacctttccttctctgcttctcacttcccaactgttctaatttcatatgggaatccatgcagttatggagaatccaccttcagcaatgggaatgaacctagcaccacatgacctgggctggatcaatcatcacatactatcccctgacccagtgattggttcagggatggacatgtgacctaagagagtgtggttagagtaaacctcaggacttctgctgataacattggcaaaaagattttttttttaaatgaatgagggcatgtagcctcacagaacagctggaagccattttgcaaccacagagatctgccaaagtctccctaagatgaagaaacactgagatagcagagccaggaaatggtgaagggaatgttggtccctggtcaagttgtttgagctagccctgaagtttttcaaatctctgtgggcttttcaattgcatgagctagtaatttccctttattacttaagccaatgtgaaccagcttttctgttacttagaaccaaaaacattctgctacatcattgatacacgtcaaacacccccttccttttacagaagaaaagactaaatctcatggatgctacgtggctagttaggaggaattgccttcccagttccaggcctttctccttttactactctagccacttgtgatgggtttggtaacaatgagtaaaatgtgcattctccttatttctaaccacggattggatatgttcagaaatattaaaactgattttcctcaagtgtatcttctggcaattaatgtcattgctttatagccactctgtactacgggcccttgtgattcattagaaaaaacaaaggatcaaatagttagagaaggtataaggaccttgtttaaaattttatttaatttgcagctaatttaccagcaacttaggctcaaccacgtatgctgctttgctagtttcttcaaaacttgtcatgcactttcatttcttggtaatcatccctcattaccatttcttatctttcaaaaacacagcctcaccacactgtattcttacctttggtgcctccctctacagctagaatttccagattctgtgggctcttcctctgtaaactctaaaaatccttccatttttatctatacatactatttcccccactctaacagatcttacctatcaccaaccctaaaattacctaacaaaatgctcatcacatcttcaaggaaatgtcccacagtgagagaaaagagaaaggaacctgtgtttattgtgctaggaagatactagatactttacagacattaactcatttaattttcatgaccacaccatggtaagtaggtagtagtatctcagtctaaaaataaggaaactgaggttgggtgagtcatagggttgaattccaaacctaggtgtgtgcagttctaaagatactttcttccactgcttctgttggacaatagattttgccccttttgtaccagctccaaaggatagtgaccgcctggatctcgtgttgagaagactgaagcctcatccaggttgacagggaaagacaaaaggatgtcttgccaaagcttgccaagggggaaagtggcaatccacacaccacttatttcacatttcttcaggcctgtgcctggggcagttctagaggtttcccaggagaaggacaggtgcaccagggagtctggctataaagtttgtacactagaatctgttggcagattctgttgcttaaagttgagtttgcattcatactttatatctgaagaaatgggaagttagggagttaaccactgtctattgggaagtgattcatgaatcagaacaggtgagaatgtcaggctctgaaatgaacagcacacttctgtatggaatgtactggggcagcatacctgccttctttctcagatcaatgttgacacacttaaatttgtgaataaggccttccaggatatcttgtttaggaagaaccagttcacttgctagtatctaggctttctaggtatcacgagggctttctgtcaaagcataaacaagcagtgagaaatcatcagtgttctctctctgaagagagagacaccaggaaaggagagagggtagcaagttagcaggcatggaaagctgctgctttgcagatgtgttcatcaggcataatccttagctggatgttagacagtaccagaagttgcatggtgacttgtctgatggttgcaaagatattggtcctcatgtgggattattcaagatattcagaagggaagaagctgaatctggttacaaaaggtgttccttaaatacgtaatgaatgaatgaataaacagttcaatggaaattggggcaaattaaggattcagtagatgtgaggtgtatttgtctcatgtcctcatctgatgaacatctaccatattcagttgtctagtgaggactcttttagtgtagaaaccaaggaggcacatttggggttcatttagagatggggtatttggggctggggggaagccagcatatgaatgatgggcttcaccaggagacaaagggcatctgtctaagggatggatgctgagggtggacctggcaggctgagcaggtgaaactcttccattggagcagactgtgggtttatttgagcttaagaaaaggaggtcattcccaagaatgaatagcagtggatttgtagactttgaaattaacagatcaaagacaccagatctctgtagagaacttaatatgatctctagattctgaagctccaattctcagccctggctgcaccctagaatcacctgggagcttttcaaccctaccactgccagggtttctcccccagagctttggattcaggcagttcagagtgaggccctggaatcagtattttcaaaaagacctccaagtggctctgagaatatcactgcagttgagactgtccactctagacataactcaaagcaggcaaattttcaggattccatggctagactatgacatttccaacaacctcaagagagacattttaggattattcattcatactgtgtgcatccttggtttctcactagcccctgttcttaaggcctggcagattcccaggtgacttctatccatgagagtgtcccaagaagggccactgggaaacacacttatagagagtttggattatgatcccaaaagacacattcctgaatgccatcatccccgaggttgaaatcctgaaagatcaaaatttctaaagactaaatccttaacatctaaaatcctgaaaatcacaatcataggatagttgcatcatgttaggtgaaactgttaccttgttgtggtctttatttggaaattaagtatggtttaaggagatgcatatagtgccaagttgacagggatggatttattgacttaatttgagatgtcaacttgactgattaaggaatgcctgaaaccctggtaaagcattattttgggtgtgtgtgagggtgtttccagaggactgagtagactcggtgaggaagatctgcccttgatattggtggacaccattcaattggccaacaatctggagataacaaatatagaaggccaactggtctctctctgagagctgggacagacttttcttctgctgccttggacatcagaactccaggctcaccagcctttgcactccagtacttaacagcagcggccatctgggtcctgaggcttttggcctcagagagtaacaccattgtctgctgtggttctcaatataaaaacattgaaacttcctcaataaatgaacagatttcctttttgtgtatctgcatttgtgaaagaccaaaatttcttgagatcttgcctttttgggccactgcatatgcagtggtgacctatagaggtttttgattgatcttgtcaaaagacaggttgtccatcacagtatttcggatgactggagttataaagctaggtacacacaactaccaaccatcatgatacatgtttatacactttgtttttggcatattgccttatgaatacagttcatctgcttgtaattgttgtaatcatgtgactgttgttagaatagctgagtgcttatgtttgcaaagatatatatgttattattgccaattttattgtgtaaattggcctctgaagtgctctgtcagtttttatatggttctcaaataaatctcccttaaaaatgtaaataaatgttttaaagataatttcttcttattttttccagaattatatttttgggattttgatctttcaggatttcaatatttgggatgggtctttcaggattatgatcaaccccctatgtggaaccatactggggaaactatgaacaagaataaaatctcagaagcctgggattttgacattggaggcaaaggaaaatcacatcagagagccctgctcagtgcaaagagcgctaggccgggtgctggaagtgctgactttcactcatgactgcagctgccccactgtgatcctggggaagtgaccactgtgatcactgtgggtctgagtactgtcatctgttcacttccatgtccttccacttctgtgactctgtgaggctaactctgtttctatttttttttttttttttgagacgaagtctcattctgtcgcctaggctggagtgcagcggtgcaatctcggctcactgcaaccgccgcttcccgggttcaagcgattctcctgcctcagcctcctgagtagctggaactacaggtacacaccaccacacccggctaatttttatatttttagtagagacagggtttcacgatgttggccaggctagtcttgaactcctgacctcaagtgatccacacccgcccccccccggtttggccccccacagtgctgggattacaggcgtgagccaccacaccccgtcgcctaactctatttctaaaagctctgccagttggagatttctctagcccactagagtttctggctttgggggacagggagggaagggaggggaagctgtgttataagaagaaagtttaaaaagtaagcataaattatttgagcttttaagagacattaacaagctaccatactgagggtattaagaacactaaaatttgtttggctttggatagggaagctactgaaattgaagaagaaaagatgggactgaatgagcactccttgggttggagaaaaaccaacatgatcattatctaatcatcatcataataatgataatggacatttgtatagcacttggcagtttacaagttactttcttataataataattaccactatatggtacattacagtaacaaatactttttagggctttaccccgttccactgtaaaagttggtattagtggaggatgtaaatagacttatctacatgattaaggaactaggaggagtggaggttcaacaccagcagttggacagcaaacatcttagaagaccaggcacatcttcagccacacccttgggttcaacttggtggtctcctggttggggtcaggagcagaagtggggccatggcctccacttcccttcctgggcaatgtgcctttctttcatcaccatggagtccttgcctttgttttgtttctccttgtcatttatttccattaacatgcagtggtttttgtcctttctcttcccgattgtcactttcctcacctagatagagaagaaccagccctcacctagctcactagtctgtatcaggctcaaatgaggtgatgtatgtaaaaaggttttgagacgttaaaaagcacagtccagaaatacctgaaagcatgtaaactcttacgatttgggggcttagcaggaccaggaatttgatctcattgcctccaggtcatatcatgaccctctaggatccctcctccctgtcacacatccctctatgggcacattgattccaggatttccagagtacatcagggctgagccgacctcatggccctcgtggattgtctctgatatggtttggctctgcgtccctacccaaatgttatcttgaattataatccccacatgttagggagggacctggtgggaggtgactcaatcgtggtgcggtttgccccatgctgttctcgtgatgatgagtgagttctcacgagatctgacggcttaaaagtgtggcacttcctacctcactctctctctctctcctgctgcattgtgaagaaactgcttgcttccctctcaccctctgcagtttcctgaggcctccccagccatgcggaacggccagatgcagtgcctcatgcctgtaatcccagcactttgggaggctgagggaggattgcttgagcctgcttccatatcgtaaactgccttggaaccaattaccactaccagggagacaaactattgcttagaggatgctgacaggagcagcatgccaaaattggaagaatgttgtctctcagctggtgccacgaataggtcttcagcaggctgttccattccaccattctgtctggcccactgcttcttacaagattaagatagcagatcccatgggtgtagggagaaagtttaagctctcctcactatgagttttcaagtataaaagactttttcttccacgattttgagaacaactgaggactcttgtgaccaggacaacagggaagcttgcagcaagatagctccaggttggattcatgcttcgcaccccaagggctgccagccagagaggaggagaagcaatcactcctgcagtttctgaacactacacagacgccaggtagcttcttcaggagaacagccctctgaggaggcaggaagaggaggcttatctttcagcagccggagctgctgagatctctgggcagattaagctctctctaatggatgggctccagcctggcacattcagtggagagggatccactcatccatcatcaacataatatggtcctccctgcacttcacagtgtcctcttgctattgaaaaggcttttttgccttctcaagtttctttgtcaacagtctacaggaagaagctcaggccgccaccggcagaggtgaatgcaagctcacgttttatttctgactgcttaatcattgcctcgatcactgctcaagctctgcctttgtttccaaaggttacctgtgggaaaacttctttttctatgctgaaattaatagggaggcaaagatgagtccactgataagcagagccttaaaactcacatagagaaacaactttgctggagtgtgtgtgagtgaaccactaaggaatcagatagtgtgatggcagttatcattgcaggttaagacatttctacaaatatttcgacatctccatatactcactcctttcccccctgagtggagagactcagctaccaagagaggaagctcaaaaaaaacagaagcttcaaacaaacaaccaaccaaaaaaaaaaaaaaactgtgggttcatcagaggtggtagggaagacaaaaacatgggaggagcagctgggcacggtggctcaagcctgtaatcccagcactttgcgaggctgaggtgggtggatcacctgaggtcaggagttcgagaccagcctggccaacatggtgaaaccccatctctactaaaaatacaaaaaattagccgggcgttgtggtacgcacctgtaatcccagctactccggaggctgaggcagcagaatcgcttgaacccaggaggcagaggttgcaacgagccaagatcgcaccattgcactccagcctgggcaacaagagcgaaactccatctaaaaaaaacaaacaagcaaacaaacaaaaaacacgggaggagcaataaaaaggaatccatgctttgatttttttttttagtgagaggaagggaaggctgctgcctctcacttctccctgttttgttgttcttttaagtagcatgtgtcactctgtatatatcctgtccatgtgttttcttttattattatttgtccacttgcctagaatgaaaactccatgggagcatggctatagtgtcttgttcactcctgcctctccagggcctgaaacagaagtaggtagacagagcctgaaacaaaagtaggcagtccataaactttgctgaaggaatgagtgaatgaatgaagaccccaaggatggacctcaggaaggtgagcctgggcaaaggttttcagtcctagtccatcatgaccacatagctggaatacacttatttcactttgtcacatgaattagagattcatttggggaaacaagcaactgttagagttgcagacatctctgaggggtaaatggctgttcaaatcttgcatcttaccctgatcctcactctatctgctttccaaaaacatggagctaagatcccagcactgagaagatgggcattcctagcagggggcatttaggtgtagacagcctcagtgactcctgggtttaggatcagtgagataatctccagtatctacagtgggcaggtggaagagtgtctgatgcaaactgtatctatttacaagctttccagacagctgggcttgtgccttggaaatacaataatatttgtttctcctccttcctcttcactccttggcctcgtgttctgcagtactggaacctgggtcagatttagctacctcattcattcatttatgaattcatttagccagtgattatggagcacaaatttgtgccggaaactgtgcctcagtgtcctcaacaggttctgacttgtgaattccaaaagcttttgtgatctactgggtaaaacattgttttctaaggaaaatgacatgctgattgctgaacagcatattctaattaccttgtggatcccaggccattcttaaattgggttttgtctttattgccttagactgttaatgaattgtttcccagtctgattgaatgctccttgaagacggacccgggtccagccactgcagtaaatattgctaacttgggggtgtaattctgctgcttttgtggttgctgctttgcttatttttttatgtctgctgtttcctgtgagattgtttctgtgtttcatatgtggattgatgttcggtgaggtttatggaatttctgtgcagcttgggttaagagtatctcttcaaaaaggtttttgcatttgcttctgccaaccttgttatcagctcaagttgtttcttatgttgaattattggggatgacctcccccacactcaagtagtataaattagaacctcgctgggtgtggtggctcactcctgtaatcccaacaccttgggaggccaaggtgcgcagatctcttgagtccaggagctcaacaccagcctgggcaacatggcaaaaccctgtctctagaaaaaatgcaaaaattagccaggcatggtggcacatgcttgtagtcccagctattcgggagcctgaggtaggaggattgcttgagcccaggaggaggaggttgcagtgagcatttatcatgccactgcactccagcctgggcaatggagtgagaccctgtcccccaaaaaatttttttaaactcaaaccctatggtattatacctgctgtgggtataatcctttagttacgattggatgcttgctatgatttctcagaaggaaaacattttttcctacccagagctctttacagctaagcagaatttccccaaatgtgcctttaaaaggtattggcttatgcaggcttctcagtttgatgtcttgttcctgaatgagcaatgaaaccccaaacggacaaccttgccctcaaggacagccgaagtatcagatactccttgcaactccttatgtcagctcacactccatttgtggacatggagcatttccttccttttttcttttccttttgcaaatctagttatgcatttaaaaggatgcaatgtacccattatttccaggtgttttatggcactaatgtgtatggcagaaatgggtgttctctaattgttcataattcaaggtaattatagacatattgtttcaaaattaaatcaatagattttcaagccatgctatgtataaagctccatgcgggacacaaaaagggaaaaaacactatgtaccatgcacccttaagcaatttcacacatgctgtcttatctaattttcacgacagtcttatgagacagttattatccccattttatagatgaggaagctgaggctgcatgatgagtggcttgctcaaagtcacatatctaatcaataagacagctggcataaaacccatatctcactcgaaagtctgtgctttcccattgcacaggttcatgacatagtccaagggagaagacatagctgacaaaaggatcaatagcagtgtaagagtagacaaataaaacaataaggactgcattgcaatagatgttatgaagagggacggacatgattcattgctagtgaatataggccaaagggctataacttcagagtaggcagagatttgtgggccacagtgggaaagatggaggagaaagttagcttgggccttgaagatattgtctcagtgaatgaaggggagaagaccatgcctggcagtggagagagcacaagcagaaggtgggaaagcgtgtgcaggttatgggctccatgagtaggtaggtcatggctatatacaagtatgctgggagataagatggggaaagtttgagtccaagtatggagggctttgattggtaatgaatttggattttatttggtaggcaataaagaaccccagaagacttttgcctaaagaatgatgtagctgaggcagtactttaaaaagatgtgtatggaaaaccatgtacaaattaattgtcaggggagagaatgaaggaaaggagagagcttggattaaggggaagcagtgaaaatcaaatggaacagatggatacctagatatttctcatactgagggtgccaaggccaattgttcttaattaagcaccaatctggttgattccatgggaatttgagatgtcatcaaggtatattgctattgtcatcttccacagactgagcaccagtcaggccactgggtctgagtccctggggctggagcgggtccagtgggcaatttattaaaagttgccaggagaagaagggtgaatgcaggccacatcctgggaaacacacactgaacgtcaatgctggagaattctgagttgtacctctaagttcatggatgagcatgatataaggaagggaaggcaaaaataaaagtagaaagacaggtactgaagtattgtaaatgaacgggtccagtatttgtgaatggaacccacaacttgttttaattagctttaaggtgtctagtacattgtgggtcagcttagtttaaagatataggactaaggcgagcagctttaacatctgagctgaaagggatataaagatgacataccctcttctaaacttccacgactctaccacagcacttatcataatgcatcatgattatcaagttttatatctgtcttctcactagactgtgtactctctgtgggcagggactgtgtcctgtttatctacattcctggcatctggcacaaagcccagcacagggtagatgcccagctaagagttaatgatggcttggaccagggtgatagcagtgggagtggtgagaattgatcagtctttaaatacattttgaagataaagccaaacgggtttcctaatggattggctatggagtatgtaagcaagagagcagtgaagaatgacgcaaggatttgggtttgaggaactagaaggtaaagttgcaatcatctgagatggagaaggctgcaagcagaacaggtttcagagaaaagatggcgggttcacatttgaacatgctgatgctgggtgtctattatgttcaagtggagatggcaagtggcagtggtttcttacatttgaaatctgagagagaggtttgggccaaagatacaagtttgggagtcatctgcataaagatggtattaaagagttctaaacggggtgttatcaccaggggagtaagtgtagacaaagaagagcgccaaggtctgagtcctggaatattacaacactcagaatctgtgagaagaggaaacaccagcaaataaaactgataaagagcagccaaggagataggaaagaaactaagagaaaggggaagtcctagaagccaagtgaagagaaaatatagcaaggagaagggggatcaactgtgtcaaatgccactgatactcaagtaagatgaggagtgggagctgcccattagatttagcatgtgaagatcattgatgtccatgataagacttgggtgcctggttggggcaaaagcctgagtggggtgagtttaagagaaaataggaggacaggcattggagacaagcagtacagacaactcattataggagtgctacaatgagaagcatctaaatggggtggaagctgatgggcaaagtgggattgagagaagccacttgttcatttagatggaagaaacatcagcgtgtttgtattctgatccagtacaatgaaaaggctaagagcttagacctgctaagctcacatactcaggcttccatcttctagtgatgactcctattgtgagttcattgaggatgagagctaaatgtctacccttacctcttgacataagatatatagaagatgcttagcaaatatttatcaaataaatgactatgcataaaatactttgcaaactctctgagccgcagtttcatctgttaaatgaaagtaatatcacctacctcagagaattaaataagataaagtacatatagtatataacaaagagcttagtacttagtatatgctcagtaaatagttagttttattgttagttcaatgctttcattttacagataaggtatctgaggcccagaaaatagtttgttcaagattgcacagttaatgacagagctaccagtttcctagactcatattccttagctttttccacataaccagagaatttacctacaattcccaggtaccacagatgtgggtgctttcaagcctctgtaaattcactaagttgatgagaaacctggatattagtaattaatggcagatctgaaatctctctagaaccttcctatgtggccaacatatgtcttcctgtctaatttgtcaagatactctgcaaagtcaatcctagtacaaggctccatattcatcttgaagctttttcttgttttaccagaattctggttttaattttttgagtagcaatccatgttactctttacatacccaagtcaagggacaaagctaagccacatgcttgttttgttcattatccaatattatgtaagtctagatgactgactccattagtttaactccaggtgacaatgtagatatagatccaaaatatgtttctggacaatattaatagaaatttttatgaccttggaacacaccctccctcattgtacttgcaatagatgaataacctgctcttgctaggatgagtgaagaatgtttacctttgtcaacatttattagtggagtactatatgcagctattcctttaataaaacagtaaatcttcagcaaagtttataggttgtctttcatccaaagacctcaaagaaactttgctaacactgtgtcattattcatcatacaacttgccaagggaggcaagtggtgattgtttcaaagagagaaactgaggttccaggaaggtttctgtgacttctaagggtcatgaacagggtaaaaaagaaaaaagaaaaaaaggaaagaaagagagagagagagagagagatctgggcactgagcccaaattcctgttgctcaggccaaagacccagcgctcctcctagagctctctaaacatttctttctgatagaaaatgtaatttactaccttgatctgttaagcagaaatgaactctcaacctgtcttcaatgacagggaaagccaacctttatttctgaagttacttcaagtcataaaatgcttgattcactgtattaaataatacagtattaaaataagtaaatagctttgtagtcataatgatagcttggatttaaatggtgcctgtgctctgaaaagcagggtagttcacaggcttctgcagacctttggtctcatttggctaccctcctctacccttcttcttcttttttttttttttttagacgaagtctcgctcttgacccccaggctggagtgtgatggcgtgatcttagttcactgcaacctccgcctccccagttcaagtgattctcctgcctcagcctcccgagtagctgggattacaggcgcctgccaccacacctggtgaattttcgtatttacagtagagacagggtttcaccatgttggccaggctggtctcgaactcctgacctcagatgatctgcccgcctaggcctcccaatggctacctttcttgacttcaagtatccctttccttcccacaggtcttttcttcaccaacctgctttcttcactcacacccttattctttcattcaattattttttcttctgcactagcagctctcaagtgaaaagaaactccctgctttagctgtatatgaagaaagacctccaggccctctggaagagctgtggaaggccatcctatgtagatcctccaagaggctcttacaggaatgagttaagatcccatcttgtttggaggttaatgatcaatgtttcagagactgactagaactaatcaaacattcaagttctcttctaaatttcccagtccctcttctatttagatctgggccttataactagttctggccaataaaaagaaaggcagttgagaattatattcttcctccatcgccctcttaacttgctacagtgaccttggaggtcacatcttccaagacactacagctacaagatggaggatggttgcccacctgacttctgactttgcatgagcagtaaacaaactgtcatccggttacctggagatcaaaacccctgagattttgattgtagcagctgctgtcaattatcctgactaacagcaggagtgaaatattgcaatagtttaaaaaaatctaagagatgtggcattagcttaccagttaggctggatagatggaaatccatgatatgcagtggcaaaaaatttaatgaagtacggctggcgataacttggaaagcagaccatgagccaactgagtttatacatttaacacagaggccagccaacttttccataaaaagccagataatgaatattttcagctttattggacagactcctttgcaactactcaactaccattgtagcatgaaaacagccatagacaatatgtaaacaaatgaacatggttgtgttcaaacaaaactttatttacaaaaacaggtagcactctggatttggtctgttggctatttgctgacccctagtctaggggaagagtttagataatatgttgccattggctgcatttgacaaggaattaaagttaagagatgagtttagaaagtgttggccggcttgcaggcagaaattaaagagagaaatcaggaatttggattcccaacttttcacaagctgtaagtggtctaaaaatgctgtacagactccagtatccacttagatagggagaaagaggataaatacacaaaaataaacctcctgataagcagagtaggcatggaggagcatgaatgtaaggcgagcaggttaatatttgaacaaagacccgaaaaaagtaagggacaagccaggtgactatatagggaaagagcagaattatagcaagtgcaaaagccctggggcagcagtgcacctaatacctgcagggaactgcaaggatgccagtattgctggaaccgtgggcacaaagggtgggaaggggggtggtagtaaaagataatatcagagggagggcaggtgggcatggggcagtcttcaaaggtaaatcatacagggccttgtaggtcattatgaagatgccagctcttattctgaattagtgggaaagccatagagggtattgaggtgaacagggacacactccaacttatattcttgaaaagataattctataatatggcaaaaccccatctctacaaaaaaaaaaaaaaagaaatacaaaaattagccaggcatgatggctcacgcctgtagccccagctacttgggaggctgaggtgggaggatcatttgagccccaggaggtcgaggctgtggtgagccatgatcacactgcattatagcctcggtgacagagtgagactctgtctcaaaaagaaaaaaattcattctggttgccggactgagacaaaacaaagggggtggggagtaagcaataagaccagccaaaagtcttttgctgtaatccaagcaagaaataatcattcatttatacattcatctgttccctgagtgggtcccagagtctctgaatcatctcaaccattttgcatctagttctcaactattcgcaactagttctcaaacttggctgcacattagaatcacctgagaactgtgacgatgactgctcctagggttctacctccagagattctggtttcttgagtatagaccttggctggggtggggttggagtagatattgtgtggcccgacatcaggatttttaaagctccccaggtgattttcttgtgcaacccatttggagaaccactgatctatataatacaccctctttgagctgagctcagagcctggtggagttcccagtgttcaataatcttccaggtctctggcctcattttttgactgcagggagcatcttccctcttattgacagctttgcagtccccatctggggtgcaagagactacagggtgctcggaagtgtccatcctggaggcatcatcaaaactacctacttgttttgggggtttttccaacttttattttaggctcaagggtacatgtggaggtttgttacatgggtaaattggcatcatggggatttaatgtacagattatttcatcacccagtaatcaccataatacttgataggtagtttttccaccttcaccctccttccatcctccactctcaagtaggccccggtgtctgtttttcgtttttttgtgtccatgggtactcaatgtttaactcccactaataagggagaatatgtgatatttggttttctgttcactgtaatgtgtttaggataatgacctccagctccatccatgttgctgcaaaagacatgatctcatccttttttatggatgcataatattccatggttaatatgtaccacattttctttatcaagtccaccactgataggcatttagattgattccatgtctttactgttgtggatagtgctgtgatgaacatatgtgtgcatgtgtttttggggtagcatgatttatattcctttgggtatatacccagtaatggaattgctgggtcaaatggttgttctgttgtacattctttgagaaatctccagactgctttccacagtggctgaactaatttttctaatgaactaattacattcccaccagcagggtatagggatttccttttctctgcagcctcaccagcatctgttagtttttgactttttaataatagccattctgactggtatgagatagtatctcattgtggttttgatttgcatctctctaatgattagtgatattgagcagtttttcatactcttcttggccacatatatatcttcttttgagaagtagaaacatctattttttccagagtttctatagcttagcttagcactagggaagtgggtggggattgctgggtgtgctgtgggaagatgacccttccataaaagacagcagggtgggaaaaggccccatgttttcagaatattagtatatatacatatatatatatatatgtatatgtatacgtatatatatatacgtatatatgtgtgtatatatatacacatgtatatatatatttatatatttatttatatatatataaatatatatataaaaatatatatatatttagtcgacatccctgttctatcccaaaagcctaggcctgtttctctagcagcctggaaaatccaaatgtagcaagaaacacttgtctgcatctgaaactggccatcagaggacaggtccttgacacacaagcacagagtggtctttcctacagctcggacatgccctttgctccttccccctgtaagtcaccctccttctatgttttcctaaagaaagttatttttacccactttggaatgccagttcggaacagcctctggcatcttggaaggcactgtacaggtacttttcatctctaattgctcctgcttctccatttaaaagaaatattttcaaagcaatgggagcaagttactcattcaaatgctgttaacaaataacaggacttgagtgtgtaatctgaagttactcagctttgaaaagttgccctgaggagttaaaatttctgcttcactggaaattagaagggaggatgggggggatgtccttatgcgaggaattttcagcccctggaattttatgtctgatctccctcacatctgagctggaacgtgagatccagtgcaagattgcaggagagagcgggctggggacagttctggggcctgcaggtgttccgtttctgtgccaaccagcaagggccgctccccctgcaccaccaaacacccgccaggacttgctggagcccatgtcagtggagtcagcttataaattactcgggatcatcattccatgttggatcgaatcatagagggtggagtgtagaggtgctgcagcctgggcttcaggtggagggctttctggaggaactccacaagcaaaggctgacaacgcagccatgacaagccacagactcccagcgaactcagccccaagcctacactttctctcatgccacaagagcaactgagccaaaagctgggagcctgggccccttctcccatttctgttttaattactgctttttcttttaatatatgtttcccggcatgctgtaccatgagaagtagggacagcaatgccctccagggaggctgcacatagtaagtgttcaatataattaagtgtcagtaaatgtcaattcccttctgtggtttaagaaaatatgcaggccccagggtggtatggaagagatgtgactggtgagtcctaaagtgacgtcagtaataagggaaggaaaatgttaaggaggtcaagactcctcattagggaagaaaagggacttcacctgtgcctgccaatcaccaaggactctcaggtttggctcttctgtggacaggtccaagcttaaaagagtactcatggcataggaattctgaaaatatttattaaagagagaaaggatgattcaattagaggtgggagggaggggccatgattaaaggaagagatagaagaaaaggacttcaagtttccacttgaaggtggctcctcatcctgttggcaaagttctgaggaagaaaaggtatatatggaatgccacttactccactttggagcttcaaagagggtgtggggaggcagaaggaaaagaggctgaaggagaaagagcaggaagggaagagtcaagggtgaagtgctcaagttctcccattctgtgctaagaatagcaggctctcttcaggggaaattcagtccctcttcccaccatggacttgacctcatcaggctctccagcctgccccagaccacctaccgacagggactcatgatgatagtttgagagtgaatacattcaaggcccaaccccagtactttacatatctcccctccaaatctagaaaccaatgccttggctccctatgttcctacaacttggctttttctgcataaatcccctttcaaagctcttgtcttagagccagttgatactgatcgacacatattttaattaaatttgcatttacctattgattttcatacccagtctcattccaaaaaggattggaggcagcttctaacatttcaatgtgataatcactttgataaatctgccttaccacccctgttcacaaacacctgtatctacatccacgaaatatagatgatcttcatagtttaattgtaaaacaatacacaaaacacctttgaaacctggctccaagttttaaaataggtgcattgtactttgtatgctaagaagtttcagacaggattgggcgtcctggccacagaaatagagtcttgtgggagacccccagtttggattcagagtttgggatggccagaagtatgaccacattgattttctttccttgttaggtgtagagaaaaagaggtacacaggttgtgttgaagagcagagtttcgtccaaaccaggtgtttggagcattggaggagggaaattttcctcccttccaggagcccctccagcatcccagatcttgccaactcagaccctttcccagacaaacttgcctctcatccctcagggagtcagttgatcccagctggaactgtaatcctttgctaaaaggcctcttggctgaagcccagctcagcagggaagggttcagctttgtccttggggggcttctgcaggaggtcccattcttggggactctgacactgtgggaatctggcaggtgccccttcccaggttcacagaggttgctttggggggttgcaacaggacttgcttctctggtgtttatctcagtgaaattcaagaaagtccatgtgcagtttcatcctgggataaaggagggtcttctcttcctaccagcaactccaggcaagatactctcctcagcccaaagggctaaagagaaggcaaagggaacaaaggaaggccattttactcattgttgttgaacttaaaatgtgtaattatcttctgaaaacagctgaagggcttatgtaaagcatgacacaggagaaggtatttaaacatgaaacaaggcagcatcttttgctggagcagaatacctgctttccaaactccagatcgactttggaggaggagaatagcatgacagcctccatgtgtgagtcctgtcaacacttggcatccaccttcccattcacttttcacaacactgcatggtaaaccatttcacagataaagaaatggagtctcagagaactggagtaaattgcccaaagatgcacagctactcaataatagaacctgaatttgaacctgctgggtaattctagagccctcagccttagccactacacagcgctccttcccatactgtcactacccatagtcgttcagccatgcattccctagccactaaggcaaagcaaaagataatgggctcaatgaacctcacccctcagatgggctaagtcacacggcacttttgttttcattgtgaatgcccatcagtgaggcacatactgcctgttacagcagatctgcttcgtgcatttgtaagttttgcctgaccctggtgtgcatttgagtttgcgattccaggactacaacatttctaataggaaaaatgtcagctctgtcttattctgatattgacatgctttggggatgccttaggaggctaggaagccttctaagtagcttctgaatttaacacatttctatagaactgttacaagctggttgggaatgtggaagcatgctcaccaaagacggttttcattaggctcaaatcaatgatgagcttttcctgagaacttgaggctttaggagagagtagcatgggccgttggattattataacaacaacaacaaaaagattttaatacatttttctctcattgttttgcctgatgacagatgcaatcccagatcacaggcatttggtgcatgagagcttttctgtttacaggtgtccactgtgccttggagagggctggggcaccgccctagggattgttatttcagacaagaacttcaccctacaaagtaaaggcaagacaaaatgtcattgtcccttttatgcatcacagaggcacattggacttgtagaaggagcataccttttagacactaggtggactaggtaaaacctggatttgaatccagctttttctacttcacagttgtatgacctaggacaagttacatcaagtacatttttgagtccagtttcctcatcagggaaatgcagataaaaatacagactttgttaaggtaccgtaaggattagaggtgatatatggaagaccccatgcagggaagaccccctggaagactctttgtagttgatctagatattatcaggagcagcgtgggacatgcggcactgcacatgctggccactagcttgcacagcaggtcctcaaataatgtcatgtttttgtttttgtttttctgagacagggtcttgctctgtcacccaggctggagtgcagtgacacaatgctggctcaacctcctgggctcaagagatccttccacctcggcctcctgagtagctgggatcacagaaccttccactggccactcagcgaaaggcagctgattcagcacctggagaagaccggcaacagggctgagtttccttgcactgcagaggaggggagaggcaaggagtggacatgagcacggaggatccagggcactcccttgatggtgatgccctcgaagggctgccccgtgcccattgtacagaatgtggattccaccccacgccatgagagctctcgcgcaggcccagaccactttataagccatatttcccaccaattcctgtttctggatctgtcaggttatttcatatttctaggcccttagctttgcttcctcttccctgaacgccctttgcccacatcatcccagctctccttctcctcctgccttctgtcttctcttcctctcatttcttgtcacccaggctggagtccagtggcgtgatcacggctcactacagccttgaactcccgggctcaggtgatcctcccacctgagcctcccgagtagctgggactacagatgcacaccaccatgccagctaatttttaaaactgtttttagggatggggtcatcttcctgtgttgcccaggcttgtctcaaactcctgggctcaagtgatcctctcacctcagccttccaaagtgctgggattacaggcatgagccacaacatccagccccttttctcttttcttacccttctttcctattttcttttccattttctttccctcccttcttctttctttcctaactattaaggagtagattgaattcaaggtctttatgtgtgtcagtttttgttttccaacaaatatttcttaaaaaccaaccattgaaacgtaatggtaaccactggcccctgtctccacctccacacctaagaagccccaaatccagatgtgtccattaaaatcagtccagatcttctttaccaagccactagatgtcatattaatttcacagcagaatagggaagcccatgccggagctgaaaacctgcaacaacaaaaaagcatctaaatactgcaaaaaaaaaaaaaaaaaagagggagagaggcatcttaatatttgtccttaacacatcataccagacttctgcttccaggaatgactggatgtggtttttctaggtggacataatacaaaatgcagctacctgaaaacaatggaaagtggacagagcaggcagattctggtgggaagtccacgcaataaagaaaagatgttacaggaagtgagcgcccatttttgctgtttttagcttggaggcaggtgcagccattgtgcaaaccaggtgtggtgctggtggaaaaacagccatctttttggactatgaaaatggaaggttgagttcagggcaactataactgccaaaagagagaagaaagagttctggaagagaaagagccaaagagggaattcccaaattctttctgctcctgtctgtggctgatcccaaaccacggacacacacagcaaaaacaaaagcatctcagccagagacaaaagagtctaaaagagactggacctgccacctgagaaacagagtttgaagttagagttcaatcacaaaaaaatgcctgctaaaacaaaataaacaaaacctattagagaaaaggtgttctcttatcagaatgtagggcctccacaacttaacgtttataatgtgtacaatccaaacttattcgacatatgaagaactggaaaagtgggacccattctcaagggaaaagatagcggagattcactccaagatgacccagatgttggaattatccaccaaggattttaaagctactattataactgttctcatgctataaaatccactatttagatcatacttaattgtgaagaaatgaattctttcctcctaagattagaaacaaggacggcatgaatacccactttcactactaacactgaattttgtacgaaggtcccagtcagttcaatatttttaaaaagattttaaaaaaagcaataaaaggcatacatattggaaagggaaaagtaaactgtctaaatttgcagatgacaaggtcatataatggtttaaaaaaagctactagaacaatatgtgagtttaccaaggttaaaggatacaaggtcaatatgccaaagtcaagtgaatttctatatatttgcaatgaacaattcaaaatggagttttaaaacatttttatttatgatagtctccaaaatactttttaagaaagaaaatgacagaagcaacccaagtgtctactgatggataattaaattatagtatataaatacaatggggccgggtgcagtggttcatgcctgtaaacccagcactttgggaggctgaggtgggaggatcactcgagcccaggagttcaagaccagcctgggcaacatggtgaaaccccatctctagaaaaagtacaacaattagctgagcatggtggtgcacacctatggtcctagctactaggaggctgaggtgggagatcaccggagcacaggaggttgaggctgcagtgagctgtgattgtgccactgcactccagcctgggtgacagagcaagaccctgtctcaaacacatatatacatacatatgtggaatacaatggaatatttacttaaaaaagaaagaaaattccgacaacatggatggaccttgaagatattatgttgagtgaactagtcacaaaaggacaaatactgcataattgtacttttatgaggcacttagagtaatcaaactcagagacagaaagtagaatgctggttgccaggggctggtagaatggaaagttattgtttaatgtttataaagttttagttttgcaagataaaaagatttctgtggatggatggtggtgatggttgcacaatgtgaatgtacttaatgccacttaaaaatggtcaagatggtaaattttatgttatgtgtattgtaccacaattttctttacaaggtctcaagttggacattaaaatgccaggcaattaaaagtatttatgtttaaaacttaatttaaaaaataattgacaagtatattctaaaatttgttcgagaaggcaaaggacctagaatagcaagaatactcttaagaaaggaaaacaagtttggaaggacttaaactacctgaattcaagacttatcattaagatacagtaatcacaacagtgtgttactggcataaagatagaccatatgagatcaatggaacaaaataaaagctttaaaatgcaccaatacttatatggtcaattgattttcaacaatggtgccaaagtaatttaatggggaaaagatagtcttttcaaaaaatggtgttagaacaactggatatatatatatatccattatatatatacactcatttatatatacatcatatacatgtatgtatcatatatatgtatatagcctcaactcttatttcatatcatatacaaatatttgaattgattgtagacctaaatgaaggagctaaagctattaaacttttagaagacagcataaaagaatttccttccttctgccttgccttgccctgccctgccctgccttgccctgccttgccctgccctgccctgccctgccctgccctgccctgccttgccttgttttgtaacagagtctcactctgttgcccaggctggagtgcagtggcgtgatctcagctcactgcagactcaatcacctgggcttaagccatcctcttgcctcagcgtcctgagtagtttggactacaggcatgcgccaccacacttggctaattttagttttgtttttttgtttttgtttttttgtagagacaaggtttcattatgttacccaggctggtctcaaacttctggactcaagcaatcctccctcctcggcctgtaattatttcttaaacagggcacaaaaagcacaaatcacataagaaaaaaagataaaacagacttcatcaagatttaaagcttttcctcctcagataacgagttgagaaaacaaagacaagccacagattgggagaaaacattggcaaaacagctattaaaaaagccttctatccagattatataaagaacccttaaaactcagtaataaaaagacatacatagtaagtaatgggcaaatgatttgaacaatcactttataaaagaagataaatgaatagccaacaaacacataaaaagatgctgaacatcacaagtcattcaaggaagtgcaaattaaaataataataaaatactattaaatgtccactagagtggccaaatttaaaaaaaatgaaaatcaccaggtattgtggctcacacctgtaatcccagcactttgggaggctgagatgggccaatcacttgagcccaggagttcaagactggcctgggcaacatggcaaaaccctgtctttacacaaaatacaaaaattagcctggagcatatctatagttccagctactcagggggctgaggtgggaggatcgcttgaaccctgggaggccagtctgcagtgagtttagatcatgccactgtactccagcctgggtgacagagcaagacactgtctcaaaaaaaaacaaaaaacaaaaaaaaaccccaaaaaataaaaatgtgaggaactctcacacatttacacattgctgaaggcaatgcaaagtggtacagtcaggccggaaaacagagtgacaaggtcctataaaggagtggtcccaacctttttggcaccagggaccagtttcatggaagacaatttttccatggacagtgggggaagggaatggttttaggatgattcaagctcattaaatttattgtgtactttatttctattattattacattgtaatatataatgaaataattatacatctcaccataatgtagaatcagtgggagcactgagcttgttctcctgcaactagatgatcccatctgggggtgatgtgaaacaatgacagatgatcaggcattagattctcataaggaacacacaacctggatccctcgcatgtgtagttcacaatagggttcatgctcctatgagaatctaatgcctttgctgatctgacagaaggcagagctcaggcagtaatgcgactgatggcaggtggctgtaaagagagatgaagcttcattccctttcctgccgcacacctgctgtgcagccccattcccaacaggccaccgacaggtactggtccaataaagtggaagatatccttaccagtaacccaacaatcccttctcctagagaaatggaaacacatgttctcacaaagacaagtatgcaaatgcacatagcagcattattcattgtagccaaaatttgaaaacaacccaaatgtccatcagctggtgaatagatccattgtggtacatctatactgtgggatactactcagcagtaaaagggaatgaactattgatacacaaaacattatagatgaatttcaaacacattatgctaagtgaaaggaatcaaatacaaaagactacattctgtatgactaaatttatatgaaattttagaaaaggcaatattacagggaagggaagcagatcagcatatacctgaggctactaagccaggtgaagggcaggttgcaaaggggtatgagaggcttttagcaagtgatggatgtgttctgtatctttattgtggtgacatttacatgactgtatacaattacccaaagtcattaaattatacaattaaaatatatgaattgtactgtattgtaaattatacttcaatacagctgaagaaaaagtcaacaacaaccacaaaatcacagccaaagggctcttctctatggctgaaagatattgggtccacatattccagagtcccttgtactcatatcatggtctactatataaataaatcataatttatttttaaagttaatcattgctgaacatttgtaatgtttataatttctttcttttttgagtggaccaatggaggggtgtaacgttcttctatgagtccctggagcacttttgcaagtaattctacatataaaatgtgttgggttatagattataaatgtactcatgtttcttttttcatatgattttattcttttttagaatttcatttgaatagaatcctaccttatgtagtctttcttattaatacataatagtatatatttgggggttatatctggtatactgatactttcatgtaatggtaaaatcagggtaattgggatatccatcaccttgaacatttttctttatgctgggaacatttgaattattctcttttagttacatatttatcttttatgctgggaacatctgaattattatcttctagttattgtcaaatatgcaacagatatattattaactatagtcaccctactgatcgattgaacaggtcttatttcttctacctaactgtattttggtacccattaatcaacctctctttatatccccctcccctccacacttcctggcctctaggaaccaccaatctactctccatcttcatgagatccactttattagctcccacatatgagtgataacatgtggtatttgtctttctgtgccaaacttgtttcacttaacacaatgaccatgttgctgcaaatgacaggatttcattcttttttatggctgaataatattccattgtgtatatataacacgttttctttgtccaatcatccattgatggatacttaggttggttccatactttggctattgtgagtagttctgcaataaacatgggattgcagttatcttttcaatatattgatttactttcttttggatatatacccagtagtaggattgctggatcaaatggtagtcctatttttagttttttgaggaacgtccacactgctttccatagtggctgtactaacttacgtccccatcaacagtgtacaagtgttccctttttccccacacccttgccaacatccaatattccctattttttaaataatagccatcttaactagggtgaaatctcactgtggttttgatttccatttctcggatgattggtgatgttgagcattttttcatatacctgtaaaccatttgtatgtcttcagaaatgtctattcagatcttttgtccatttttattgggttatttttttttgctattgaattgtttgaattccttatgtattctagctattgatcccttgtcagatggatagtttgcaaatattttcacttattctgtgggttgtatctttattgattgtttcctttgctgtgcagaagctttttagtttgacataattgtatttgtctaatttttgcttttggtgcctgtgcttttgaggtcttactcaaaaaatctttgcacaggccaatgtcctacagcacttctccagtgttttcttctagcagtttcacagtttcaggacttacactaagtatgtatgtatgtatgtatgtatgtttttatgtatgtatgtatgtatttatttatttatttattttgagatggagtctcactctgtcgcccaggctggagtacagtggcacaatctcgtctcactgcaacctctgtctcctgggttcaagcgattctcctgcctcagcctactgagtaactggtgcacaaccccacagccactaactgtttgtattttaggagagatggggtttcaccatgttggccaggccgggctcgaactcctgacctcaagtaatccacccgcctcagcctcccaaagtgctgggattataggtgtgagccactgcgcctggccacatttaagtctaatccatttttggtttttttcatatggtgagagataggggtctagttttattcttctgcatatggttatccagttttcccagcactatttattgaagagattgtcctttccccattgtatattcttgtcaccttgtcaaaaatgtgttggctgtaaatgcgtgaattgattctaggttctccattcagttccattggtctatgtgtctgtttgtatatgagtatcatgctatgttggttactgtggctttgtagtatattgtgaagccagagtgatgtgatgcctccagttttgttttgctctggattgctttggttatttgggtcttttgtggttccatatacattttaacattgttcttttctatttctgtgaagaacgtaattagaaaattcattgtgaaagggattgcattgaatctgtaagtagctttgggtagtattgacattttaacaatattatttctttcaatccatgagcatggaatattttttcaatttttgtgtgttctcttcaatttctttcatcagtgttttattattttccttatggagatccttcacttctttggtttaatttat

SEQ ID NO: 1662 - DNA, 32743 bp, Homo sapiens; identical to SEQ ID NO: 1661

SEQ ID NO: 1663 - DNA, 16426 bp, Homo sapiens
ggcccgcccctcgcagccttgccgcgccccgtgcgccctgtccgcccctcgctcgcattgcaggcatcctgagtctcggcccttttcgccaaatcgctgctctgccgcgcgcctacgcaaggaaagattcaagggtccctccacttcagggagtggagcccgcgcctcggcacggatcagctgtgcgtctcctttggcctactggctcctctgcttgtgtctatagctagctggacgcatcgtgactttatcttctcatctttcctggcgcccccagacgcatttcctggtccctcgaggcagcggcgtctggggagtgcactttgcacagacagggaaaccgaggcactcagcggtctccaatggagacgctgtaatcgcattccacgaccagctagcgctataagcgctgcctctaaagcggaaggcctcccagtccttctcgacaggaagcaatatttgcatatctaaggagaacaagattcggcaatgtgctccgggagcaagtgcaggcatggaacggtatgggctggagggggacagaccttcagaggcggctgcccgttccctgtagtgtcacataagatttttagaagataggagttttcacagtggcggcagagccctctgctaaatcctcatattagatgtcaaaggtggcatgtcatttgacccaatggcttttttagtcatttatcttcctaacacctatgagagaaactgcttgcttccctctcaccctctgcagtttcctgaggcctccccagccatgcggaacgcctgcttccatatcgtaaactgccttggaaccaattaccactaccagggagacaaactattgcttagaggatgctgacaggagcagcatgccaaaattggaagaaggagaaagtttaagctctcctcactatgagttttcaagtataaaagactttttcttccacgattttgagaacaactgaggactcttgtgaccaggacaacagggaagcttgcagcaagatagctccaggttggattcatgcttcgcaccccaagggctgccagccagagaggaggagaagcaatcactcctgcagtttctgaacactacacagacgccaggtagcttcttcaggagaacagccctctgaggaggcaggaagaggaggcttatctttcagcagccggagctgctgagatctctgggcagattaagctctctctaatggatgggctccagcctggcacattcagtggagagggatccactcatccatcatcaacataatatggtcctccctgcacttcacagtgtcctcttgctattgaaaaggcttttttgccttctcaagtttctttgtcaacagtctacaggaagaagctcaggccgccaccggcagaggtgaatgcaagctcacgttttatttctgactgcttaatcattgcctcgatcactgctcaagctctgcctttgtttccaaaggttacctgtgggaaaacttctttttctatgctgaaattaatagggaggcaaagatgagtccactgataagcagagccttaaaactcacatagagaaacaactttgctggagtgtgtgtgagtgaaccactaaggaatcagatagtgtgatggcagttatcattgcaggttaagacatttctacaaatatttcgacatctccatatactcactcctttcccccctgagtggagagactcagctaccaagagaggaagctcaaaaaaaacagaagcttcaaacaaacaaccaaccaaaaaaaaaaaaaaactgtgggttcatcagaggtggtagggaagacaaaaacatgggaggagcagctgggcacggtggctcaagcctgtaatcccagcactttgcgaggctgaggtgggtggatcacctgaggtcaggagttcgagaccagcctggccaacatggtgaaaccccatctctactaaaaatacaaaaaattagccgggcgttgtggtacgcacctgtaatcccagctactccggaggctgaggcagcagaatcgcttgaacccaggaggcagaggttgcaacgagccaagatcgcaccattgcactccagcctgggcaacaagagcgaaactccatctaaaaaaaacaaacaagcaaacaaacaaaaaacacgggaggagcaataaaaaggaatccatgctttgatttttttttttagtgagaggaagggaaggctgctgcctctcacttctccctgttttgttgttcttttaagtagcatgtgtcactctgtatatatcctgtccatgtgttttcttttattattatttgtccacttgcctagaatgaaaactccatgggagcatggctatagtgtcttgttcactcctgcctctccagggcctgaaacagaagtaggtagacagagcctgaaacaaaagtaggcagtccataaactttgctgaaggaatgagtgaatgaatgaagaccccaaggatggacctcaggaagaaccttccactggccactcagcgaaaggcagctgattcagcacctggagaagaccggcaacagggctgagtttccttgcactgcagaggaggggagaggcaaggagtggacatgagcacggaggatccagggcactcccttgatggtgatgccctcgaagggctgccccgtgcccattgtacagaatgtggattccaccccacgccatgagagctctcgcgcaggcccagaccactttataagccatatttcccaccaattcctgtttctggatctgtcaggttatttcatatttctaggcccttagctttgcttcctcttccctgaacgccctttgcccacatcatcccagctctccttctcctcctgccttctgtcttctcttcctctcatttcttgtcacccaggctggagtccagtggcgtgatcacggctcactacagccttgaactcccgggctcaggtgatcctcccacctgagcctcccgagtagctgggactacagatgcacaccaccatgccagctaatttttaaaactgtttttagggatggggtcatcttcctgtgttgcccaggcttgtctcaaactcctgggctcaagtgatcctctcacctcagccttccaaagtgctgggattacaggcatgagccacaacatccagccccttttctcttttcttacccttctttcctattttcttttccattttctttccctcccttcttctttctttcctaactattaaggagtagattgaattcaaggtctttatgtgtgtcagtttttgttttccaacaaatatttcttaaaaaccaaccattgaaacgtaatggtaaccactggcccctgtctccacctccacacctaagaagccccaaatccagatgtgtccattaaaatcagtccagatcttctttaccaagccactagatgtcatattaatttcacagcagaatagggaagcccatgccggagctgaaaacctgcaacaacaaaaaagcatctaaatactgcaaaaaaaaaaaaaaaaaagagggagagaggcatcttaatatttgtccttaacacatcataccagacttctgcttccaggaatgactggatgtggtttttctaggtggacataatacaaaatgcagctacctgaaaacaatggaaagtggacagagcaggcagattctggtgggaagtccacgcaataaagaaaagatgttacaggaagtgagcgcccatttttgctgtttttagcttggaggcaggtgcagccattgtgcaaaccaggtgtggtgctggtggaaaaacagccatctttttggactatgaaaatggaaggttgagttcagggcaactataactgccaaaagagagaagaaagagttctggaagagaaagagccaaagagggaattcccaaattctttctgctcctgtctgtggctgatcccaaaccacggacacacacagcaaaaacaaaagcatctcagccagagacaaaagagtctaaaagagactggacctgccacctgagaaacagagtttgaagttagagttcaatcacaaaaaaatgcctgctaaaacaaaataaacaaaacctattagagaaaaggtgttctcttatcagaatgtagggcctccacaacttaacgtttataatgtgtacaatccaaacttattcgacatatgaagaactggaaaagtgggacccattctcaagggaaaagatagcggagattcactccaagatgacccagatgttggaattatccaccaaggattttaaagctactattataactgttctcatgctataaaatccactatttagatcatacttaattgtgaagaaatgaattctttcctcctaagattagaaacaaggacggcatgaatacccactttcactactaacactgaattttgtacgaaggtcccagtcagttcaatatttttaaaaagattttaaaaaaagcaataaaaggcatacatattggaaagggaaaagtaaactgtctaaatttgcagatgacaaggtcatataatggtttaaaaaaagctactagaacaatatgtgagtttaccaaggttaaaggatacaaggtcaatatgccaaagtcaagtgaatttctatatatttgcaatgaacaattcaaaatggagttttaaaacatttttatttatgatagtctccaaaatactttttaagaaagaaaatgacagaagcaacccaagtgtctactgatggataattaaattatagtatataaatacaatggggccgggtgcagtggttcatgcctgtaaacccagcactttgggaggctgaggtgggaggatcactcgagcccaggagttcaagaccagcctgggcaacatggtgaaaccccatctctagaaaaagtacaacaattagctgagcatggtggtgcacacctatggtcctagctactaggaggctgaggtgggagatcaccggagcacaggaggttgaggctgcagtgagctgtgattgtgccactgcactccagcctgggtgacagagcaagaccctgtctcaaacacatatatacatacatatgtggaatacaatggaatatttacttaaaaaagaaagaaaattccgacaacatggatggaccttgaagatattatgttgagtgaactagtcacaaaaggacaaatactgcataattgtacttttatgaggcacttagagtaatcaaactcagagacagaaagtagaatgctggttgccaggggctggtagaatggaaagttattgtttaatgtttataaagttttagttttgcaagataaaaagatttctgtggatggatggtggtgatggttgcacaatgtgaatgtacttaatgccacttaaaaatggtcaagatggtaaattttatgttatgtgtattgtaccacaattttctttacaaggtctcaagttggacattaaaatgccaggcaattaaaagtatttatgtttaaaacttaatttaaaaaataattgacaagtatattctaaaatttgttcgagaaggcaaaggacctagaatagcaagaatactcttaagaaaggaaaacaagtttggaaggacttaaactacctgaattcaagacttatcattaagatacagtaatcacaacagtgtgttactggcataaagatagaccatatgagatcaatggaacaaaataaaagctttaaaatgcaccaatacttatatggtcaattgattttcaacaatggtgccaaagtaatttaatggggaaaagatagtcttttcaaaaaatggtgttagaacaactggatatatatatatatccattatatatatacactcatttatatatacatcatatacatgtatgtatcatatatatgtatatagcctcaactcttatttcatatcatatacaaatatttgaattgattgtagacctaaatgaaggagctaaagctattaaacttttagaagacagcataaaagaatttccttccttctgccttgccttgccctgccctgccctgccttgccctgccttgccctgccctgccctgccctgccctgccctgccctgccttgccttgttttgtaacagagtctcactctgttgcccaggctggagtgcagtggcgtgatctcagctcactgcagactcaatcacctgggcttaagccatcctcttgcctcagcgtcctgagtagtttggactacaggcatgcgccaccacacttggctaattttagttttgtttttttgtttttgtttttttgtagagacaaggtttcattatgttacccaggctggtctcaaacttctggactcaagcaatcctccctcctcggcctgtaattatttcttaaacagggcacaaaaagcacaaatcacataagaaaaaaagataaaacagacttcatcaagatttaaagcttttcctcctcagataacgagttgagaaaacaaagacaagccacagattgggagaaaacattggcaaaacagctattaaaaaagccttctatccagattatataaagaacccttaaaactcagtaataaaaagacatacatagtaagtaatgggcaaatgatttgaacaatcactttataaaagaagataaatgaatagccaacaaacacataaaaagatgctgaacatcacaagtcattcaaggaagtgcaaattaaaataataataaaatactattaaatgtccactagagtggccaaatttaaaaaaaatgaaaatcaccaggtattgtggctcacacctgtaatcccagcactttgggaggctgagatgggccaatcacttgagcccaggagttcaagactggcctgggcaacatggcaaaaccctgtctttacacaaaatacaaaaattagcctggagcatatctatagttccagctactcagggggctgaggtgggaggatcgcttgaaccctgggaggccagtctgcagtgagtttagatcatgccactgtactccagcctgggtgacagagcaagacactgtctcaaaaaaaaacaaaaaacaaaaaaaaaccccaaaaaataaaaatgtgaggaactctcacacatttacacattgctgaaggcaatgcaaagtggtacagtcaggccggaaaacagagtgacaaggtcctataaaggagtggtcccaacctttttggcaccagggaccagtttcatggaagacaatttttccatggacagtgggggaagggaatggttttaggatgattcaagctcattaaatttattgtgtactttatttctattattattacattgtaatatataatgaaataattatacatctcaccataatgtagaatcagtgggagcactgagcttgttctcctgcaactagatgatcccatctgggggtgatgtgaaacaatgacagatgatcaggcattagattctcataaggaacacacaacctggatccctcgcatgtgtagttcacaatagggttcatgctcctatgagaatctaatgcctttgctgatctgacagaaggcagagctcaggcagtaatgcgactgatggcaggtggctgtaaagagagatgaagcttcattccctttcctgccgcacacctgctgtgcagccccattcccaacaggccaccgacaggtactggtccaataaagtggaagatatccttaccagtaacccaacaatcccttctcctagagaaatggaaacacatgttctcacaaagacaagtatgcaaatgcacatagcagcattattcattgtagccaaaatttgaaaacaacccaaatgtccatcagctggtgaatagatccattgtggtacatctatactgtgggatactactcagcagtaaaagggaatgaactattgatacacaaaacattatagatgaatttcaaacacattatgctaagtgaaaggaatcaaatacaaaagactacattctgtatgactaaatttatatgaaattttagaaaaggcaatattacagggaagggaagcagatcagcatatacctgaggctactaagccaggtgaagggcaggttgcaaaggggtatgagaggcttttagcaagtgatggatgtgttctgtatctttattgtggtgacatttacatgactgtatacaattacccaaagtcattaaattatacaattaaaatatatgaattgtactgtattgtaaattatacttcaatacagctgaagaaaaagtcaacaacaaccacaaaatcacagccaaagggctcttctctatggctgaaagatattgggtccacatattccagagtcccttgtactcatatcatggtctactatataaataaatcataatttatttttaaagttaatcattgctgaacatttgtaatgtttataatttctttcttttttgagtggaccaatggaggggtgtaacgttcttctatgagtccctggagcacttttgcaagtaattctacatataaaatgtgttgggttatagattataaatgtactcatgtttcttttttcatatgattttattcttttttagaatttcatttgaatagaatcctaccttatgtagtctttcttattaatacataatagtatatatttgggggttatatctggtatactgatactttcatgtaatggtaaaatcagggtaattgggatatccatcaccttgaacatttttctttatgctgggaacatttgaattattctcttttagttacatatttatcttttatgctgggaacatctgaattattatcttctagttattgtcaaatatgcaacagatatattattaactatagtcaccctactgatcgattgaacaggtcttatttcttctacctaactgtattttggtacccattaatcaacctctctttatatccccctcccctccacacttcctggcctctaggaaccaccaatctactctccatcttcatgagatccactttattagctcccacatatgagtgataacatgtggtatttgtctttctgtgccaaacttgtttcacttaacacaatgaccatgttgctgcaaatgacaggatttcattcttttttatggctgaataatattccattgtgtatatataacacgttttctttgtccaatcatccattgatggatacttaggttggttccatactttggctattgtgagtagttctgcaataaacatgggattgcagttatcttttcaatatattgatttactttcttttggatatatacccagtagtaggattgctggatcaaatggtagtcctatttttagttttttgaggaacgtccacactgctttccatagtggctgtactaacttacgtccccatcaacagtgtacaagtgttccctttttccccacacccttgccaacatccaatattccctattttttaaataatagccatcttaactagggtgaaatctcactgtggttttgatttccatttctcggatgattggtgatgttgagcattttttcatatacctgtaaaccatttgtatgtcttcagaaatgtctattcagatcttttgtccatttttattgggttatttttttttgctattgaattgtttgaattccttatgtattctagctattgatcccttgtcagatggatagtttgcaaatattttcacttattctgtgggttgtatctttattgattgtttcctttgctgtgcagaagctttttagtttgacataattgtatttgtctaatttttgcttttggtgcctgtgcttttgaggtcttactcaaaaaatctttgcacaggccaatgtcctacagcacttctccagtgttttcttctagcagtttcacagtttcaggacttacactaagtatgtatgtatgtatgtatgtatgtttttatgtatgtatgtatgtatttatttatttatttattttgagatggagtctcactctgtcgcccaggctggagtacagtggcacaatctcgtctcactgcaacctctgtctcctgggttcaagcgattctcctgcctcagcctactgagtaactggtgcacaaccccacagccactaactgtttgtattttaggagagatggggtttcaccatgttggccaggccgggctcgaactcctgacctcaagtaatccacccgcctcagcctcccaaagtgctgggattataggtgtgagccactgcgcctggccacatttaagtctaatccatttttggtttttttcatatggtgagagataggggtctagttttattcttctgcatatggttatccagttttcccagcactatttattgaagagattgtcctttccccattgtatattcttgtcaccttgtcaaaaatgtgttggctgtaaatgcgtgaattgattctaggttctccattcagttccattggtctatgtgtctgtttgtatatgagtatcatgctatgttggttactgtggctttgtagtatattgtgaagccagagtgatgtgatgcctccagttttgttttgctctggattgctttggttatttgggtcttttgtggttccatatacattttaacattgttcttttctatttctgtgaagaacgtaattagaaaattcattgtgaaagggattgcattgaatctgtaagtagctttgggtagtattgacattttaacaatattatttctttcaatccatgagcatggaatattttttcaatttttgtgtgttctcttcaatttctttcatcagtgttttattattttccttatggagatccttcacttctttggtttaatttatttatagatcttgtatatttttggtagctattgtaaatgggattgctttcttgatttccttttcagattgttcactgccagcatatataaatactactaatttttgtgtgctaattttgtatcctgcaactttactaaattcatttatcaattttacccatttttggtggagtcgtcaggtttttcaaattataagattatgtcatttgcaaacaaagataatttgatatttttctttccaatttttctctttctttctcttgactaattgctctggctaggacttccagtgttatgttgaataaaagtggcgaaagtgggcatccttgtcttgttccagatcttagaggaaagactttcgattttttcccatttggtataatgctatctgtgggtttgtcatatacagcctttattgttttgaggtatgttccttctgcacccagtttgtggaaagttttttgtcataaaaggatattgaattttatcaaatgctttttcagcatctattgaaacgatcatacggattttgaccttggttttgatgtgatgtattatattattgatttgtgtatgttgaaccagccttgcatcgctgggatgaaacccactggatgatggtaaattatctttttaatgagctgttgaattcagtttgctagtattctgttaaggatttttgcatctgtgttcatcagggatattggcctgtatctttctttttgttgtgtccttgtctggttttggttatcagagtaatgctggccttgtagaattagtttggtcctcactcttcaatttttttgaatagttggaacagaattggtattacttcttcttcatatatttgctggaattcaacagtgaagccatcagattctgggcttttctttggtggaaaactttttatcatggctttgatctcattactcattattggtttgttcaggtcttccatttctttgtggtttaatcttggaagattgcatgtgtccagaaatttattcttctgttttccaatttgttggtgtatagttgttcataatagtctctgattctttgcatttctgtgctgcctgtacttatgtcttcattttcatttctaatttgatttgggccttctatatttttttcttagtgtagctaaaagtttgtcaatttatttatcttttcaaatagccaattttaaatttcattgattttttgtattttttttagtctcaatttcatttgtttctgttctggtctttattatctctttcctgctaataattttgggtttggtttgttcttgcttttctagttccttgaggtacatcgttaggctgtttatttggaatctattttttgatgtatgcatttattattataaacttcctcttagtcttgcttttgctgtatcccatagattttggtatgttgtatttccatttttgtttcaataaatttttaaaccactttcttaattttgtcattgacccattgattgttcatgagtatgttgtttaatttccatgtgtttgtatggtttccagtttcctcttgtttttggtttctagtttcattccattacgatcagaaaatatatttaatataatttcaacttttttgaatttgttgagacttgttttgtggcctaagatatgatctattctggacaatgctctgaagagaagaatgtatattctgcagcaattgggtgaaatgttctgtaaatgtcagttaggcctatttggtctagtgtgtagtttaactccaatgtttctttcttcaatgatttgtccgttactgagagtcggaagttgaagtctcccacaattattattttgcagtctctttctttaaatctattagtgtttgcttcatacacttgggtgctccagtattgggtgcatagatatttataactgtaatattgtcttgctgagctgacccctttatcgttatgtaataccttggctctttttacagtctttaacttgtagtctattttatctaagtatagctaatcttgcaattttttggtctctatttgcatggaatatctttttccatcccctatttcagtctatgtgtgtctttgtaggtgaagtaggttttttataggcagcacatagttggatattgtttatttattcagcctctgtatgtcttttacttggagaatttaatccatttacatttaatgttattattgatagggaaggacttactactgccattttgttacttgttttctagttgttttgtaactcctctcttcctttcttactgttgtcctgtgtggttattttctattgtagtatgttttaatttgttgttttttatttttagtcaatctattgtaggtttttgctctgtggttaccatgaggtttaggaaaaaaccactgtattgttactaaaagttattattttaaaaaggtgacaacttatctttgatcataaaacatatagaaacaaaggaaaaactgaaaaaaaatctacattttaacttcatcactactcccaccctgccccattttaacatttggattttctacatatagaagtttatcatattagcataatgacagattgaatttcaatcttcatttatttatttttcttgccttactacactgtctagaaccttggtatgttgagtagatgtcttaatgtaggcattcttgtctcattcgcaacatcaaaagaaatgtttttattgtaagctgattttttttttagtagatactcttatcagttcagaaaggtttcttctagtcctaatttgctaagtttttaaaaatcatgaatggacataaacaacatttgtttctcacaattctaaaggctgagaggttcaggatcaaggtgctgacagattctgtatcttgtgagcaccattttctgagtttgaaaatggcctccttctcgccatctcctcatatggtgaacagaaagggaggactctagccttttcttcttataagggcactaatcctatcatggagtccctaaccccatgactcatctaaccttaattacctcccagagactccacctccaaatatcatcacattgggaattagagattcaacatatgaatttgggaaaggaaggacacaaatattaattccacagcagacattggattttatcaggtgtatgtgtcttcatctactcagatgatctatgatttttctctcatcttttaatatgaattacatgggttgattttctaagttaaattaaccttgcattcttaaaatgaaccccattttgccttcattatgctttatatacatcgttactcttaaattgctaatattttgtcagtttctattatgcatgagattagcctatattcttcctttttcatattgtcttcttgttggtattttagccttatcaaataaatgggaaagcatacttagaaacacactttgtgtaccttctcagattcccttaactgcctccctctttccttcccttggtgggcaccccacacatgccaggtttccccttcacttttgaactttaataaaacaccacatcatagtacatggatctcaattcctgaacagctgctaagtcggcatgatgcaacacagatgaaatggcagtaatatccttgttgggtgaatgttactcaatgagaactgggagatgggagcttacctgacaggaagattacccccttttctctcttccactgactactccaagatattgttcctccttgcaacctttccaaaaacatccacattccaagaatctcacatactgagtaacctaacatgtcccttttgacttactatgaagtggtagtcaatatagtaatgcatcatatcacatttcattggatttcccttgctttatttctacttttctctcattcatactgtgctgaatttgcatttcccaaataaaatattagcatctttttcgagatggagtctcactctgtcattcaggctggagtgcagtggcatgataccagctcattgcaacctctgcctcccggcttcaagtgattctcctgcctcagcctcccaagtagctgggattacaggcaggtgcccaccatgcccagctaatttttgtatatttagtagagatggggtttcaccatgttggccaggctggtctcaaactcctgacctcaagtgatctgtccacctcggcctcccaacgtgctgggattacaggcatgagcgactgcgcctggtcaaatattagcatcttaatccttgcctcaggctccactttctagaagacctaaactaagaccaaaattgcctcctttgttctatgcactggagtattttatgtaagattccataattttgttcctttaaagtttgatagagcttataaaccatctaggcctgggtttttctgtgtggaaatactgggaagtactgttatctttaatgattttaagactattcagtttttctacatcttcatgagacaattttcctaagttatagtatttaaagaattcaccctgttatctatacttacaaatttattggcataaagtttatatagtatacttttattacctttttaaatacttgtattaatctttatatgacctgtaggaatgctcatattttcattcttatcgttttggttctttcagtcttgccagggttttatatattttatgagtatttttgaagaaccagttgctgactttgttcatctctattgtgttttctatttccaaggttgctcttacctttagtagttcctttttttttttttttggtttccattttgttattgtttaactttgtgtattgaatgactcatttttagtctctcttttctaatatgcacatttctaagcaggtctgcctatatgctctctaaatactgctctagctgcattccacatattttaataggatttgacagttttaatttccatgactttttcccatgactaattagaaatgtttattaattctcaaatacatggagctttcctaaagatgccttttatactgatttctatctgaaatccattgtggtcagagaatactgtgtgttttgtagcaatcctttgaaatacattgagacttgcttaatttgcaagtacaggttttcatatttttccatatgtgattggaaaaatattaatttgacaatttggggatatagtatacacacaatacacacaaacatatatgtattttcagtacttcaaaatttctacatatttcctggtatttgtctgcttgcttcattaattactgagagatgtacgattttgagttgtactttcttttgttgctctctcatttttctttcatatccttatggcaattgtattaagtgcataccaatttaaaattatttcaccttcatgaatgtcaccttttattacacaaagtgatattttctattaattcgcctaaataaactttgcacttgagtcctttttcagggtctgcttcttgggggaacctaaactacgacagttcgtctcccctggtatgttgtagcaccacgatagctaagactcccacctgtggtaaattggtattgggcccatcaggaaggggatacactcacttacgtaatctctagaatgatagagagatgggggtggtgttaattataaggatggtggaataggttggttgtt

SEQ ID NO: 1664 - DNA, 16426 bp, Homo sapiens; identical to SEQ ID NO: 1663

SEQ ID NO: 1665 - DNA, 16426 bp, Homo sapiens; identical to SEQ ID NO: 1663

SEQ ID NO: 1666 - DNA, 16426 bp, Homo sapiens; identical to SEQ ID NO: 1663

SEQ ID NO: 1667 - DNA, 16426 bp, Homo sapiens; identical to SEQ ID NO: 1663

SEQ ID NO: 1668 - DNA, 2674 bp, Homo sapiens
ttggcttgttgattccttttattctttgtattctatttcattaatttctactctattatttctttcccttcctgctactgcctctgagtttaatttacacttatgttatgggtgagtaatgcagacctctgagtcattgattgtgataccattcttcttttaatccttaggaattttacagagatatacttcatatatcacatatatatcatataattcttccgtttaaatatatttatagacgtgtgtaaccatcaataaaatcaatttttgaacattttcatcatcaccccaaaaaagactccacacccattggcagtcgctgctccttgttttgtaattcccaactcttttaacagaagccttgaaagctgtgcatttcactctaagaactggtgtagtggcatcccacacatttctacattttatataatcatcataatttattttgaaatattttgaattctcttttgatttcatccatgaactatgaattttttataagtatgttgcttaatattcacatattgggagtttttctagatatagttattaatttaatttcattgagatcagagaacatattttatataatttccttcatttcaaatgtttttagatttgttttatagttcacaatgtggtctatcttggtggaagtaccatgttcatagaaaagaaggaatctctggtacatgttgcatgtgtgtgctataaatgtcgattaacccatttatgcctgaggttgcaattttttgaaattttacaattagaccttggtgatgaccttgagcagtaggatataaatcattccacatgtttagtgttccaataatggaacactaggcataagtatttgtcaagatggttgacagtgttcagatctgttgttattttactgttttcatcagatcattctatcaattggtaagaagggggtgagatgatctccctttaatccttttgagtgttgcttcatgccttttaaagttctattattaggcatatacacatttatgattattatgccttctgataaattcacccttttaacactacaaatagtgcctttaaaaaaaatctctgcgaatagcaagtgaaaacctgacaacaagctcttggtgactctggacctgggcagtcctcagccttctgttcagctgctcttcccacctctcacatgaaacatgtctatgaaaggctgaggacatcacatctgcattcatgcgggcttcctagaacccacagtactcattcatccaaggagagcatgtcagtgcctggtggccacactatacaaggaatcgtggagtatcaggaataaggcacgaccctccctttccttaggacagttccagttcacagggagatgaggcacatacatcaataaccccaaagtccatgaaggtgcaaagagtcatgtggggctgcccaggcagaggtgacaaatgccactggtgacaggacactggtggacatagagggaaaagtccacacagacaggttcccaggcagacaggaagtcaaggcagttggggacgggagtcaaaacaagtgatgctgggacacagctctgaggtttgtgggcatctctgattgagggagatggaaggtgaggtcagagaatgaggttctcaattcatagatttgggctcataggggtgtgagagtgtgtgtgtgtgtgtgtgtgtgtgtgtgtgtgtgtaagagagcaagagagagaggtcttgttccaggtcttctcctccatagactctcctgaccctgccctgcctcttcctgagatgagtcattcaccagggggtttccttgccttgttcctcctggaccagtgttgtattaggctgttttagagggaagtttgccgttcacattgatttcctctctcaggcatacatgccctaaaaatgcctcgttgatcttaaaatgagcaactcagaattgttctgaggttgtgctgtggtgggaaatctgcttcttttgagtcttttgtggcttttttctttctttgttcttttggtataagaagaaccttggattaagaagcaagccatctgtcttgtagtcttgggccagcatcacggtccaggggaagccacttcttatctaaatatgtttcattcctgaaataagaggtgaccttaaatgacttctcagggacccccagctgtgacccagcgctaggtgaatgcaggcctcacgaacaagcaccaaatactcccctgggaaaggtcagcagaacccagtgacccaatcattgctgctgcccctgagggtcactcatctccgtgcccagcccctccactgaacgaatgttctgcgtctcacgctgcttgtctaagacaaggacaatgagggttcctgtacagtctggttgtatgaggattaagtgtgttcatatgtgtataaagtgctgagaacagagcttggcacgcgcaagtactgtatttcagcacatgctgttgttagtacaatcattcccctcaatgttgattttaatgaaatcacatcctccaggccaccaatatcttgacctggggccttgcaacggcacagcctccctctgccagagtcaagtagggagggatgacattcctggagccggcagtctctctggaggtgcagggagcggggagatgtgtggacccccagctccaggagagggactgatgag

SEQ ID NO: 1669 - DNA, 2674 bp, Homo sapiens; identical to SEQ ID NO: 1668

SEQ ID NO: 1670 - DNA, 1948 bp, Homo sapiens
gaggctgaggcaggagaatcgtttgaacccggtaggctgatgttgcagtgagctgagacagcaccactgcactccagcctgggcaacaggaccagactccgtctccaaaaaacaagaaaaagaaaagcaatattcagaaagagtaggaagaggtgacccgctgagaaagactcactgttctggctctggccataagaagaatagctgctctggccatagcctgaagtgtccgtggactggctataaccactgtaactctgctgtccgtagggctgactgctctgctgggaatagccctgcccgggctgggtggggtaggccccatagctaaataaaaggaaaaccagcgtgatcagaaaacatggcgtgaccacccttgccctctacaaactctggaagcccaaaaatagcactcacctttgggttgcttgttgggtataatctgcaaaagaaaaatacaatcacattatcttcagctgccactctgaaagagttgaattaaagctaaattccttaactcaagcactgatgaataaaaaggaccacgtaggccaggcacggtggatcatgcctgtaatcccagcagtttgggaggccgaggtgggtggatcacttgaggtcaggaattcgagactggcctgaccaacatggtgaagccccatctctaataaaaatacaaaaaattagccgggcatggtggcgcacgcctgtaatcccagctactcgggaggtgaagcaggagaatcgcttgaacccgggaggcagaggttgcagtgagccattgcactccagcctggcaacagagcaagactccatctcaaaaaaaaaaataaaaataggaccatgttgcaacaaagggcataaaattcctccatgagacactggttgagaagaggaacaaactggcgttatcagccaagtgttcttacaataaagaaaaagtgaagaaaatgcaagtttctacagagtcccagaagccttaaccattggaaaaaccaaggtcttggtggacatccacaattttctgcaagcccaattcatgtcagtgattgctctaaaacatcgcgcattcgtttcatccactctatgagaaagccattatcgccaggagtcaagagactaactctcccaacgtcgcagaactaccaaagtggcacaggtttgaattcgaacagtgttcagattgtggcctctgctctctcagcccagacccacagaataagaaagtctcaaaaaaggccattcttcactctttgaccaatcccggagatgaagtgggctttttagtgcaaagccagagaatcaaaagagcccttggaccccaaatgacagagatcatgcaactgctcgccttaggaggcgaaagtcaacaggtactcgagtccccagccctgggactccagatggttccgttttctcacctaccctgccttcccccagcgaacaaaaagcaacaaaagcgcttttgaaaagccccacttaagatacacgaacaagatcaactcatcctcccagcacaggaaacgcggcgcttcccccgcaggaaaagggaaagaggaccaggagagggtgtggcctcgggcggccgttcttctccgtccctatctcagaaaaaagaaatttagaccaggcgtggttggcttacgtctgtaatcccgacacttcgggaggcccaggcgggcggatcacctgaggtcagcagttcgagaccagcctgaccaacatggtgaaaccccgcccctactaagaaacacaaaaattagccgggctgtggtggcgggcgcctataatcccaactactcaggaggctgaggcagaagaatcacttgaacccaggaggtggacgttgcagtgatctgagatcgcaccactgcactccagcctgggcgacagaggaagaccgtgtctccaaaaaaaaaaagaaagaaatttaggcgggaaaaactct

SEQ ID NO: 1671 - DNA, 1948 bp, Homo sapiens; identical to SEQ ID NO: 1670

SEQ ID NO: 1672 - DNA, 6977 bp, Homo sapiens
cagtcacatgactctcccgccagcagagggaccggaagtgcgcctgccccaggctcggagatgagagccaggcgtccacggtgaacagcaccagaaagcaccacggtttaaggcccaggtccactcgccccaaaggccgcccgtgagttgctgtgaggactgaacaggaaatgggcggaaatggttcagcacagtgagtgctcagtgatgcggttgtcattgataatccatctggaagggattgcttgtcagtttcaggagactcagagaccactccctcctccaggaagtcttccaggctttaagtcttgggtgggaactcaaactgtgggtgagttgaattggattttcctttccacaaggtgtctgtccccctgtgactctcactgcctgtctctcatcatgggcagggactaggctgaattcctctctgcatcctaggactctgctcagaccctgtcacaaagtcggttttgggagctgttagataaatgaatgaatgaatgttttgaggactcagcactgagcattcctggacacgataccattgttctgagagccagaggttgtcttgggctccccttcctgggggccagtgcttcattcaccacccaaatccttgccacagtccctccctctcctaggactggggagcatgtggccacagccacccatcgttagctgggttctatcagctccaccacatcataagttggatgtgcctggcaagactgcatcataagagaggatggccacctgagatggaacaccaggaggactagcaggcatgagcaggtgtccttgaaccctgcctcattcaccattgcggctccagtgtccctcagctcacatctagggacacatgtaaactcggtagggccagacgccagagaagaaaaagctggagcatggcttatggatggtgagcacaacctgaggtggatagctgctgaaccacagcttcgctcagtgatgaccttgaaagaaacacaaatacttctgatgggcagagcttcaggcaatgcacctggccctccgctgtgtgtgggaagaggagcagcctgaggtcaaaacaccggggctgagaggcagcagtgaatggcttggccagctcatcaggggcccggaaggagaaagatgagggacaagaggcctggagcagaggttgatggatgggcgtacaggagtgggaattaaagaggaaggtctttgcgctccttccaggaagcatctgccaccaaacaggcactgaacaatcaggtaggcaaggtggtccaaccagctgtcatcagtcagtctcactggccatgccagggccggcaccatggatcactggagagggtagccgagatggcaaggatgggccctcacttactaaggctgacctagctactgtctgctgaatgtcccctgtaaagcccctcccttgaggccagctggctgcttggccagttggctatattcaactcttgaaagatcggagattcatctggactaaagtggacacaaacttcaggtcagagtttgtcttttctgtcccagccccccagcggcaccatccttttggcttactgagtgtgtgatccaccagcctgggagcccgcagagcctcaagtcaggctaagggacccacttcgcagcaaggaggtgtgggagtgggccgtgaccacggggatctgctgcacatatcacaaactgtgtgcctctcactgctggcttggaggggctagagactggcctgccaaacgcacagctgtcagctgcagagggtccccttgcctgaggccccatgctttcctgggaagcctatatccaatgacagtaaaagcaaaagttaaaaaaagaaaacacaaagtatgctgtcctctgccacctagggcacctttggcatccgtggtcaccccaccttgggcatctgcagtcgtctcaccttgtgcatccgtggtcgtccctcgtcccgccttgcacatctgcggtcgtctcaccttgcacatccgctgtcgtcccaacttgcgcagccgcggttgtcccaccttgcgcagccgcggtcgtcccaccttgtgcatccgcggtcgtctcaccttgaggttgaggaggaggagatggagaggccagatgagagcccttgacctagctgggagctgtcagcacctctgccaaaacgcaggcctcctcaaagaggacagtggttgctgttcaggggatggagcctggtgtggtggccccagctttcagcacacccaggaaaagctatcgccttccgctgccctaggtggcctgccctctgggaggtctaagtgactagaggcctgtggattctaattggaaaaaggttgcattgggaaaaacaacttgggggccgctgctcctgggctgctctcaatcccgtgcccagggccccctcacagcccacctaagggccaggctgtggggaaggagtgactgagagatggcaagaaggggatggagagacggggtctccaactgttatcaatggggccaccaggcatcctcctcctcctcctgctataagaaaccctggaggagcctgggctctttgcccacaggtcctggggcccttggtcctcctgcatggattcgtgagggagattcctgctcatctgggccactcaacagtggtccctgttgggccagggagtcactttggtgtctgaaagtccctgtggggacagtttatgctgagcccagttgaagcttcaggtttattttctgcagagcaccccagtgggggctttcctgaagagctgtggtgctgacactcagataacaagccatcatttatggcacactcacctaaactgggcaccgtggaaggggcttcccatacttcctcccaacaatcccatgaacacaacaccaacccagacaggtgggctctctggagagtccagcttgcagaggggaaactgaggcccaagccggctcaggttctcccagtgcttcccagccagaagcagcattgccagggctcgaggttctgaaccgggcactccagctgccccttccccatgccggagggcagcagcctggctccaagcacccctgtgcactgttcctgggaagtgggttccaggggtagccccccactgtgacatgcccagccttaatcttcctctgcatttgcaatggtgtgtagatgccctgatgttgaagctaaaatgagcccctgttttcaccaggaaaagtttgaatgtttccttttttcctgtcctttcttcatgcacttcctgacgtgtaatccgagcaattgtgccctggaatggacaagagccttcaagggaaaggagacgctgtgttgctctggcagagggaggtggccgagtcaggaccagccaggtaacatgtggggcccgggcacagtgaaaggcagcgcctgttccaagatgaggaggaatttcaagagtgtagagcagtccaggggccttctgagcctcggagtcctgtgcacctgtacacgatgcttcctgctggcaagtcgcctgcccagagacctgggaactgtgtgaactgggaccccaggcaagcccttttctctctggcctctgttccgtggctgtgaataggagcgtggtggctgagggtggggcaggggctgccccccgggtttgccgaccccagcattagcctcactccaggcttgtctggacatggcagctaaattgggggacctggctcccaggaacacccaggcctggcttggcatctccttgttagcgagaatgagaaaggcatccattggctacagtcatgtggcacagggaggacaaaggatggctgatctgatctcaaaactcccccatgtgggtggcacagggggtcctagccatgtggccatggatgctccattctctctctgagcctccatttccctggggctattgaggggaacaggtgaaataacagccaatatttaggaagtgagcatggctcaatgcttgcaaacagagggtctcatccattcattcattcattgagcacactgtgtgcaaaagcctatgctgaggcccagagcctcaggccgaggtgtctggggcatcactgaccccaaacccgtagccagctaagaggctttccccaccgccactccatgctgcctgggcttcatggcctaggtgaccacagcagctggctcactctgtgacccagccaccctcatgtcctctaaggctggccttcaggtgtctgggccatcttcttctgcctccttgcccccactcctagctcttctctgatccctgcatccctgtccctgctcctggatctggccctcctcttctgtctatgtcctgctgaccatgcctccaggcctcccttcaacccctcctccgccataagttgcaggccaccgtcaatgccagtaggacaggactggtcccctcctgaacaaggaaagctcgcctgcttgtttccagcctcatgttcctccctagggcctccatgaacccttggcatgtattagcccctgacatccttgggacagagcccagctcctcaccctggatcagaccttccaccacccactgtcccttcctccctctgctcggtcagaaggactcacttgtggtccccagatgcaccaggtgttttcatgcccctgggcctttgcacatgccattctttcagtctggcatgtcccccttttctccttccttcaaacttctatctatcctgtgggcagcctgggcagatgcaggaggttagggatgcggatgatgacagctacatccccagcacctagcacagtgcctggcacatggtaggtgctaggttaatgtttgtggaatgatgaatgaatgagtgaatgagctttaacctcagatgggcctgggtgcacattcactcagcacttactctgtgatcttggatcagtgattttttttcctccaggcctcaaattactcatcagtagaacatggatgggtgcagggcctccctctcaggtggttgcctggtgctaatccactcagctcagggttcccagggcctagaacaaaggaggtgttaaatgcatggaaaaatgaccgaatgaagcaatttcctcttcctggaatccgctttgcttcacccccatattttcctgtcaaagtccctcttgttggacattaacaagcagatttcaaaaattcacgggaaattgcaaagggccaagaatagtcaagcaatcatgaagaagaacaaaagcagagggctgacagcaggtctcaaaagtgatgacagggcaacagtaaatcagatggtgaagcattgacaggcagccaaaccatcaatggaacagagacccacagacatagggtccacatgttgtggcagaggtgtccctgcagggggtgggtttgaatcaacaaggtatccctaaggaaaaattgtgtcttaacccttgccctatagcatgcacaaaatgcaatagctgatggattacagattgaaatgtgagggttttgggagaaacgtaagggaacatcatgacacatgagcagatgatgatttcttaaacaggatacaagaggcacccaccataaagagaaatgcttataagttaaacagtactaaggttattaagaaaatctgttcattaagtgacaacagaaagtgaaaattaaacccacagagtagaagaaattatctgcagtacagtgtctgagtatgtagcatttaaaaagaactcatttacagcaataatttttgaaaaacagctgcactgacatcaaaatgggcaacaagcttgaacagacacttgacaaaagaggatattctaattgccaataagcatacaaaaaagtgctcacttgtgtcagttgtcagggaaattcaaattaaaaccacaatgaaataccatgtatggtcaccagaatagttaaaaagaagaaaaaagatagacaatagcaagtgttggaggtgagatggggcacccagggcagccatgcagtgcctgcaggtggaaccactttggacactgttttgcagagtctgctaaagctgaacacatgataacccaagacacaacaattccactcctatgtatatgccctacataaatgtttacgtaaagagacacatgagattgttcatagcaacactgacgtatagtaatcccaaactggaaacaacacaaatgtccaccaacaatagaatgagtgaataagctgtgaaatatttgaatagttgaataccaggcagccatgagaatgaatgattaacagctacctgcagcaatgtaatggatcctacctacataatattgagcaaaggaagcctgacacaaaagaatgtatgctatatatcaaaaacaggtgacatttcccatggggtccagtcaggaaggcacttccactgtgggagagagagggactggaagcaagcagatgggtgtgtctgagcagtggcaatgttttgctgcttggtctgtgatttagctggtgagaattcattgatctgtgcacttaagactggctagttttttgaggcatgagttaagaattctccctggctatccattatgattttcaaccagttctgccagggagccctccccaaagcccagacccaatttataaacaataataaaatacacaatgctctctattgtaaattccacactgccaattgattctcagtgaatgtttgtgttgattttgctgaattctgtatctgtagccaacgtatggatcaacttatgaacaagtgtggttctgttggttgacattttcattccacaaataacacctacataaaataacaaaggcataatatcagaactttacctcatttgtcaagaatgggagatacttctttgctgaactgggtaatgatttttttttttttttttttttttttttagacagggtctcacactgtcgcccaggcttgagaggaatggtgtgaccttggctcactgcaacctctgcatcctgggttaaaatgattctcctacctcagccttccgagtagctggggtt

SEQ ID NO: 1673 - DNA, 6977 bp, Homo sapiens; identical to SEQ ID NO: 1672

SEQ ID NO: 1674 - DNA, 6977 bp, Homo sapiens; identical to SEQ ID NO: 1672

SEQ ID NO: 1675 - DNA, 2715 bp, Homo sapiens
gtaaaacctttcttgtgtttactcagcaaagattcttttaagacgggctaagcacacggtttactctgctaacaagccttggcatttattgtgaggacctgtgttgacttattctcgagtctccattgacactcactgagaaacgttaacgcaaacacaaggagacatcctgggagctctgaggcccgacattgtgctggggaaggagctccagaaagggccatcctttctgttttggttcagtatctgaacacttttgctaaaggtctctggaaagctccctgtgttaattctcgatgagactacgtctgtgccggccgcttcctgagcctccttccatgtgcataggcctgctgcatgctggagacctgcggcacagctgccaagtgccccgtgtggttctgtgatcttgggacagtcacttcctctctgtggttgtcagtcttctcatccctaagatggaataaaaaggcctacctcattgggctcgtgtgggtgaggagaactgaagagtctgagagcgcggcacgagccagaggctacggaaaacactgccctcctacactccaccttggagagacccagaaaagaacaagcttcatttgtaaaaaaggaaaacaactcaggcaatgggggtggcttaaaggcactctacagtgtgcagatgccttccacttcttccatctgccctgtctctccaagaacccctatggccccggtctcagaacagagctgagtgcagaaatgaaaatctatggctctgtgttccaaaacgatgaagaatttcaagatggtggcagtggtaaaatctttctccaggaaaaatctgtccttggcccaatgtgtaaacacttgctgagtattgtgaaaccagcaacttgttcacaattcttctgaatttcttgggaaatttgaagtggagtacctgtaccaacatgaaatgacacgaatttaagtgacgctcaacaacgaaaagcaaaaagaaccaaagaggaagcaactgaaacaacatctggatgtatttaaaaatatacaatgcctccaaaatcaggtgtcattaatgaaaattctgaagaaatgccaccggacatagccaacgcacctacgctgttgttattcatttcctgcttttcacagaaaacaattttgttgcatggaagatcggacaaggctgttctctgaagttccctcatccacctagaaaccagatggccgaagaggaacacaattgccttccatccccttcctgaaatttcattatctagaggattaaaacccatatcacagaggaagagattgaaaattaaacatcacacctacaacccatacttcggagcactgacccaaattgtctatttttaagtcccattccatttccaaagataattatttactaaccattgtctggagcattgggcccattcattcctcttaaaaatcatttgctgggccaggagtggtggcttacgcctgtaatcccagcactgggaggccgaagcgggaggatcacgaggtcaagagatcgagaccatcctggccaacatggtgaaaccctgtctctactaaaaatacaaaaattagctgggtgtagtggcacatgcctgtagtctcagctactcgggagactgaggcaggagaattgcttgaacccaggaggtggaggttgcagtgagccgagatcatgccactgcactccagcctggcgaaagagtgagattccgtctcaaaaaaaaaaaaaaattattttctacccctcaaaacagccactttctcctccatctcctcttccctgatgaagaaaggcgtatgagcatctggacctcattgggtttaggtcatcatgttcttgcaattcctgtgtgcttatgcacattaaatgaatttgtatgccttttcctcttattaatctgcctattgtaaattcattttcagtgaacttcaaagggcagaggggaaactgtcccttggcctctacccctccaaggccccacttttttgtcaacactccttggacgcagcagaagtatgaacataatatggtcctgaatgaggctgagtctttgggcgcagaagacccgggttaataaaaataggaaggtaagaaaagaaaagaaaaatcaagacacatcataggactaaattcctattatttatccactcaggattgaccacccctttgggccagatagttgtacccccatgtaccaggtgggcacatgaagacacaagaagtgctgtgatggttcattttgcacgtcaccttgcgtggagtatgccaactcattgtttggtcaaacactagtctggacatggtggtaaaggtattttttagatgagattaacacttaaatcagtaaagcaggttacccaccatactacgggtgggccctgtccaatcagttgaaggcattaagaacaaagattgaggtttcctaaagaagatggaattctccttgagactacaacatagaaaccctatctgagtttccagcctgttgccctgtggaattcaaactcaggactccggtctatgacattaaccctcacttaacttttcagcctgccagcctgccctatggatttcggacttgccagccacacaattccttaaaataaatctctccgtctctgtctgtttctctctgtctatatacacccctggctgtaccactgaggactgaattttaacaggcagcaggaaactgggattcttag

SEQ ID NO: 1676 - DNA, 2715 bp, Homo sapiens; identical to SEQ ID NO: 1675

SEQ ID NO: 1677 - DNA, 2715 bp, Homo sapiens; identical to SEQ ID NO: 1675

SEQ ID NO: 1678 - DNA, 2715 bp, Homo sapiens; identical to SEQ ID NO: 1675

SEQ ID NO: 1679 - DNA, 2715 bp, Homo sapiens; identical to SEQ ID NO: 1675

SEQ ID NO: 1680 - DNA, 16798 bp, Homo sapiens
atctgaacaacttcataagcctgtattgtcactgaatgtgttgcacaatgggataagtaaaaatatccaaagctcctgccaatcgttttactttctaatttttttttttttttgcttcttctcaactgaaaataaggagagaaccacatgtgaaattttaaaaccaccttttggaagagataaacactctaattaaaatgaaagaattaggtgcagtggctgaagcctgtaatcccagcactttgggaggcccaggcaggctgatcacttgagcccaggagttccagaccagcctggtcaacaaagtgagacccccgtctctacaaaaaaaatgaaaaaattataatgtccagattattgatctgaccagaacagtccaggttccatgatgcatgcagtgatgtctctcagtcagatcacagacaccactgcatgcatcatggaacctggactgttctggtcagatcaataatctggacatttccatcagaaaacagggtcagaggtcttcacatatgtttataggattgctcaaatacttatgggctttcaaagaattctccaaggccttctcaatttaacttgctgaagcttccacacctctgacttgtatgcttttgagactgtttataatgtccaattcaagaaatgtgtgtgtttcatgctccagacctttgcacttgctatgaccatgctactgcactccagtctgggcaacagtgagaccactttgggaggccaaggtgggcaggtcacttgaggtcaggagttccagaccaggctggccaacatggtgaaaccccatctctactaaatacaaaaattagcggggcgtgacggcgcatgcctgtagtcccagctacttgggaggctgaggcaggagaatcgcttaaacccaagaggcagaggttgcagtgggccgagatcgcgccactgcactccagcctggcgacagagctagactgtctgaaaaaaagaaaaaaaaagaaaaaaaaaagtacacgtgtaattacgtccacgtgactgttgactatctgcctcctactccacaccatatgttctggggatcagggctgtccgttttgctcacctgtatccccaatatttaatgctgggctccttgttggcctttaatatatatttatcagagttcaactctccttttacatgttaaaagttagaaccggctaggcgcagtggctcacgcctgtaatcacagaactttgggaggctgaggtgggcagatcacctgaggtcgggagttcgagaccagcctggccaacatggagaaatcccgtctccactaaaaatacaaaattagccgggcgtagtggcgcatgcctgtagtcccagctactcgggaggctgaggcaggagaattgcttcagccagggaggcggaggttgcagtgagctgagaacgcgccattgcactccagcctgggcaacaaaagcgaaactccgtctgaaaaaaacaaaaccaataaacaaacaaacaaagaaacaagaagttaggacccagatgggaggaggaacttattaagcagcaatgatgaatggaaccagaactggaacccatgaatccaactagcaaatgctctttccattgtagcagccctataggggcaaacacgcgcccgccatcccccaggagcctcattcattcatttactttcacagcacgcaccttccaggctcctccgcacaggtacaggtttgaggcgggaaccagatgaggacgaaggcggagatgctgttggtaccaggtctggccttgcactctagctctgcgaacctaatgcgcggtcttgcaagcctagcccctgggcatcagggctgactgccctgggaatgcctggagagatgaacagggaactcatcagatgccacagcagaagcaaaggcgtggcacctggaggcccacttccttctggacacggagtcccgcactcagggtgacctgtcacctcctctgtcacgtccaacatcacctacgatgaagaagatgcaggaagcttagaggccgaggctaggcggccagacgaagtgtcgtcctctgccccggtctcggccccagggagcctggcacctctccagcgctggcgcgtgaaggtcgcaggcccacagttgagctttttttttttttgagacggagtttcgctcttgttgccgaggctggagtgcaatggcgcaatcttggctcactgcaacctccgcctgccgggtacaagcgagtctcctgtctcagcctcccaagtagctcggattataggcatgagccactacgcctggctaatttagtagagacgtagtttcaccatgttggtcaggctggtcgcgaactttgatccacccaccttgccctcccaaagtgctgggattacaggcgtgcgccacagcgcccggccgacagtcgagcttttagagcccgcggcgcgcccaccaacgcagggccgggaggaaaaggcgggccgagaggcggggctggaggccgagtgtggccgagggaagccgaactttccagtttcgctgaggcctgttaaccgctgggggcgccttcgggacagctggcttctgcgcatgctcttgaccctccgtcccccggaggaatgtcttaagtcaggagctgattagtggttgaaggcagctgatctgtttcgaatcctgtgtgtccggagaggccaacgctttcattagccagcaggaatgggctggggcgcgtttgtagttgggaatcctgagcccgggctgttgcttggaggactcgggagcagcagtggatttcggcgttaccaggagagctatgtataggaatgccgctatggaaagacatccaggacaccttgttaagtgaaaaaaggttcagtatctgaacacttttgctaaaggtctctggaaagctccctgtgttaattctcgatgagactacgtctgtgccggccgcttcctgagcctccttccatgtgcataggcctgctgcatgctggagacctgcggcacagctgccaagtgccccgtgtggttctgtgatcttgggacagtcacttcctctctgtggttgtcagtcttctcatccctaagatggaataaaaaggcctacctcattgggctcgtgtgggtgaggagaactgaagagtctgagagcgcggcacgagccagaggctacggaaaacactgccctcctacactccaccttggagagacccagaaaagaacaagcttcatttgtaaaaaaggaaaacaactcaggcaatgggggtggcttaaaggcactctacagtgtgcagatgccttccacttcttccatctgccctgtctctccaagaacccctatggccccggtctcagaacagagctgagtgcagaaatgaaaatctatggctctgtgttccaaaacgatgaagaatttcaagatggtggcagtggtaaaatctttctccaggaaaaatctgtccttggcccaatgtgtaaacacttgctgaggaacttggaataacttgcagtgtcttgcagtattgtgaaaccagcaacttgttcacaattcttctgaatttcttgggaaatttgaagtggagtacctgtaccaacatgaaatgacacgaatttaagtgacgctcaacaacgaaaagcaaaaagaaccaaagaggaagcaactgaaacaacatctggatgtatttaaaaatatacaatgcctccaaaatcaggtgtcattaatgaaaattctgaagaaatgccaccggacatagccaacgcacctacgctgttgttattcatttcctgcttttcacagaaaacaattttgttgcatggaagatcgtgaacttcaaagggcagaggggaaactgtcccttggcctctacccctccaaggccccacttttttgtcaacactccttggacgcagcagaagtatgaacataatatggtcctgaatgaggctgagtctttgggcgcagaagacccgggttaataaaaataggaagaggaggctggcctttgccccacggccttggctgcagcaccatcacatgcctccacgcctctccatctcctcatgaagatctctctccagatagagaccatttcctccctagaggaatccttgtactatccgtaggtgagaacacttcacctcattacctggatgtggagtgttgaagctggaagggatcccagagatcgaggcacctgttgaattcaggcatcggcatgtgacttgatttggtcaatgaaatgtgagagaagtgacatccactttgaggcaggcactttccgaatgccatcaagctgagatgtgaagcggaagtgaggcagaggctcccttccttttgtttggcgcagttttctgtgagagagcagaggtgggagatgaggggacctctgccccagtgtttctgcatccaagctccagccttgttgaagaggcttgttgtgaggatcatcaggcagctctattgaaagtctaccatagagaggaacataagcctttagtcagctccaactcaccagccatatgaatgagccaccttggaaaaggagcctccaccccggtcaagcctgcagatgactgccgcttgagttgataaatgtctgcaatctcatgagacatcctgaactagaactacccagccaagccactcctggattcctgacccacagaaacgtaagagagaataaatgattactattgttttaagtcactacgttttggggtgtttactatacagcagtagaaatagtgcagatttaggtgcctggaaatgtggtgctgctgtaagaaatgtgggagtggctttggcactggatttgggcagaaactgggaggcgagggtgcatgataagttaaagggacttcaagagacttcacttcaagagaagcctgatggctgtgataaggatgcaataagagcttaaaagaaaatgaggagggtcaggtactcatgcctgtaatctcaacactttgggaagctaagctgggaggatcacatggggcctagagtttaagacaagcctggacaacatagtgagaccccatctctacaacaaatttttaaaaaattagtggagcatggtggtgagcacctgtagccctagctactcaggaggctgaggcacttgagcccaggagttcaaggttacagtgagctatgatcacgccactgcatttcagcttgggtgacaagtgagactctatctctaaaaaaataaaagtaagagtaaaacacttgagagaagagcttctttgttatgtaacggtaaaaagtttagaaatgctgtcacttgtgataacctggaaaatagcaagtggtcctaatgaactgggttatccaacaaacaagagttccaggcagtgttgaagaaacacagagtatcacttctgggcagtggtaggagtgaatcccaatcaagaaatgattaacatctgctctgctggatttcaaaattgctatgggccagtgacttccatatgcctcttgctttccccatttttgaatgagcaaagggaatctagagtaatgcctgtccaccattggaagttgggtgtgtaggggtgcagataatgtatctctttagtttatagttttaggatggagaggaactatactctaggagctgtacttgagaaaccgcatcatgggaccttcatttatgccaggacatgatttaaataataagatactggacctcatgctgatgttgtcattgaaggactttttgggcatgttgaaaggcttgggaatcagctaattttaatttaagagagatgtgaattacagagggcaagaaggcagaccatgactgcaagtatctgagatggtccccaatgagcctgatatcatggtatccattgtctgtgtagttagttccttcccacatgattagtgctttgtgaccaatagaattctgtggaaatgacagggtgtgtgacttcttagaccaggtgataaaaagcatcgcaacttttgcattggtctcttggattgctccctctgagggaagtcagctaccatgtcaggaggacactcaggcagcctgtggagaggcccacatgagaggaactagggcctcctgccaatatccaccaccaacttgccagccatgagagtgagccaccttggaaatggacctttcacctcctgtcagggcttcagggactgcagccctggccaacatcttgactgctaccttgtgagagattctgatctagtgcctgcatgagataataagtgattattgttgttttgaaccattatttttggaggtaatttgtcatgcagcaatggataactcatacagccaatcctctcttctctggcctgcattttcctgggtaaactctcttgtttttgaccttatattcaatttgtgagcaggaccaggatgaagatgaggtgagggggtgcacagggcctccttcaattttgtgcctgaggtgtcttgcttgtttcacccttgccccagtcctgtgtctggtttctgcatggtgtgataaaaagtcagtccctggtgatcttgcccttaaccttgcagcctgactactgccagccccctgtgcctgacttggcttcctgtggagaagcctgtggagtcaggtggacaaaccctgtggtcctttaagactgcaggcaaaaaaaggaggaatgggctgaacaccaccagtgggggcagttctcatagaattctggaacccagcaggtccttacattggccctgaggtgagtggagagacctttagtggtggagtgcatcaggtggttgtgacaccttgaccttagggtgcaaacaggcctcaggggttcagggcagtcccagagggggccacgagagaatggccttcctcgaggtagagattggagcccatgtgggacattcatatatagaagcagaaggaaaataacactagtaacacatggagtgactcctccaagccagccattggctttacctcatccaattctcccaaaagcccaatgcatgatatactcatcatcccttaaacccagtttcaaaaatccaaaaagtggtagcgtgcagtggctcatgatctcagcactttgagcaacaaagtgagacccccgtcctgggaggctgaggcaggagcattgcttgagtccaagagtttgaggctgcagtgagccataatcacgccactgcactccagcctgtgtgacagagcaagaccctgtctctaaaaataactccaaaagctctgacaaccgaaagatttttataactcacttggtggcaagtcctggactgaactgatgtgagactatttatggtcttaattatgccatttactgtaaatatctataagtttccctacaaaaatattaatgcatttgattacagggtgttccccagaacccactgagtgctccataatatagtgttatgtaccatgtaacttttctaaaacccagcatttctgaatgttgaaacatctggtccaaagataaagtacagtgggcgtcttagtctattttctgcttctataacagaatatctgaaaccgagtaatttacaatgaatagaaatgtatttggctcatgattctagaggtttggaagtccaagagaatggtgctgacatctggtgagggccattgtgctgcgtcattccatggtgagaggcagaagggcaagtgagcatgtgaaccagagagaggatggggactgcccactcccatgacaattaacccacttctgccataatggcattaacctattcgtgagggcaggtcccgaatgacctaaccacctcttaaaagacccaccacttaatatcagcaattacatttcaacatgaattttggaggggacattcaaaccatagcagtgagactgtattattattttttccattttacatataagaaaaactgaagtgtcatgaaaagtgatgacattttctaattgcacagtgacagcctttttcttcctcctgttcagaggagaattatttcacaatgctgagactctgttacctacccaccgtccccaccccgatcacaagttcttgatgggatttggcactctgagatctttctagaccccttctagttatttttataataaacttccaaatgctttctgtgctttgggtattgattgtttctggacaagtggcaatcagatatttatccacagaaactccctggagtttaaggaagccttttgtactgccaatgtgttcatgtgactaaaatagaataaactcttgagggtttcttttcattgcccgtctccgcactgtccctccttcactccaaacccttgcttaccttgtgcccttgccagaacttccctctgatctcattctcatttagtaattaattcactcaacaaacactgatggagtccctgctgcttcccacaacgtggtggaagaggttttatgatttattaggagaccactggtttgacagacaaaagattaaggtcctggttctgtaagagttcagacaaggccttttttttttggctctggacctcagtttagccttaaccaaatatgaagtaagaagataattgagaggatgtagaaaccatcatcacaaagtattgaaacctaatacaaacaggactgaacaataaagagtgtgggccttggcacagtctgcccagggtgctggctgtacagttctctttatccagtcctcctcttggtatccttttgattttcagggtggcttatctcatgatcacaaaaaggcagccagcagcatctgcaatcacacgctttacagccagagcgggagagatggagctacttcaggcattaagctcagttcccaaactggttgctctgagccaggtctattccagttgagcctacgctggttccaggggttcagagcctgatctggagaggttagcaaatattttaaccatcactcttggaaagagtgttatttctaataatcatcacacagaagtccaaatttcaagctaattggcttaagctggagttacctgaacaaatcccatggcaggaggcttaggattgccccacttggcttggaactattagtcctactccaacaactggggttgaggtcagttttactcagattgcatgctcactacagatgggtgggattgcatacaggggtgcaaccaaaatgtgctccactagctctaagttcccttctcactctttctttgtttctacattttgaacccctgtacacgacgttgcaaaggatacccccatcttaatatttttgttccactcatttactttagcttagtcacactggctggagattctaccatcaacttctaatcttccaagaatgttcctctaaatctgaaggcaaggagaagtggaaaccgagatatggtgctctgctggtttgcagtgtcagcccgggctaggcaggaagatttctgggggcaaaacctctgcatctgcaggacttcccctttgctggcactcagatggcattgaatacatgaattttcatcagtttttcaaaatataacagtaatatgtggagtgttaaaaactcaaaaggctatatgaaacatacttttcctcatctaatacctccagttcccagagtgaatcactgtcatctatttttcgtgtattctcccatttgtgttctatacgtataccaaaatatataaacagtatttacacaggtgtgtgtatatatacaaccaaagccaccttcttctatacatagggattatagtacaaatgtttgttgaatgaataaatgagtgactaacagtaactggggggctctgactgtgaaaggctctcatttatgcccccaacgactgtcagtcaggaaaacagagctcacacaagttgtttgaacagagagattttaacgtagggaactgagtaaacaagaattggaggcgcagaaagacagaaagtggccattgaggacttacagagatagtaactgccaaaaggcagctatacctttaggacagaggaacaaagaaagagatcagggttattagaacctggaagcttggagaagaaactgcagtgctaggacctaaaactcagagaagctggtgctggctgattggtgctgatgttgctggacatgccaaggtgggttctgagggtgtggcaaaaagccagtgaactggaattcactgctggtggagtgatgtggccaggagtaagcagcaaatgggatagatggggtctctccttctgcctctctttgtccctccaagagtcaatgggagggggcctagtaaggagaagctagtgaaggggaaatgtggcttgcaggatttcatctccaggagcacaaagtagagaacagaagggtggatttggggccgagggacaagagtttaataaccagcgctccttgttcctgttcttttggagcttttgtacaaattagaaaaaagtataccctctgggcagaattagccctgggtcagggtgcatggtgtggtgggtagagaaagatgctgcaccatacctgggcataaggtcggcaggagaatatgggctggattttaccccccaactatccttttcaccaggtgtatttgtatagggtacaacctagtgcagtcgtatgtaatggccctgcatctgtccagctataagcattatagtccatttggttacatgtgggcatcacacacacacacagacacacagacacacacacacacacacacacacacacacagacaccatgaaagcacattcttttcttctttgggagcaggggtttggggtggtatatcaatcaggaggcctctgttatccctgctgtatcaactcactgggtatgggccccttctcaacatcaggacccagggtctaacttgtacaaatgtgcatctatagacagagcattgacaacatacacataattttctcagtaaatctaggatgagaaactgtttctgagggggctgtggtgaacaaagatggggagttaggcctttttagacagtaggcgttcaagaagtttgaaaggctatttcagaatgcttcataacagagttttcaaattggttgggagtctggaaatgacctggtaataacgattatggtgatgagaatagttgtcttacactaggttctctggatccagactgagacagaggtggtgtgagaagctggtaggtgttagtgggaaatcatctgcgaggaggtgaggaggcagacagggcagaggaagaagctgagagacgtgcagctgcaccagaggccctggctgatccggggacctctggaacaaggatggccctttagggtagtctccaatttaggtaagaagcctgggctgtgtgtctacacatcggccctttatcggccatggcccctcttgggaggaggcatggcctcggaaggagagcaggtttctgatgagtaataactgtgaccttcccatcggctggaggattggggtcttggctctgaagaggggatctgggcagcatgccgctgcatccactacaatagtgatgagggtgtcaatagctaccaccaggccatcacctacacaaaagctagatgttttgcccataaacctggtcctctccaagtctcccccatctgagtgagtggtattaacctccaaccccacttctcaaaacaaaatcaccagagtcttccttgattctccccttttctcctctcacaatctgtcagtaggaattattggttccagctccaaaaatacattctgaatctgtccactcctctccatttccatccctccggcccaagccattaagtcctccgtgaccaactgtaacagcttcctaacacacctctttcttcccatccaggttgccccgacggccactctccatactgctgccagaagaaccttgaaatatcgctctttttaattaaaaagcaaaactcttcaattgtttttgttgcatttaaagttcaaacttcttaccacggagtgaaaggccccacacaattggccctgtcttcttctccaacttccatttttctttggtccaccgtgttctagccgcatgggccctgtcttgattccttgtacatgtcaagcttactcttgctccagagcctgtgtggtagttgttccctctgcctggaatggccttccctagaacctgccttggctggttcttcttgctattcaaacctcagctcccacatcacctcctgtgttaggcctccctggaccactctaattaaattagtactggagacatcagtccacctggcttcaggggccaggccttcctcttgcagcctagaggctctttgcagactgctcaaagctccctttgcacaactcaacctggcagtggggccttactttctatttttatgatctcagggatgtctagagacctcgttggcctggctacagtacatcctaaccgggcattgagttggaggaactcaggagcttataatctggcctagctcctccaagttagtcagttaccaagtggagaagagaagccctttaccattgaatttttaattgtactggaaactgcctaaccctttggtagaacaataaagggaaatttggtgacttggtctagaggcctggggcaagtagcaacagagatgaggttagaaagatttttaacatgtgggctttcttttgtcattaaaagagaaaaacaagctcttacaatgtttgaaggaaaccgtcatgcaatttccaagtagttattggattctgtctgtgaccaagacattgaaggacttgggctgagctttggggccactggagtatgaagaggccccttttgtcatggagctgacttctaggaagggagacagggcagaggcaaagggcgcagggactacaccatggagtgccatgctgcatcaggcactgtgtttgggtttccatacacacagagcaattaacacacagcaggctgtgtgtacctggacccaaggggctggccaggcagagaggtctgggactgcccaggaaggggagcaggtgatgtctgaggagcagaggggatgagaaaaggcttcctgcaggagatggacttggaactggctccaggtgcaccgtgggctctgaacacacactactgaaataatgggccatgaaattcattcctccagcactattctgcttctctgtcacttctcctttccccatcatttccttccccggctggagagcactcaggaatgccttgctgtgcccagtcaggcctctggagtccaccctacctagctgatgtattattatcaccagcaaacacacaccagaggctgtatcttggctgggaagcacattagcaccttggaagcccttcttggaaaaagtaaaagattggcatttgagcctcctcattgattcctttggatgaggcagaaaaccgctgcccagaaggatgaaggggtgaagtggaaaaacatgggctggcttcaaagtggagcacaggaggctaggaatagttctgctttgtgaacaaagtcgtgcaaaaggcagagagagagagagagagagacaaagatagagagcgcaggagagcgaggagggagggagtcagctttggctaatttgaattttgaattgccttgaaaatcaccgtgcagcagtatccaattctgcctttgatggtcgaaagaaaccagctgcttttattcctcttcaggtcttgttttccccccagcagtgaagcaaattaagcaaagaaacagtgaaagttgtagttggtataatatctcaggccaaggtcaggctaattgttggtgggaggggcggtagagacaagggacacactctaggtgttgatatttctcactcctgctccattctgctccccataatgtcactttggcatttccaaacacgaccaccttggcaggctttctttacaaactaaggcccttgttctaaccaccagcattcctatactatgccatgcattcgggcaggtaagatatggtccctttgcccaagtcgggctaaaggagtggcaaaccttgaaacacaccccaagatatcccataatgctgttcttaatttgcaacatcagcagggcaggtatttgctagtgagcgtagcctcattttttcctgctgcctcatttttatcaactcagttgtaaaaattaatatcatggaggcttccttgaaagatatgaaatgcgtacttctccctagacagtctaaaatgtacctttgtatcaaatttaagcagccatctgggaagcttgcctgtgctgttttgggccctggtagagctcttttgaatgtgtggcatgctggcaggatgccagctgcctgagaggaggaaccgggagtgcttgaccccgtgatgggtagaagatggaaaaattgtcatttcaaaacagcaggtggttcctctcttgatagaggtggagattttcaccttttgggcaaacatttcctttgtgtggttgaaattatcagaatggacccttggggacaactgggcagtagtctgaatgctgatgttttagatgggaatatgggggattaatttgttgcgtgtggttatgccagagcaaggtctctcctttttgtctccttctctcccttccttccttgtttttgattgtgctctgctcacctcctcctggtccacacaccttagtaagtggtcattgaatgctgctgtccagaaggggattctctctcctcggctgcttcctgagtaataatcaaggtaaaagtgatgaagtggaaggggcgggtaattggacctattttgaaaactcaagattctgtcctgaccattcctaggcttgacacatcttcctttcccttaaaagcaaccccaggctagcccaaagaaggcctggaagaggtaaatgtaattctggtttggccacctggattcttttgttggattgacctgaccttaggtcattaggatagtgaccacttgtcttagtacacagctcattcagcaccctattgtgggccacaacaacaaaagttggggatataatggatctctccatgttttatgaaaatgcttttgtcactcttgcaatggaaacttctggattaaagatgtacatatgagtaggagattattgggaaaagggtgatgttacatttattggaagggcagttgaggaaggacattgaccatggcacccacagagggaataccttagcctgtacttgtacttagaggtacagggaagggagggacactgatgaaatttgtctttcagaaccgcttctggagtcttcctcccaagagcgaggcactggtgctgctctgtcaaactgttcaagtgccttcatgtaactgcttgctgtctctgctggcccctcccactggctccaaccatggcttggtccccactccccttaaccccagctcctgcacttcccatgcaaagcacctgccagcacctctggataactttcccaaccacattctcatactatttgctcaatcattccatggggcaagagaatgtcacccgactaggagtgtagacagacaggacaagttggacagacagccctcaggcagaatctttgaaaacagggactccattattggcactgaaaaccctaagtcttaccacccatggagaggccatattggagccaatcaacctgtgcccctagctgatgtcccatttggggatccccaacaactgtggacaatacttcctttctaggggcaccatatgcatcccagggactgtaattgtgaattgtgtggaagccagatgttacattgtctccctactgtaaacacagtgaccttcccagacagataactgagtcattatttatgggtaccctatgaactgttttccctataatgggacccctgcaattagaaaaggaggcatgaaatttgaccctgacttcagccgaccccaccgtggcctgggacctggaaagcattcatgtcagcctcccctcactgaccagggttgtgattgacgacaatagaattaccctacactttttccttgtaggccaagatggagtctctgcaattccaaatacatcctgctctacctggatcactgccttgagctgggtggaaaggtcagtagacaaatgtatccacctggctttctaacgtagacccaggttgttgatggcatccgttcacctggctggatgcaggaccctggggaggtcatggctgaagccagtgctgcaggagaaaggtggggagaaaaataagagctggaaaacacatggccctaaacaggtgagaagtaataggccctatcttttgtatctgggccagccataattcttgacaaatagtgtgcatttcacaaatgttcatcagtgagttgaaagaacatgggctctcaaagcagatccacctggtttggggcctggctctatcacttctgtttcataaacggtggcctttttttccatgtgtccactctgtgctgggctcctgcagtacagacacgaaggaggtaattactgcacatttgtctctgagaaagtcactcaaggcctctgatcctcatttttcctatatgaaaatcttctctgcctcccttaaagggccatgaggattacgctggacagtgctctgtccgtgacaaagggctgtggcatctgcgtgcagttaaacagcagaagccctcttgagcaacctgcaatggaccagcttgctagattaatgtagactctccacactactcagctagcactgtgcccatgcctgggatacactaaacccttgaagctagcagctccaactgaagcttctctccagttttcctgggcacatatgtttccattggttgagctgtgtgtgcttactgagggctatttgtatttcttctcaacctgtacctgttactctga

SEQ ID NO: 1681 - DNA, 1254 bp, Homo sapiens
aaacagttcccaggcacagaaagggggaggtaaacctaactcaaactgtgccctctcatcaaagcctaaatgcccgctaacgtgatcccagtagctcttaggcagggagggcaagagaacacgaacacgctctcaaaccaacaggtggccctgtgggcagggctagtcttcctgggagtctaacgccattgacacctgaagaaaactatcttcccagtcatgagaactcggggtgtcgattgagcagcctctcctcaacaatggagatttttcagaaaagtgagtctggtttaagggacacaaatcccacagagtttcttggcacaatgtttcagtaagcatgagtgagacccaaaaacgtccaatgagagaccaacaggcccctgacctaagtcagagctagactgcagaactctcagcccagctctgcagcagacatctgcgtcatcctcccagaaattcaactcaggccacacttctggcaaaagaagtttcaccctgactgtccttgttttcagtcagctgggctcagtgggatctaaaaacctgggacagagtgtagatccagtagaggagcccaggcctctcctccacgcacccctcactggcacccctcaccatctcccatacattccctatggtggtaaaggagaagacattcaagcagagaaccccaaatccccgtgtctccttcccttcttggctataacttagtgggatggttgagagggagaagaaatttcaaatgagccagattaaggaaacaaacaaacaaacaaaactgagaagaaatcaagtccccaacaggcactgaaatcaaaatgatttgttgtggtaacaagtcagaggcgatctgaggacccgacataaccgaaacgtcttggatgctggacagtctataactggcacatgccagggagacaagcaatgacaaagctcaaacactaaaggtgggaccatcactggattaatccagaaaggcttccagataaggaagcattttctttctttttttttaatctccctacttttttttttaagtctttaccgcacaaattctaccccttcacacacattctttcaatcccaggacgtctgaagtcttatctagacataacttcagaccgtacctaactcccagtgctggtcgtctcaggtaataagatggcatttccctgctgttaatttctaacctaaaaaaaggaacagtgactcctctgagttcagagtcctttccactaggtatacaaatga

SEQ ID NO: 1682 - DNA, 1254 bp, Homo sapiens; identical to SEQ ID NO: 1681

SEQ ID NO: 1683 - DNA, 2362 bp, Homo sapiens
aaacagttcccaggcacagaaagggggaggtaaacctaactcaaactgtgccctctcatcaaagcctaaatgcccgctaacgtgatcccagtagctcttaggcagggagggcaagagaacacgaacacgctctcaaaccaacaggtggccctgtgggcagggctagtcttcctgggagtctaacgccattgacacctgaagaaaactatcttcccagtcatgagaactcggggtgtcgattgagcagcctctcctcaacaatggagatttttcagaaaagtgagtctggtttaagggacacaaatcccacagagtttcttggcacaatgtttcagtaagcatgagtgagacccaaaaacgtccaatgagagaccaacaggcccctgacctaagtcagagctagactgcagaactctcagcccagctctgcagcagacatctgcgtcatcctcccagaaattcaactcaggccacacttctggcaaaagaagtttcaccctgactgtccttgttttcagtcagctgggctcagtgggatctaaaaacctgggacagagtgtagatccagtagaggagcccaggcctctcctccacgcacccctcactggcacccctcaccatctcccatacattccctatggtgcagcctctcagtcctagcactaagctcaaaatacagataagagaacaaacagtgcaaaaagcaaaaggtgaacaacagagtaattcttgacacatacaatacaaaaataaaaataaagaatcccacccctttaacctaaacttcatgtacctatatcttggaggagccacaaaacaaaaacaaaaacaaaaaaactttcaagctacaattctcaaacgactaaatgctggcctggagtaatcattaaagagccaaaacccaggacatgagcccaagagctacctattttgtcacataaggagcagttcaaatatacagagctcttaaaaaacatatctaataaagcaaactcaaaattaaacacattctagaaaagcgggcctggcctgagatcctatattgactgctccagcccaagctgaagctaatcctgctgtctcccatccacaaaattccttctagcttggctgggtcctccttcattgttgccctaactgggaaatggatgacaatggccagaaaggaggggaccagggaagcttcatttcctatagaaattttttcagggaattcaagatcgacacttagatgctaaggttagcttcagagctgccaaggctctggctgactggaattctttcagtcccatcacaccaagaacctgactgctacttggatagagaaatgaaaggacaggggaaggaggggcatactattaagatcaataagaagcatcgctgggcctatatagctaattagtctagttccttgaagtagctctaggcataaaccaaaactggctgaactgtgacacacaagaacatgggaataaatgaacatcagataccagacactctaaacagtggtcagtcacttagtagggctcaaatctctgaggttgctcttaagctatgctaacataagccttttctaatccaaagaccagaagagacttttaaggtcaagtgttctgttgctgcaggctggaaagcatccctgccccctggcagcaaggccctacaaaggggccagtaaagaactgctgggtcaggtcctcctggctgctggctcagagatccagggagggaggtaccaacaaggtgaggtggtaaaggagaagacattcaagcagagaaccccaaatccccgtgtctccttcccttcttggctataacttagtgggatggttgagagggagaagaaatttcaaatgagccagattaaggaaacaaacaaacaaacaaaactgagaagaaatcaagtccccaacaggcactgaaatcaaaatgatttgttgtggtaacaagtcagaggcgatctgaggacccgacataaccgaaacgtcttggatgctggacagtctataactggcacatgccagggagacaagcaatgacaaagctcaaacactaaaggtgggaccatcactggattaatccagaaaggcttccagataaggaagcattttctttctttttttttaatctccctacttttttttttaagtctttaccgcacaaattctaccccttcacacacattctttcaatcccaggacgtctgaagtcttatctagacataacttcagaccgtacctaactcccagtgctggtcgtctcaggtaataagatggcatttccctgctgttaatttctaacctaaaaaaaggaacagtgactcctctgagttcagagtcctttccactaggtatacaaatga

SEQ ID NO: 1684 - DNA, 2362 bp, Homo sapiens; identical to SEQ ID NO: 1683

SEQ ID NO: 1685 - DNA, 4547 bp, Homo sapiens
aggctccggttcccaggcggcctgcggaggacccgcgaactcaggcgcagggatctcctccactgagggaggaactggagagatgggctccatcccaggcctgccgctgtcttgacagtgcttgctgcagaaaatctgcccctccttatctagagccgtgttctgaggaggaaacagcagagacaacacattacccgggcccaggctcgggtcccagctgccacgagcagagagcacaacagagcatgcacgggcctcagaaacagaagaggagaaataacgccaagcttctaacagaagcctcacaggagagtaatggtttcgggaacccaccgggggaaggggctgtccttggcctctgctcctaccctgacccaggctggcagcccaggacacactggatgtctgtcgtcttctctcgctttgggctgtgcctgggttctcaccccttcagcccaagcccagaccttaagctcaaaagaattctgagacaataagcaaaccttacaagggtgctcagtcttggagagtttactcttccaaataaagctctctgtcacagattgaaaagttacccgcatgtcctgtgaataattaatcctcctaacaacctgagatgctgtgaagcctataaaaggcccaggaattggatggagccacattactcttttttcagatcctccatgatatcctcacctgtcttctcttcacatgaagcaaagcttccttatcctgaaacatcctgaaagtttttaaatctgctcagctcttcaaggaacagagaaacagccacaaagatgtgaggcagtcaccttgcgttctaagcctggctggggaagggaccccggtcctgctttctccttctctatttcctgcttgtccagggaagcccatcaagctgccatctcaatgggcttcccaaaagtgaaggagatggcagttcccaggcacctttagctgaaagggacaattgccaggaggccttttgtaatctaactaccctggggagggagaggggaaaatgcactaaagattctttcagtactttaacaacaacaaaaaaagtctggagaaaataagaatcaacaacagggctttctaagatgaacttgggtggcggccttcagggcacctggggccacctatggaatggctgcttctccacaggccctcacaagttcaagctgaacagtcatccatttctggccgggtgcagtggctcacacctgtaatcccagcacttccggaggccaaggagggaggatcacttgaggtcaggagtttgagaccagcctgggcaacacagagactccatctccacaaagaatttaaaaattagccgggcaaggtggcgtgcacctgtagtcctagctacttggaggctgaggcaggaggatggcttgagctcaggagtttgaggatacagtgagctaggatcacaccaccgcactccagtctgggcaacagagcaagatcctgtctcaataaacaaaactccccaaatccctacaatttccaaggacaatttcaactacctggagaaagggtaactgtggaaaactccactaaaagatgctcccacctacatgggaagcagagagccagcatacaggtttttcctaccacaaaatgtctcctgggtacaagaaaacaatccccccgttatttctccttttctcttcctgtcagaagcacaggggcgtgtgtggcagaaggcaggctggcagtgcggttagtacataccatggccttggacctagccagagggaagcaatgcaggcggcgggagaggcagaaggcaggagagaagcagggacagaaactagacttactttcaacagaagcaacacgagtgaaacagttttgtctatcttaaattaaggcaataaacccaaatccttccccaacttccccctgaaacaaggcataatcccccagcgaagaaggcaatgcccttgaatccgtcccttctcaagtctgcaccgcaggcgccgagtgacggcggcttctcggcattcccttcccaccacaagatggtctctcctggtctctgcaactggggcgagccccccggggtacatgggaggccgtcctgcatgcaccctgctctgtcctttcttacgcatgctaaggacaagtccaagaaaatgggaactgtaatcccacacctcagccctgcctgaaaccaaggcctcacccattaaattatcttctcttatcccaaaggctggctgagattacacttactgatacaaactcatctttggaaatgcagctggagaaagaacaaaagccttcacgaaggcaccatcttaagctgctctttccgaaaagccacttttcacctaagtgggaaacagcatcggtaggagaactatgggactcctcccgtgctctcaccagctgttggtctggaaaggcaggcagtgtggtaagctgagaagtttgaaaataaagttttccaggggcctgcttggctggctggaaaggatgtgagtaggtacaaaagacccacaccagtaagcagctgagagccggacggcggcatcagaaactgagacaagcatgcaggcgtgagaggggctgaggatggggcgcgctggtcggacgcagcgtggtgaataccaggattctgcttcaggctctcccactgtctcagcggggtaaagaaggaaactctgaggtgcctctcaaactgtcaaatcaaactgtcaaacaaaatgcagataacaccatcaactttacttttttttcacctttatggaccaatttctagcccatcattttctcactgaagtctcaggccccagctctggggatgagaacactagggtgacagcagatgggaaggtcctgtctgtaagttatctgatgattcaacctccagacggttgacactatttccactatcatttgtatctgcagaaaaccaggttggccccacagtctcagttatgaggacctatgagtaccagggagagtcattttgaggttatttttaatgtaaaaacacttaaaactgttccgaagacaggacacacagtgacgtgaggaggatgaggaggatgaggaggatgaggaggacgaggaggatgaggaggacgaggaggacaatacagcagcatcgcaagttcccccacacaaccatgccccagaccaggtcctgcgccaggggaggatcagcagcaggccttcccctcccactttttgggacagcccaaaagtcacaggctggtgttttggccatcgagaatgggtgccaccagaggcaagactgattgaatttccctgtaggtactgaatgggatcatgacatcagcagttcctctgagctaacagcctgcagagttgtgtaggtaacatggggttagaggggacaccctgccaacatgcgcaaaatgacaactgaacacacataaacatacaacatttacaatcaccatcagagctgcaaacaataacgggttgtttgttcacacaaacaccctgtcagagcccaggggtttgtcttttgagtcctgaactcctcatcagcaaatggaaaatggtatttgtaaaccacacgacataggttctgtctgagggggtctaagcgtcattatctaggacagagcctgtagaacagctaatcattccagaatgtcagctgagagccagccataaagaggccgggcacaggcctatggccactgattcctatctgggcccctgagtcaaaaagtgaccccagcaatgactcccttcacagtctccgagcaaactctcctaagccctgggcacagggcggttaaaggttcttcctctcagaagacttaacatggttattaaattttgatcctaaccaatctctcttcttaaggttttttcatgacacgttgagtatgccaatttttaatgttttatttttctaaattttccaagaagctgccttacaacgcagtgcacagcaagactgtgtaccactgagcccatccatcaatgctagctctcgcaagggaatcgctggaaacattctcatgctgttggctcaatcaagatggttcttttcaaagtgtctaagctgtaattctttgacaactctgactttctcaggctttcagcaaaacactgctaaaattcaagggaaaccacaactcaaaaggccttctcactgctttggcacagagcgcccccaaagtcctgcaagccatcaaaagactcagcttgcaaacccaggctctgtctggagagggagagagggagagagggagagcacactttctggcaggggagcagctggggagttgcaaggacacacagagggtggccacataaacgcagccgggggacagaagagaatgacggcccagtgggtgctgagaacctggtggacgctcaatccatataacagagtgctgcatgctcgtggggtgtgtggggtgtgtggggaatgtggggtgtgttcgggtgtggggtgtgtgggggtatgtggggtgtgttcgggtgtggggtgtgtaggctgtgtgggctatgtgggggtgtggggtgtgtgggtgtgtatgtggggg

SEQ ID NO: 1686 - DNA, 4547 bp, Homo sapiens; identical to SEQ ID NO: 1685

SEQ ID NO: 1687 - DNA, 4547 bp, Homo sapiens; identical to SEQ ID NO: 1685

SEQ ID NO: 1688 - DNA, 4547 bp, Homo sapiens; identical to SEQ ID NO: 1685

SEQ ID NO: 1689 - DNA, 11813 bp, Homo sapiens
ctgaagcttcatgagacctcttctcatctgtgcaggaatgagcggccgactctggagcccaagctgttgcttcccatctggtggtgaggcctccactgtctggtgagtgcaatgtccgatgctagagcccaggctgttgcttcccactctggtagtgaatcctccatagtctgccaccagaaaacgctatgactttggggagagaaagagatcatggcttccgaacaagataaacaagcagtgcaactggccctggatctatgacccatttgggatggtcccgtagaactgcaagtaactgtcctagatcaacatgctaattggagccttaggcagaaacaagatgggaagaggtacatttctggttttggacccagaaactgccagaggccagcaaagcttataaccctttcgaggagcaattgttagcttgctattgggctttgctggaaacgaaacacctctgcttcaaccatgatgtctttatgaggcttgaaattcctattatgacttgggtcatgagttcccccgaaactcaccagatagggcacgccaagggggagaactgggggagtttccattccgggatttgggacgtccccaagtttccagccttgggctccagagtcagacaccgcactctccaggctggaagattctccaccaggccaggaagcaacagcatgggttccagagtgggacacccgcactcaccagactatgaaggactcaccaccagaccaagaagcaacagcctgagctccagagtcagacaccaccctcatcagactgtggaggattcaccaccagacagggaagcaacagcctgggctccagagttggccactcgtccgtgcacagacgaggagaggtctcatgaagcttcggtgcagtctgggaccacagctctttagtaacgagttgtttggcataaagcccagtcacagggctcttcaggacagggcttaaggaacacaaaaaggtcagcttgtttttgtgattgtctattgtttttcaacaatagtagctgtaatcccagctactcaggaggctgaggcaggaaaatcgggtgagcgagaccccgccactgcactccagcctgggtgacaaagcgagactccgtctcaaaaaaaaaaaaaaaaacattagctttagtattgataatacactactaacaaagtaaacgttgattttctcttgaacaaaaattttatgtattattaatatgccagcaaaatacttctgttcaccttttgaatacattcaaaaggagagtgagtacaaaagagaattttctcatgctctggggggggcctgggtcagctcaggaaggaagccctgcctgtaaaggctgcagcttaggctgtctctcttcacttagcccagcatctgatcacatcttctgtcactcagggcctgaggggcgggacctaaagcattatccaatcagagacgctgggctggaaaccgtccaatcaggcacgcagctggagcgacgaggacggctttccgcttttggcgcggcctttgtctctagctgcagccggcgtttcaggtctcgtcttcactggtctgtgtcctattctcctggaggcccagcctctgtggccctgtgacctgcaggtattgggagatccacagctaaaaccccaggacaccctggaagcatagaaatgttcttcagacaatcagtaaaaacaaacttctccaagctaaaggaggatgttcgaatccatcataaagaagctggaaaccttgaaaaaagattagatgaatggctaactataatagacagtgtagagaagaccttaaatgacctgatagagctgaaaaccatggcccaaaaactacgtgatgaatgcagaagcttgagtatccaatgtgatcaacaggaagaaaaagtatcagtgattgttaaaatgaatgaaatgaagcaagaagagaagtttagagataaaataataaaaagaaatgaacaaagcctccaagaaatatgggactatgtgaaaagaccaaatctacgtctgattggtgtacctgaaagtgatggggagaatagaaccaagttggaaaacactctgcaggatattatccaggagaacttccccaacctagcaaggcaggccgacattcaaattcaggaaatacagagaacgccacaaagatactcttcgagaagagcaactccaagacacataattgtcagattcaccaaagttgaaatgaaggaaaaaatgttaagggcagccagagagaaaggtcgggttacccacaaagggaagcccatcagactaacagtggatctctcggcagaaactctacaagctagaagagagtgggggccaatattcaacattcttaaagaaaagaattttcaacccagaatttcatatccagccaacctaagcttcatcagtgaaggagaaataaaatcctttacggacaaacaaatcctgagagattttgtcaccaccaggcctgccttacaagagctcctgaaggaagcactaaacatggagaggaacaactggtaccagtcactgcaaaaacatgccaaatcgtaaacaccatcaatgttaggaagaaactgcatcaactaacaagtaaaataactagctaacataatgacaggaccaaattcacacataacaatattaaccttaaatgtaaatgggctaaatgctccaattaaaagacacagactggcaaattggataaagggcccagaccctggcaggtgcagtggctcacacctgtaatcccaccactttgtgaggctgaagtgggcagatcacgaggtcaggagatcgagactatcctggctaacacagtgaaaccccatctctagtaaaaatacaaaaaattagccaggcatggtggcaggcacctgtagtcccaggcacttgggaggctgaggcaggagaatggcatgaacctgggaggcagagcttgcagtgagccaagatcatgcctctgtactccagcctgggcaacagagacccatctcaaaaaaaaaaaaagagtcaagacccaccagtgtgctgtattcaggagatccatctcatgtgcagagacacacataggctgaaaataaagggacggaggaaggtctctgaagcaaatggaaaacaaaaaaaaaaagcaggggttgcaatcctagtctctgagaaaaacaagactttaaaccaacaaagatcataaaagacaaagaaggccatgacataatggtaaaggcatcaattcaacaagaagagctaactatactaaatatatatgcacccaatacaggagcacccagattaataaagaaagcccttagagacctacaaagagactaagactcgcacacaatgataatgggagactttaacaccccactgtcaacattagacagatcaatgagacagaaagttaacaaggatatccaggaattgaactcagctctgcaccagccagacctaatagacatctacagaactctccacccaaaatcaacagaatatacattctcagcaccacattgcacttactccaaaattgaccacataattggaagtaaagcactcctcagcaagtgtaaaagaacagaaagtataacaaactatctctcagaccacagtgcaatcaaactagaactcaggattaagaaactcactcaaaactgctcaactacatggaaactgaacaacctgctcctgaatgactactgggtacataatgaaatgaaggcagaaataaagatgttctttgaaaccaatgagaacaaagacagaacataaccagaatctctgggacacatttaaagcagtatgtagagggaaatatatagcactaaatgtccacaagagaaagcaggaaagatctaaaattgacaccctaacatcacaattaaaagaactagagacgcaagagcaaacacattcaaaagctagcagaaggcaagaaaaaactaagatcagagctgattttttttaatgggtttcattgatgttattgcagaggacatgattttttttaatggccatggagtattccatgattatgtgccatattttgttttttactacatcttttattttattttatctttggatgcagggtctcacttattgcccaggctagattaccatggtgtgattttggcttactttagtctcagcctcccaggctcaagcaattctcccttacctcatcttctcaagtagctgggactacacgtgtgcgttactatggctggccactttttctttttgtattttccatgtagacaagattttgctatttttttcaggctggtttcaaacttctaagctcaggcagtccacctgccttggccttccaaagctctaggattgaaggcatgagccaccgcttctgaccataccatattttctttattgatgggcatttaggtcctgtccatgtctttgctactgtgaatagtgctgcaatgaacatgcatagcatgcatatggatgcgtctttataataatttatatttcttttggtatatacccaattatcaggttcctgagtcaaatgataattctgttttcagttctgtgaggaattgccacactgctttttacagttaaactaatttacactcccaccagcagagtataagcattctcttttctctgcaaccttggtagcatctgttattttttgacttttttaaaatagccattctgactgatgtgaagtggtatctcattgtggtttttcttttaatttatttgtttatttttttgagatggagcctggctctgtcacccaggctggagagcagtggcacgatctcagctcattgcaacctccacctcccaggtttaagtgattctcctctatcagcctcctgactagctgggactacaggtgcccaccaccatgccaggctaatttttgtttttttattagagacaaggtttcaccatattggacaggctggtcttgaactcctcaccttgtgatctgcctgcttaagcctcccaatgtgctgggattacaggtgtgagacaccgtgcctggcttctttttaatttctttaatgattaccattgagctttgtttttcatatgcttgttagccacatgtatgtcttcctttgaaaagcatctgttcatgttttttgcccactttttaatgaggtttggttttttcttgtaaacttgtttaagttctcattaattctggatattagacctttgtcagaggcaaagtttgcaaatattttcttttattctgtaggttgtctgcttactctgttgatagtttcctttgctgtgaagaatctctttagtttaaataggtcccatttgtcagcttttgcttttgttgcaattgcttttggtagcttcatcatgaagtgtttgcaggtttctatgtctagaatggtagcttttatgttatcttgcagggtttcttataattttatgttttacatttaagtctttaatttttcttgagttgatttttgtatgtggtgtaattaaggggttcagtttaagtgttctacatattactagttagttattccggcaccatttattaaatagagaattttccccacatttcttttgtcagctttgtcaaaaatctgatggttgcaagagggtggcattatttctgggctctctgttctgttgcattggtcttgtgcacatgaattttttataacatctttctctcttctgcttttccccccataaacattttttttttttttttttggagagggagtttcgctattgccaggctgaagtgcaatggcatgatcttggctcaccacaacctccacctcctgagttgaagcaattctcctgcctcagcctcccatgtagttgagattacaggcatatgctatcatgcccagccaattttgtatttttagtagagacagggtttctccttgctggtcaggctggtctccaactcccaacctcaggtgatctgcttgcctcaacctcccaaagtgctgggattacaggtgttagccaccacacctaggctaacattctttcaagtgcatcctgtttgcaaaacttagattaccaagagttcaaagactttttaaaaagttccaaaaaaatttttcttattctctttttccttaagggatttagattatgtgtagatatttttctctgctttcttgaaatatctgtaaaccatattaacagttaaataaactttgtctttttttttttttttttttttactttagattatcttttctagtacatctgatttattggtttatttctaattttaaaaagtttgtttctctcctttttaggactttttttttttttggatggagtttcagttttgttgcccaggctggagtgcaatggcatgatcttgactcaccaaaacctccacctcccaggttcaagggattctctggcctcagcctcccgagtagttgggattacagtcacgtgccaccatacccaactaattttgtttttttagtagaaacggggtttctccatattcctcaggctggtctcaaattcccaaactcaagtgatctgcccgcctcagcctcccaaagtgctgggattacaggcatgaaccaccatgcctggcccatttttagtcctttaaagtaaacacaaatgtgtttagataaaagctcattttaagagcacacagaagcttagcagaaacataggattaaatttagcaatatggaatgagaaacgctaaaagatactaagtttctttgaaagtaactttattatccaaggtaattatccaacatttgcaggctgaagtacttacacagcaaaaacaaaaagagttcagtgcataaactgaacagtagagtctgtagttgtacttggctttctattgatgacttcagaacaattagcatagttatgtgtagtgtttgcagacactacacataacaatacattcatatacattaaacagttttctttttctttttttttaatttttctttgagacagagtctcactcttgcccaggctggagtgtaggggcgtgttctgctcactgcaaccactgggacccaggctcaagtgatttctcctgcctcagcctcctgagtagctgggattacaggcacaccccaccatgcctggctaagtttttgtatttttagtagagatggggtatcaccgtgttggccagcttgattgtgaactcttgacctcaggtgatccacacacctcagtctcccaaagtgctgggattataggcatgagccataaacagtattttttacaatagtatgaatataaagccacaatacttactttgaatgaatcacttaaatggttattttaatattgttatttacacttttgaaatataaactattttaactgaagtatagttaaactttttaactgccatatacattactactagtttattaaaattatttatacttagatatttaatctaataccccaaaaaatttactaccaaattgttacagtcaatactagtctgacatgtttattactttattcaatagggataattataagtaaacacaattttagtatcttttatttcactcaattggaatgctgctattacaaatgaaataaagacagttgatgtggccacccaaaaaccatgatagctcttcagttaactatgttggaagttctaatatactccacaatgtgaacacagtcagattctatttctgcatcaaaaagtgttgttggaagttgtcagatatatttcaatatagaacccccattcaatgactaggagatgagagagcagcagagatgggaaaaaaagctttataaaattcttctgaaattctgccccctttcttcataatgctcatgtttctcatgctgagagtaattgtgcactttgggtggttagagagaaattgcttttaggggactattttctggctgacttgatcaatcttatatctaaactgagctttttctcaagatcttttttctcaagatctttttaacttttttctctcaaaattatcttgctcagatggagatctgtttttctctccaatactttgggtgtctgtttcagaagccctattagtatcccatggtgtctgaatgaggtaggctgtcacagtgagaacttttgtagatatctctatctggactcatgctggaaattcatccgattttttttccatgtcaccatgataattaaaaacgggctgaaacactggtcacattcccattattgtgaaagtgcaattctactcacaaggcctgcaggctctcctgcagctcaggctttcctctctgatgtgacactagagtgctgctgtgggaaatgtggttcacataaactgagctgtgctcaaggctgtccctcagtggcagatgagagaggtcaagaggacactagcaaccaggaaaaagcaagaaagtgctgtagcccaatgccatggaacacagagccactgctgtaaaatgtaaatagccaaaaggatagaatgcttttcaaccatttttgtagcagagtgaaaacctaccttcagcaagtacctggcttcaagctgctaaactacctcctgttatgaaggtgtgaaaagtttttttgttattgaatataaacaattagcatatacagatggcctcttcaatctccatgtgaatttaggatgaactatgtatgacatggttctggaaattctacttgtggactaattttggtgaccatctttctgtctctgcagtctcttaagcagattgactatgatgcatgtcacataaaacagttttctttctgttctattgtggagtttttctggggctggagaacattcttttgttatttccaaacactgtctataattaccagacatgatataaacacataaggtgccaactggaatttactctagaggggactttccctctcagacttccagtcaactcacacttgtgcaacaaagtgcatgctgtcccctaaatatgcaagcagaactgtgtttctgcctatttggtatctatagtcctctacagtcacttctagagagactaaaccaaatttctaccaacttcacagggcaacaatcaatagttttatctcaatgactcttgtatcttcagaccttaaactgattcagagaccatggggcccacaaacctaatcagagtaacgttttcattgagtacacattcagacatgagaatcttcactttccccttttttctcttggtaaaatgttcacaaatgtgcaggtaacacctgctgctactccagccattcgggccctaaatctgcagctctacattttgtatctaggtcttgagatttgggaaatagaaaatttttatctaaaaatgcaagtccttttggttatcaaactcagacattgaaatgaaagtgcagttacgcctttctcctcctttgaaatatgtattcatctcttgaaactgttcactattgccacaagtagatgtatattaaactgataataccacattggacactgtatctcataccctaaaccataatgatatatgtccaatcaataaccaatgttacttctttaaataaaaatttctgacaactctatcagcccactctctgtccctttgtttttgtcttcacaactcctcttgcaactgctgttaatgaaagtgtagattctaggcaacttcagtctttgctcccaggttataatccttaaacttcacccaaataaactgtctacttacattcatgttgtgtcagcttttttttttttttcatgtaggcttaatacttagaaagtgctagagcagcctctattaggggatctcttctctgattgtactccacttgctgtaacaccaaaggatgcagaaccaggttctgtagcagaaattgctggtgtctgtggcaggggagggcacctgaggacagggaagaagaaacatatttttatctttatggagcagcacattgttcccaaataccttctgctttaagggacagaaatggatggactttttctgtcttttctgccagttgatgtcatgcttgcaggtaaacatgtggtactgacacccttaaaggcatattctcaagaggcaggtaaaaaaccaattccaaaaaagtattgcaacaaaaggaagcaccaaataactataatatctttatggcttgcaaaaatataggcagaaaagggctttcttttctagggaagagcaaacaagattagaaaggaggtgggagaggaacagcaaatggagggtgaaaaagtcagattttagatcagagaatggcttaccctgaaatcagcatgttcttaggagggacataaaatggggttgtatgttgactcagactgagggtagcttgaatttcaggagcctgagagaagataaacttaagtaaaatttgattaagaaatattttattttaggctgggtgtggtggctcaagtctgcaatcccagcactttgggaggctgaggcaggcggatcaccagaggtcaggagttcaagaccagcctggccaacatggtgaaaccctgtctactaaaaatacaaaaattagctgggcgttgtggcaggtgcctgtaatcccagatacttgggaggctgaggtaggaaaattgcttgagccctggaggtgaaagctgaagtgagccgagatggccccactacactccagcctgggtgacagagtgacactccatctcaaaaaaaaaaaaaatcataattgattttgactgctgaaggcaaattcagctggttttttgttttttttttaatgagaaaaaggagaaaatgtgcagagtgtatgtctggctgtgtgataggcaagaaaagggagcatcatcttaatcataacgggaagagtgtttctttccataaactgttcctgaagcacacaaaggaaggagaattttattaatcacaaatatttttcataattatctatgtgtttcatctttcctcatctcttttctttgttctatgcatttcttccacttggcttttcctgggctgcatcttatatattaaaccagtaagcataactacagtgttttgctgagttctgtgagtagctctaccaaattactgagcttcagggaagttatgggagtccccagtttttaaacagtagctcagaaccatagatgggcccatgggatttatgactggcatctgcagtgagaacaatgttgtgggaccgagccctgaatcagggtctgtgctgactctgggtagtgttagaaatcaaatgttatacaataagttggtgttggagaattgtttgatgttcagcaaatgctacagatttggtgccagaaagaagatatcatggaggcctggcctggaataaaactctgggtgtttgggaatgggagattctgctctcctgtacacagattgtcacactgcccattgtcctgtgattccaggtcttctcccagggtgacagaggactgaaaacttacaggaaaggagctctgatgacacatccccttttcttgcagctgccaccacaggattcccacatactcccaaacacacacactagacattgacatgtccacactcctcccaggactaggcaccaccctcagtgacttcaccatgacatttttggtccaagcacttctagccaaaaagccaaaagtatctacaagtttccttgcatattcccatccccggatatcgaatctgcagcagcaacctgttttctccaccagcctagggttctggccctccttttcataatctcatctgcctgcatgcacacagaaataaatcagagtacagccccacctggtcaactatctgtagcaaaaatctgtccattcactgacattgcac

SEQ ID NO: 1690 - DNA, 2661 bp, Homo sapiens
gggcggcggaggggtgactgcacaaggaggcattaagctgtcctgaggatcactgttcccaaagagcctgcatccacagtccaggcctggaaaaaaggggattccgggcaaatcccctaggtcttatgagtcactgctccaggcaggagaaacggaaaatcccttggccagaggcgccaagaccgggctggaggccaaaggaaactgggggcgggaggtagaggccgcggctcacatgctcccaccactggcccccggaacagctggacagagaatctgtgtgcccggtcgccctctgccgccctcctgccgcctgccacacccatcgaaagctgctgcctcagcccagggcaaatctgagctgagaccggcgtgaccctccgggcgggagcagcagccacgctaccggaaccccgcgggcctaacccggctccctcccgcctacacccccatagaccccggcccggcttcaggtcccctgcccgctcttcgcgtccttgtcctgttctcacgtccctccttcctcccttcccatctccatcaccgccagcagatgaccttgtcaaggctggaagggaccgcaaagatcctcaggttagaggaggagattaagacccaacccgggaagactggggggtccaaggtcctcggcccgctcgcgcgcggtcggtcaccagccccggctcacccgagtgtgcccccggagcccacctcctgaagcgcgcgctcctgctccagcggcaccagctcgtggccgcggtgctcctgtgcggcgcaggacagcgcggcgggcagggccgcgccctcggggcacgcgtcgcagcgcactggctcttcgcccgcgggccacggctcgggagcgcagggggccgacggctccgggacactgggcagcgcgctgggtgccgagggctccggggccagggcaggggccgggccggggccggacccggggcccgagccctggcggagctgcagcagctcggacagcgtgtggttcttgcggagctgaaggccgtcggggaagggctcctggcacagcgggcagcgggccgcgcctccgggtccgccggctccactcgcgccacgatgcggccagagcgcgcccaggcaggcgagacagaagttgtggccgcagggcagcgtcaccggctcccggagtggctctaggcagatggggcagctgaagggtccactgccgtccatgactccgcggccgcccagggcgccgccgattgtgctccggcctgggagggacccgggccgttcgcgccgcggcacctccccctgggacctaggccagggctccggcccccgcccgcccccagctcggcccgccccgcagcaccgcccgcctgcgggcccgcggactcccagtccccgcccagacaacgcagggaggcctccgagcccgcgcgacccccaggggagtccgcgtggtcctaaggaagggcgctgctgaaagggtgtgaaactgagtgagcgcgggcggagaacgcgagaggtacagtggaaggaatgggaaggactcagcctccatccctctggtccttctgggccaggccagcgctccgcaggggctgggcgcgtctagctgtgtcatgcctgcacctttgcgctcgacccctccctggcacccttagcaaagttcctgagctgctgactgcagagaaaaataactgctgatgtacatatgtttttgccccttagcgactctttttttttttttttttgagacagagttcctctcttgtcgcccaggctggagtgcaggggcgctatctcggctcactgcaacctccgcctcccggattcaagtgattctcctgccttagcctcccaagtagctggaattataggcgcttgccaccacaccaggcaaatttttgtatttttttgtagagacggagtttcaccttgtccaggctggtcttgaactcgtgacctcaggtgatccacctgcctcggcctcccaaagtgctgggattacaggcgtgagccacagcgcccagctcctttagcgactctttaccccaagtagggaacttggacttttctagacctgaaatgggaagttgacgtcattccctaagtcccttgtctgaggaatgtagttctggcccctggacactggggacacctgtggtggggttgggggttccccaactggaagtatttaaagctcatctaattatgcacttaaagtggtgcgttttattgtatgagttatatctcaataatgttaagttaaaacactacaccagaatgacaacaaaataagtaaagtagcactgattataacccaaagtgtaaaataaacatctatgagtccatgccgatataaataaataataaattaacaagctggggagaacagacatatttcgcattgaaaattccaaataatgtttttttatttttatttttttagatggagtttcgctcttgtcgcccaggctggagtgcagtggcgcaatctcagctcactgcaacctctgtctcctgggttcaagcgattctccctcctcggactcttgagtagctgggattacaggcgcccgccaccacatttggctaatttttgtatttttagtagagacggggtttcaccatgttggccaagctggtctcgaactgctgacttcaggtgatccacccgcc

SEQ ID NO: 1691 - DNA, 2875 bp, Homo sapiens
aaggaatcctgattcccaggcggcaggtctggggctgagcacatgctgtttgggggatcacctggacgcctggggagacagaaatggttaaaaaatggcaaacctgatggtttttctgacccttttctattccccctagagacggaagcagtgaaagggaggcaaagaaaagctatcaacccaagtaaatcgttcctaacgtagccagaggggtcctcagcatctccgcacatctgctcccccagccccgggtctactggctggactaatagactaaacgggaggtctgtaggctgtgactcgataggcacagtggcaagccccttcccggggaacagttcttgctggtattcggagcccatgcgaaatagtgcccttgttttacagttcttttctttgcaagtgctctttgagcctgatggcactgataacctgaccacgaatgaatgtgctcagtttccattgcctagaagggtcaaagtctaagggtagcagaaaagaggaaggtagtatagggtcaggggaaaggaaggcagaaccctaagaccagctgtgacaagttctgtctagaggtgggcctgcaccccaacacctttccttcctaggacatcattacactttctgaatagtgttcttttttttttttttttttttttgagatggggtttctttcttgttgcccaggctggagtgcaatgtgcacaatctcggctcactgcaacctccgcctcctgggttcaagcgattctcctgcctcagcctcccaagtagctgggactacaggcacccaccacaacgcccggctaagtggctaatttttgtatttttagtagagacgggttttcaccatgttggccaggctggtctcaaacttctgacctcaggtgatccaccagcctcggcatcccaaagcactgggattataggcatgagctaccgcgcccggccctgaatagggttctttatcccattccagtgtaaggtggccccacttcttcccagccttctccatgtctattagtattaggtatcttagaagtcaaggacagcattggtaacaagagtcccccaagatggagacatctccatcatgtgtagggcaggttggggtgtgtgtatgtggatgaaaacaaggttgaagccggctgttatagacttataaatatccatattggaactcaccaactgtgcatgttgggggaaaagaagcagagagatggttgcagaaggagaaaggagagtcatcaataatacccaaatgagctggttaatgtttccagtttccatccagaacttgacatttgagcagagccacagacagaagctccttactggctttgtttcagtgcctctcagttggaagcataatagaagattagaaaaaccaattgcctggatagaggctcaaatcattttttaaaaaataaatggattcctgttaatgggcctgattttcaactgtgtttaggtaaagaacattgccatcgttcagaattagacatgagcttcagtgtccctgaagagccactttaaagaagaatgtctttaagatttgaaagaattcaacccatgctacttctgaacgatttactgttaggtgctgtgcagatatgtgttagaaagaaataggaggcttgtgaaggatccaagagtgagtatgacttcaaaagcagtgcaggttaatttggggcctttggagatgagtcatcctgctaaaataaacacatcagctttctcttcacaacttaatacacgtgtccatatttggtaacaggcccgtggtgaacatgttggcctacctgcaaaggggccgtctccatgctaaagtgtgggcaccaaacattagcatatgtactaatagatcatcaaggaaggttattagtgacacggctacctctgacacatgggacgcaacttaaaatagcacatgcagacatttttctcttatgctcggactcagggaaaagccccacttgggtaatgttttggggtgattttgatgatctgactggttctttgtgttaggacaatgatacagtttagaagtttgtcctcttccaatttcatgttgagatgtgatccctaatgttggaggtgggcctagtgggtggtgtttgggtcatgggggtggatccttcaggaatgcctttgtgcccaccctatggtaatgagttcgtgggagatctggttgttaaagaggctgggacctccccttttccccctcttgccccctcttgccatgtggcacgccagctccccttgccttctgccatgagtaaaagctccccgagggcctcaccagaagcagatgcgggtgccatgcttcttgtatagactgcagaacgtgagccaaataaactttgtttatgaagtacccagcctcaggtattccttcgtagcaatgcaaaatggatgaatatggcaagtttcttagctatttaaggagacgtatgggactctgcagatgatcatattcccatatacaaattaaggcacatagccttgatggttgggagtttcctaaattttcagaaaattctactgtgctaggttgccaatgccactcaaagtgatgtattggttgatatcctaaggaaagttgggttttgaatgaacaggcaatcagttagggtatttgatgtatattatgagacatgtggacttgtataaggtgcctgtgggtataggaacagagcagaagaaagagagaacaaggaagaaagagaggaataaaagcaagcaaacaaaaccaaaacaaaaatggcacgctggaaagaagccaaatggaggaaagaagatgaacccctttagtccatattctagtagctactaggtccattggaccaaattctccacgtcttgctcagtaatgata

SEQ ID NO: 1692 - DNA, 891 bp, Homo sapiens
ggaattcagggctcctggttcctcccgtggctggagccaccgtgcccagccacagtcttcttttttttgagacagggtctctctgtcacccaggctggtgtacagtggcgctatctcagcttactgcaacctccgccttctagactcaagcaatccatattcagataatttttaactatttttttgtagagacaaggccccactatattgcccaagctggtctcaaactcctgggctcaagcaatcctcctgcctcggcctcccaaagtgctgggattacaggggtgagccactgcacccggccagttgatcttaccttatacattagaaggctctgcacccccttcaagccactcttggcctataaaggagtggacagagaattacccaagggtggtgggatcctgggcatttgagagctcagccttctgtcccctaagatagcttttttttttgccatctgcatgtctcaaatacgttcaccaccccccatacaccacctaagaagtcaatgcaaactttcacccctttgactaatataaaatgagtattcctggaggcagtcatccccaaagaaaatggggagtggcaaagcaacagggcaaggtgttcctgtttcaaagcggtgaagaacaaaatcgcacggacaattttgagctgcaaaaattggccccaggaaacttctgagcttgggagataaaaggcagaacctggaattgtagcatccaaggacaaaaagaatgtttgccagcaaatcttggctgtcaattttaaaggggccgtgggcggggcggaggggggcgggtaggattccaacaaaaaatgagtataataaataaaaaataaaagggggaagagttgttaatggtttaactgctggttcagttctga

SEQ ID NO: 1693 - DNA, 891 bp, Homo sapiens; identical to SEQ ID NO: 1692

SEQ ID NO: 1694 - DNA, 891 bp, Homo sapiens; identical to SEQ ID NO: 1692

SEQ ID NO: 1695 - DNA, 891 bp, Homo sapiens; identical to SEQ ID NO: 1692

SEQ ID NO: 1696 - DNA, 891 bp, Homo sapiens; identical to SEQ ID NO: 1692

SEQ ID NO: 1697 - DNA, 891 bp, Homo sapiens; identical to SEQ ID NO: 1692

SEQ ID NO: 1698 - DNA, 891 bp, Homo sapiens; identical to SEQ ID NO: 1692

SEQ ID NO: 1699 - DNA, 891 bp, Homo sapiens; identical to SEQ ID NO: 1692

SEQ ID NO: 1700 - DNA, 891 bp, Homo sapiens; identical to SEQ ID NO: 1692

SEQ ID NO: 1701 - DNA, 2080 bp, Homo sapiens
tgtgtaattataaaagaaagaggtttaattgactcacagttctgcagatttaacaggaagcatggctaggaggcctcaggaaacttacaatcatggcggaaggcgaagggaaagcagacaccttcttcatgggcagcaggagggcgtgtgtgcgagaatgaggaagtgccgcgctttaaaaccatcacctctcgcgagaactcactatcacgacaagaacgtgagggaatccgaccccgtgatccaatcacctcccgcctgtccagtcctacgtgtccctcccctgacatgtgggaattacaattcaagatgagatttgggtggggaaacagagccaaatcttatcagaaagagcggctcagagaggtgagatgacctactcaagttccaggagtgggagtgatgggacttgccacggattccctctgtgtaaatctgtgacagccctgatgtaaatcagacatggcctctccctctgggagcagccagtctacttggtgaaaaacaagggatgaaaggggacacagcaggtgacttaagtgctatggttggaatgtttatgtttccccggaattcttttttttttttttttttttgagacagagtcttgctctgtcgcccaggctggagtgcagtggcgtgatcttggctcactggaagctccgcctcccaggttcacgccattctcctgcctcagcctcccgagtagctgggactacaggtgcctgccaccatgcccggttaatttttttgtatttttagtagagacggggtttcactgtgttagccaggatggtctctatctcctgacctcgtgatctgcccgcctcagcctcccaaagtgctgggattacaggcgtgagtcaccacacccggccccccggaattcttacgttgaaatcctagccctgaaggtgacgtggtgatgatgtgatgatggcagaaccctcaccaatggaatctgggccgctgtaaaagaggccgtgggagcttgcttgcccctcccaccatgcagtgacacagcaagaaggcagtgaggaatgggccctcgccagacaccaaacctgctgggaccttgaccttagacttcccagcctccagaactttcagaaatgtttgtaagacacccagtttatggtatttttgttacagcagcctgaacagactaaaacactagcagggcaaggctgctgtaacagtagacaaaccccagaagctgaaaaatcataaaagtttttgtctatattgttctgtccataattttttttaaaagcataaaagtttattttgtcttcctcagtagtctgaactgagtattccaggttggtccccgggctgctctgctccgtgcaggaactcaggaatcctcgtttctctgccttcctctaggccagcggttctctgctagggtgaattttcccaccagggtatgtttggcaacgtctggagagtgatcctcatccactcccgtccatccatgagggcctagtcacagggccacatctaacttcaggggacggagtgctgggaaatggagtctaggtgagtgcccaggaggaagggaacagccgactcaggtgggcagctggcagcttccccgacaggcgtcctaactggtgcaagagacatgcaggatggaggtggttggaggacatttcggtaactaggtcagagcttgtgcaaaatgcagagacaagagagagcctgacaaagcgcaggcactgccacctggatggaggctgacagtgggagggagggatcagtgagcagcaggcgggtggcaggagcctgaaatgcaggactgaggagtctagtcttcgtcctgaaggcagggaaggacctttggccagtctcctgacgttctgccccggctctttcctccctgaaggtgagtccctcgtgtccatcttacatagttgggaccttgctgacacacacttctgcctgcctttaggccgtttccttgattttctatgttgccaagatgactggcagctgctggaggtcaggaccacagcctggttctcagagccccaggcaccaagttcccacccacccttgcaaactctccttttttttt

SEQ ID NO: 1702 - DNA, 5104 bp, Homo sapiens
acacataagaaggccctactatgcaccacgcctggtgctagcactgggccactgtctagagggggagacagatgctcattgcaatggcgaccgtttccaggaaggagagattcaggggtgttggagggatcaccaggtgagggggtcggaggaggtggccctgagtgagctgtatcggtgtctgaagtggggaggaagagcgctgtgggcagagggaagagggtggagctcggtggtgggaggaagcggagcacgtggcacagaggcgctgagcactcccaaggctgcaaccccggggaagggccagaccatagctatatttattgcacatggtgccggagaatggctatgagcaagacagaggtggtctctgttctcaaggcagctacagagggacagccactcccccagcccccaactatgagcttcccagaactggcctgaaggtgcagctgcaatgatacgggctcacatcctggcatcctcatttgctagcgtgaaaatcgcatttctccaaacctcggttttctcatctgaaaaacaggcacagcacctagtttgcaggactgggaaagttacagagggttaatggcaatgcggttggccttgggcactccttgttctgacctctggagttcggctgccctgtggtctggccctggctctgtggagaggctttcccaggccgaggggctcaccaggccttccctagtgaggagctctttctgccagagctgagctcatgggcagggcggggcgcagaggccacatatcagccagctgtcctccctttcctgggagctggtccagagacgaggggcagggcgtctggttttcattgtgcggccgtctctaattcctctggcatctgagctacttttcagaaggagggagatgcacttaactggttgtgacccagcttggtgctgaggaagaagccctgggcctgggatcaagcagagttgaactcgaagcctgcctcagccacttacctgctgtgtgacgcggggaggccactgtagagctggcacgaaggaggcttcctgtctgaaggagctggtgcagacacaccggtggggcacccggcagaacaacagcagaagatctgcaatcacacgaactggctgcctgttctctacacgagtccaaatgctgtcaggctcatttctctgtttgacagtgagccatggacaagctgtggggcaaaagcaagaactgtacgtggtctccatttacagaactcccaggctggtggaggtggcttttggtacaactcaggtctgagggcaaaaatacacactttggctttgcacaaaggggctgacgaccccatacgtaccctagcacctgggctgcccagctaaagaggtcaagtggccacaagctgagcctacggtaatctttaataactagagtaaatttccttgtgaactggagaattggtaagacaagctcaaaaccagatcttccaactggcctccctatcccccagctccctccttccttttttctatctccttagcgattgttgtcttctccaaagggtctcccctttccaaaccccaacatgattctgttttgcctcctgttatggactgaattctgtcctctcccaaattcacatgctgaagccctaacccccagtacctcagcatgtgagtgtatttggagacagggcctttgaagaggtgattaaggttaaatgaggtcattagggtggaccttaatctaatattataatttacatattatatataatatatattataaattataaattatatatcatatatttttatataatatataatatatacaatatatgatatataatatatagtatataatatataacaaattatatataatacataaaatatataatattatatatcatatattatatataatagtatatatatttatatgatatataatatatatgtattatataaatgttatatattttattatatataatatatatgtaaattataatatatattatatattgtataaattataatatataataaatataccatattagatatattgtaacttatatattatataatttatatattataatatataaattatatctaatatggtgtcctcataagaagaggggattaggacatatagagacagatggcagggctgtgcacgtacagaggaaagaccatgtgaggacacagtgagaagatggccagctattacacaagccatggagagaggcctcgggagacaccaacgtggccgacaccttgatcttggacttttagcctccagagctgagaaaatattaataaatttctgttggttaagtcacttagtctgtggaatcgtgttgtggcaatcttcaactaatacacctcctaataaaatacttgtttctaaagggggagttgttgcatgttgaggtttttactgtgcacctctgtctggggtgaatgctggcaaactgcaggaagactgcgccataaaccctatcatggtttggcttcttccttgacccactcagaaaaagttcagttcttctgaaaaactcacgagtactccacaaggtggcacatatcaccctccacaccatcctcatctcgaggtctctgtagtacacctgagaccaaggggggagctcgtgtacattctggtctttgtcaacagtgactcccaaccacacccttattctttcaaaatatattttattagcggcacatggaatgtcaagttaagcaaattctttccagagagaaggtgagcctgacagactaaaacgttgagcacggatgatacagcagaaataacatttccagtgtaatgagagataaagaggaatactgcccaccgaggaaatgactttcttcaccatgctgaccacactgcacagcgcccgatccggctggtgaggatggggaggtgggaagaatctcaaagcactggacagggtgaggactcaggaagtcacggggtcagccctacagcatcagctcctctctgttgttggagaggccctgagccccattactcactatacgaggaccagagtgtctttggcaggtggaggctggctcacgggagaacaccaagtgagggggctcctctgtgaacccaagaaacttcaaggaaccccacagcgtctcccttatgacctcccatctccagattaggaagctatggattcccagagggtcctttggaagtatctagaaatgtccagggtgagtctagccaggttcaccttcaggatgctttccccatgccctgtggttgagacggctccgatgtcattgtcggcataacctccagctcctgctcaaaaagggtgattgttctgagcagtaacagtcaagaaattcaaatccatattagaagtcggacgctacatgaaagttaaatcgcgaagggtgctcaagtaccgacaaaggtcaggttagtagccatgatctgcggaggcaaaggtggactagaaagcgtcatgtagatgccccagaatttaggaggataaagggagcctcagaggggcaggcctgacctttcacagagcagctacagcaggacagcatctccttggccccaaagcacagccattcctttttgctcaatgaagccaccctctccctgtctcctcctcatgccccacacactatggaggaagaaacagcatgactgcattatatggatctctagcaaggccatcatgttccagtgatttggggaaaatgatacccacaacctaacatccatgcacactgtctaatggagggcagttatatttgttgagggtgggcataattggacctgagggaactattctgggctatccacttaagtgggggtctggagtgaaagctactttgataagatttcttccttattttgggcttggattaagcaaccttacagccttctctgagtcattcttgtatctgttcacacacagctaccagcctcagagtcctttagccttggaaggattcgcctttaccctcccacagttgatacagaagcacagaagattgacatttgccttacttattgatgctggacatggggcaaggactcaggagttgagatgctgcattggattgtcacaaggccccagaggttctcaaaggcagataatccctggctctggttctggagggagctgacactggacagccaatgaactgctgcagtgggaggaggcgcctttactttttcttataagcttctgctggggaattaactgaccgggttccatggtgtcaaagtgccctaatatttggaagcagccaagtctttgcttacttttcagttactctaggaccacagaaggccaggtgtctccaagggtggtcctggcacaggcatcgggcgtgtgaagctgtcctccccgccacatgcacttctcaggacaagtgcattgcctgaggtgaccactgctgagcctagtaccgtcccccatgactgtccaggcaggggcctggccagtggcagtgctccttggggaggctcctcagaaggccaggcagagcacacctggtgctcacagctggacagagagttctgagaatttagcttatgccttttcttgtcaagatttaccactgtaactcaagcttaaaattaatttctaggatctaacctggagtggccctgtggcctggtctgaacgcagctgaagcaagctgcactactgaccaggcacagtttggtgggatttttgccaaggagaaagaaaggtagactacttcacatctcttgggtgatataccaaggagaagaggagttaccaagcctctactctttttaaggaagcttccagtgtctctgagttcatgacagaaaaagggtatcaagaattgtcgagagtgtagattattactaaagactagagcaacacattaaaaagggaaggtagggctagttttcctctaaaagaataagctgctctttagggcagatggaacaatttagctgcttctcaaaacttcagtcacctgtgggggttcatgaggattcctgcatgacaagtgtgaaagtctgcacggagtgaaacatacagccccccagccctgcctctcacccactcctgggaatgagatggcgtgcttcc

SEQ ID NO: 1703 - DNA, 4445 bp, Homo sapiens
cctgcctatgtgggttgcagagccaggcagagcatttgacatttccggttggagggccatggcagccagtattttatttaaaacactcagagtttacagtcaaaaacccgtgagtctgaacaaattctttaactggcaattccctgcaaagggctctgcagtttgcactatttcaatcatgtgttcaatcaaaagggtattggagacgtaactgtacattatcactattgacatttcccagcctactccactttggttaaaaagaaagtgtccaaagatgccacttaataactttgggtatcatgaaaatgtcactttggcaagcagaaaagtggatttacacacccaccaaaggtgacctgcttagaaagagacagcagggattgtttcctggcctccaaaagagacagtgcacccaatgtccctgcaagttaccattgctccaggggatggagggagggagaggaagaacaaagggcagtggcagcccaggtgctactcagcccactggagcaggctcgggtggacagaaaggcttctagggcttcagcaacaaagctggggtgggggtaggggttgggcgaagaaaggtgatatggtttggctctgtgtccccactcaaatctcatctcgaatggtaatccccacatgtcgagggagggacctgttggaaggtgattgcataatgggggcagtttcccccttgctgttctcatgatagtgagttctcaagagatctgatgggtttataagtgtttggcagctcctcgtttgttctctctctctcctgccatcctgccatcatgccatcatgtaagacgtgccttgattccccttcatcttctgccatgattgtaagtttcctgaggcctccccagccatgcagaactgtgagtcaattaaacctcttttctttataaattaccctgtctctggtagtatgtttatagtagcgtgagaatggtctaatacacagggaaaaaggaccgactggtgcaaagctgataaaatgactgcatccggttctggagtcccagatgggggtaacacacacatagaaagacgcaggaaggtgggtcccagccaagagacccgtcccttggtcaaggtgatggggggcagcaagtgatcctgtggcccggtgaaagcaaggtcaaggttttggaaggaccgtcaagtgttagcagagctacagctggacagagaaggaagaagaggggccattttcccagaggagaaggctgtgaagagccagccaggcaaagtggcagggctcagttaaaaaccggtagaatggcaggctgaggcatggctgcaaagactgggttatccccttctccacttcctgggtttccatctcagcaacacgcaccaacctccacaatctaggtggcaacctcaaatctttctgtaacctcacttcccacagtgctttgcacctaacccaggggcagacaaatattttctgtaaaggaccagacagtaaacattttaggctttgcaggctctgtttattggaacattcaccctactcaactctaccgttgtagcgtgaatgttccgagaaaacttacaacactaggcagtgggccacatttgatgcatagaaaactgcttgccaacccctgatgtaacagattgccaaggcctgtcgatgttaccttctaaagatctcctgaacctgcccacttttctccagcgcccacaccctcgccacactagtccagccacaatcttctgttgcctagatgaccccagcagctccctccccgcctgcctcctccattctgctttcacttttgtctcctctacccagcagccagagtgagcatataaaatgcagttctgatcctgtcacctctctgcttaaaactcttcagaggttcaccatcgcttccagaaaaagatcaatactcctgacgtggcaacctgtcgagactcaggaccgctaggaaatcagctcttgtttacccctctatccattacactacgatccagctgggtttaggcatcacttcctctgagcaatcctccctgatgtcatgaggcagtgctgagtgccttctctggaccctctgtttacttgcctgttaaatcctgaacatctggaagggagtcgtgttcagcaacatatctacgccttgcagcacggtgcctggcctgcagctggtgttccgtaaacagctgctgactgacgggatgcatcgccaattctagatttgagtcaattctagagaccaccatggtggagagtgcatatgcaggcacgccagttaactgatctggctgagcccagccctccagccatccctgccaaggtgtcaatgtgagtgaaaccatcttgaactctgcatattaacttattctccagctgaatatcaccaagagacctgtcttctgatgctacatggagtggaacaatctcccagctgagctctgtccacattcctgaccacaaaatcatgagatattaaataaaatggctgttgttttaagcatcaaccagtcttctcaatgctgccacaatcctcacaatggcccataaatctctacgtgatctcccactattctctttgatctcatctttggccttcccatggctgaacctgctccagccccactggcctccctgttcctccctgaacataccaaacatggtcctcccacctcacggcatttgcacttcctttcccctctgtgaggataatcctcccccagatgtcagcacggcatggtccctggcttcatgcaggcctttgcatacatttcagtcaatcagagaggtcttctctgatatcttacctaaaacaggagtccttttcttccacctcagccctctggagagccagggaacacctctctctccttatcatgctttatttttcttcataccactttcacaatattaatatttatatgtttattgtctatttagacctcctctcctccccacaaataaatgcacattctttagtacgaattctccgcaaacagaaacgttgtctgcttttatcattgctgtattcccaggacctaaaacagtgtcctgggtgtaggactgatcaataaatatttgtaaatgaatgaatgaattaattagcacacgttcttggatagaaatctctctattcatttctaattattcctcaaaataagttcctatgagttaagttgtggaggtgtaggaataacacatttcaaaatcttttagcacatattggctaaaattccctacagacaggctgcactggtgcttacccatcctgctagggatgtgtaagagtgctaatttccttgcatcatcaccaatataggataaagtcactcaaaaatatttgctacgtggatacatggaaaaaaatggttaccctttattttaacttaactttcttgatcctgtgtgaactgaactccttgttccacgtgcttattggccactacaaagtaagttccttgacagcaggggtttagatttgctcactgctatcccagcatcccagatagagtctaggatataagagatacatgataaatatttgtagaaagaatgaattaatatagatgttttcttttgttattgaaaggctattgactcatgtgtcctctgagaagtctgtctcttttttcttactgacttgaaataactccatgcatatagaatattttactgtcatctaggttgaatttttaatgtgtcatttgcactctattttgtatatgctattttttgacattcagaaattctagcattttatgtagttacatctatcattttattttagttcctctatttggtaccatgtttagctacagtcataatagttaacactgtatagcacttcccacatgccaggcacttttctgaggattttacatacattgtttattaaattcctacagcaatcctataaggtagacactatcattatctaatcatataaagaaactgaggcaatgagctatgaaatcaatcatctcctgtacaagattttatataaatttacctgtagattgctttatgatttcagtttttatatttgtgattattatgtaataatagaaatctattgggttactccatggagaagtgagggtctaattattttttcccaattaattgtcaagtgctccaacacagtttattgtaacaatatgtaacatgtctgtaacatattgacatatatatatgtatgaatagacatatgtatacatacatacaaacatatgtacatgaacacaatcacacactatatagcatttgctggtattcttactcagctcacttgtactgtcggtcctttttagttgtttagtaatttttgtggtgtgttcagtgaatcaaatttataaaatagaaatataaagaagaaacataaaaggattaccagcgattccctacaaatcctgattaaaggcacgttcaatgttgttctcatgaaatatgc

SEQ ID NO: 1704 - DNA, 2301 bp, Homo sapiens
ggcttaggaggaatcctgggctgccggcattccttggcccggtggtcagatttctggcacttgtagcaagctcttgggggaggcaggcctggaggaacgcctggccactgtggtttaggtgtttggaagaagtccttgtgtgctggagatgtggttgaggtttctctcacagtggaggtaaggaattgcaactcagaaatatgttgctacttggctgcctctattctgttattgtacaccttgaaggtgaggttagttaagtcctgttgtggggtttgagggctggaatttaatttttctagctttatttaatgttgggtgcagattgggtaataaaataaaatgtatattgagaataagacggccttttgacctttcagggtctagggctgtaaagcgtctcagggttgctgccaaaggggccgtgaactgggctgggtttttcatatttgatgaaagagtctaaacgctaactgatttgggagaggttggataaagaaaaaggagcatcaaccttgactatgcctttggctgcagccactttttaagaggacattgctgggcaggtgcaggaagaaaactgtaagccggaccgggtgtgaggaggggaggtgataaaaggattatagggtggaggagcggaggctgaggaagagttgggacctagcttgacctggtgatgaggggagaggtcagatgggtctgtagaaaaggaagattagaaagactcagcaacacttggggttgggactgaggggacaggcgagagggaaagaaggaggatttgggacaaatcgcattggggacagagactagggagggaccgaggtgtcaaagaatgcctggacatcaggcacctcagactgtttgcctattttacgataagaattatttagatattgtaggatgtagaaattgaaagtgccattttctggctatttggaaccactgtcaaatttgtattggggtcaagcggcattgcggaagaaaataaggcatttaggttttaggtcaggtgtgaattgaagaggttttaggtttttaagaacacaggctaagggagaagaagggggaatggagggcagaagcttgcccatagtgaaggaggcaagcccagagaaaagagagtagagacacggagagaaggggttggggggttcttgccctccagaaaagtgcagaaggggtagagacacgaagagaaggggtcaggggattcttgccctccagaaaagtagagaaggggtagagatacagagagaaggggtcagacacaattggcagggaggcaccaaatttcacttgcgtccgtgtgaagagaccaccaaacaggctttgtgtgagcaataaagctttttaatcacctgggtgcaggcgggctgagtccgaaaagagagtcagcgaagggagatagggatggagctgttttatagggtttgggtaagtaaaggaaaattacagttaaagggggatgttctcaggcgggcagggttgggggtcacaaggtactcagtcggggaggttttgagccaggatgagtcaggaaaaggaatttcacaaggtaatgtcatcagttaaggcaggaactggccatctggatgtgtacatgcagttcacaggggatatgatggctccacacagggatgagagttgctgctgcccagtccagagccacagagccaaggagggcctggcctgccccatggcccattacagaagagttcttcttgttggcagagactgggatgaaattccttaccatgaaggactgtattttttttttaacttaaatattcattgagcagcttctatatgcaaattatgaatatggagattcatatcatatattgtcactgcttcaaaaagctcacaatctcttttcttccgcacagatttctgcatcctctcagtcatgatgataaaggatttactacctcagtcatgtcaccactcttgaatatcattcccatggcatggtgcagtaggaactggttgacttttaaaactaagttataataatcttaaagcgattggaaattgagaagaatgtaatggaaaatatatttatatggcttggttagccaaaattccctcataaagcaccaacctgcaggatcccttagcaatttactgaagatgaaaaataagcagaacaactttttataggtctgtagtcactagagattaattacaaacactaggtgtattttaacctaattcttggttcctgaaaagcactgcagatgacagcaacaaaagataatacctgcttttaccacgggggaaaaaaatggataactg

SEQ ID NO: 1705 - DNA, 2301 bp, Homo sapiens; identical to SEQ ID NO: 1704

SEQ ID NO: 1706 - DNA, 3723 bp, Homo sapiens
gaactggggctgcacgtggagctcatcggacagcacgagttccgggtgggcacaggcttggtaggccctgcttttgaagtggacggccagccggcgctgtcggcccccggcagtgaggggcttagcacctgggccatcagctgtggaggatgcgccaggtcccccagcactactggcccacccgtgccacacttgaattcttgccgcgcctcagccacctccccacagggcagggctcgggaccctcagcctgccatgcccaagcccccctactggtgggctccccagtggcctaagcctccccaacgggctcagccccctgctccgcagcacccagtcccatcaacagcccaagggctaaggagtgcaggtgggtggcacgggactggtgggcagctctgcccatggccctggcacaggatccactaggcaaagccagctgggctcctgagtcaagtggggacttggggaacttttatgtctagcaaaaggattgtaaatgcaccaatcagcactctgtgtctagctcaaggtttgtaaatgcatcaatcagtgctctgtgtctagctaatgtagtggggacttggaaacttttatgtctagctaaaggattgtaaatccaccaatcagcactctgtgtctaggtcaaggtttgtaaacgcaccaatcagccctctgtaaaacgggccaatcagctttctgtaaaatgggctaatcagcaggatgtgggtggagtcaaataagggaataaaagcaggctgccccagccagcagcggcaaccagcttgggtccccttctgcactgtggaagctttgttttttaattctttgcaataaatctcgctgctgctcactctttgtgtccatgctgcctttgtgatctgtaacaccacgaaggtctgcagcttcactcctgcagccagcaagaccacaaacccaccaggaggaatgaacaactccaggcatgccaccattatgaactgtaacactcactgcaaaggtctgcagcttcactcctgaagtcagcaagaccacgaacccaccagaaggaagaaactctggacacatccgaacatcagaaggaacaaactccggacacaccatctttaagaactgtaacactcactgcgagggtctgcggcttcattgttgaagtcagcgagaccaagaacccaccaattccagacacaatagtacagaggaaacaatcagatatgcattgatctcaggtttgaagaatttacatttttaagaaacttatgactaggaattaaacccaggctgaagtgttgacagaaccaaatcataaccactagactacagggtgaaatatagcttttgtaaatattacaggaaatccaaaacaggcatttgggaatttacaaagtttaaattttttcttaggtcactgatatagtttggctctgtgtccccacctaaagctcatgttgaattgtaatccccaatgtagaggaagggacctagtgggaagtgattgtatcatgggatagatttctaccttgctattcttgtgatggtgaatgagttctcacaagatctagttgtttgaaaatgtgttgcacttccccctttactctttctctgctgttcttccatgtgaagacaatggctgcttccccttcaccttccaccattattgtaagttccctgattcctcaccagccatgcttctgtatagtctgtggaactgtgagccaattaaaactcttttctttataaattacccagtctcaggtagttcttcgtaccaatgtgagaacagactaacatagaaaattggtactgggagtaggacattgctataaagatacctgaaaacgtggaagtgatttggaactgggtaatagacagaagttgaaacagtttggagggcccagaagaatacaggaagatgaatgaaggcttggaaacttcctagagacttgttgtgtcattgtgaccaaaatgttgatagtgacatgaacaattaagtccaggctgaggaggtttcagatggaaatgaaaaacttattgggaattggagtaaagtcagtcttgctatgctttagcaaagatactggtggcattttgcccagctctagggaatctgttgaactttaaacttgagagagatgacttagggtatttggtgaaagaaatttctaagcagcaaagaattcaagatttgacctggctgcttctaaaagcctatgtttatatgaatgaacaaagagatgatctgagactggaacttatatttaaaagggacacaaagcataaaattttgaaaaatttgcagtgtggccctgtggtagggaagaaaaacctatttttagggaaggaattcaagcaggcttcagaaatttgcataactacaaagaagggaggtactaatagccaagaccatgagaaacaggccctgaagatatttcagggaccatcacaggagccctcccaggcccaggtacttggaatgctgcttcagagagtgaaaaccacaagccttggtggcttccacatagtgttaagcctgcaggtgaacagagtgcaagagttgaggcttgtgatcctctgcctagatttcagaaaatgatgtatggaaaagcctgggtgtccaagcagaagtcttctccagaagcagagcccttatgaagaacctctactagggcagtgaagagggaaaatgtggggttggagcccacacacagagtccccactgtggcactgccaagtggagctgtgagaagagggccattatcctccagacctcagaatggtagatccaccaagagcttccactgtgtgcctggaaaagccacagacactcaatgttagctcatgaaagcagccacgggagctataccttgcagagccttgggagcctgccccttgtatcagcatggcctggatatgagacgtgaagccaaagaagatgattttgaatcattaagatttaatgactttgtgctgggttttgaacttacttgggacctaatagctcctttgctttggccaatttctcccttttgaaaagggagtatttactcattgcctgtacaccatatttacccaaatgcctgtatccccattgtatcttgaaagtaactaacctgtttttttattttacaggcctataggcaaaagagactttgagactttggacttggactttgagtcaatgctgaaatgagtaaatactttgggctactgttgggaagccatgattgtgttttgaaatgtgagaagaacatgagattttgtagggaccaggagtagaataaaatcatttggctctgtgtccccactcaaatctcatgctgagttgtaatccccaggaactagggacaagccatgttcaggatggcagcttcatcttctgtctctgccagccacatgtatagtaagaagcagacaagatggcaccaatcagctggaaagcccatttgcataagaagattagggtagggttactagccttccccacgtgctatgtaaatgtcatacctgatcaaactgatctgtgagccctacgtaaatcagacaccacctcctcaaactggactataaaacctggtgcattcgctgcccactggtcctttctatttggagacctctttctgtatggacccctttctctatggtttctctttctcttctcttctgcctgttaaacctctactcttaaatccctcatgtgtgcctgtgtcctaaacttttctggca

SEQ ID NO: 1707 - DNA, 871 bp, Homo sapiens
tttcgtatttttcagccaaatggatggacataattttgtgattcagactgtgtagcagtgttaccagtttttgttcaattaatccaggaagactgaataacataaatccgcaaatcacatttgagaaacatctttccaagtctatatattaaaaaaaaaaagaggcaatcaacctttgccagttgcattcaaatactgggtttggaaaggataaaccgactgaatagtcagaatgtgaaccactgaagggagacaagttggagaggaagctggtacattactcacgaatgaatcagacatcccctccctccgtgtttgaaaatgtcctcggcataaagcatggtacaattccaaacgaggaactatgctcaggattggatttatatgactgatcagtttcctctgctgttatcgaaagcagatatcaaatggctgtggaggaatgcaggtgattggagttggtccaaagggaagttgtgagttctgggaggcagaaggaaagcagctgccatgttctgaaggttatcagcacctgttggtgatagaaacagacacagaggtgttagcaggttcctgtttgtcctcgcacccccctccctcctgatggtgaccttgtcccaggtcttctaccaggccttctaccagatgctttgctgagaattcacagaggccgtagacctgaagaaccaacaaccttccataggctttgaggtcccactccggcagcaggacgtgctggctcccaggaatcactgtgaccactattctaaattccttatgtgttcagaatttattcagagctcaggaaggtgatactactgtaacagatgctcttcagaattctaatctactcccaaggcaaatggatacc

SEQ ID NO: 1708 - DNA, 13405 bp, Homo sapiens
gaaaaagtatatgccacaaaatatacctgattttctcacttgtggccagccctttaaatgatttgagttgtttccttgttgggcattggcaaatggcacgaaaatgtgctccaagcataatgaagcttctcataccatttttcctgctgctgcaggacaggatgttgcacccaacagtgtagaagcatcaaggatggggctgtcgaaacataccaaggaccttcaacaccaatcgatgcagatgaagggccagctataaacttctgcatgcatgcaggctgcattttgtggcatcagctatttccagcattgctaatgtactgtaggcatatacatatgtatgtatatgtagatataatatatgtgtgtatatatatatccattcccttttctttcttttggttgtcaaatagtatgaagatccaagattatgcatgaaatggtcacagcacaatgcaaaaagtaaagtgtcccctacaacccaggtggccaagggcatgttgaaatttgctctgctatagttctgcttacaccagcaattctacagtcatacatggtagacgcatgagagttctttatcattgatttgcaccatagatggattgtattgaatccatcataatagttctaccaaaggttacttattaacatgccacatatgcacaatctagcattcttgtaaatgagtctgacgtgttcatgtaaacccagggctattttgacaagcttctgaaaaattaatgattctttgccaagaaatgtttaaagcttgactgaaacgttaaattcatttttgtgttctgattttgaaagtttttaatggctgtactaatagctgaatgttcttcatcaacagtacgtgatgtattatagaacaagggtggctactcctcacagtaataacaacaaatctatgtcttaattggtcttcccttcccaagggggaacatgttcattttcatctgacactcattcttttgagattcatttggctacctttaatcttcctctgtggattatctgaaatgtggcttggctctatgtttttcatacactatcaactctattgaagcccaaatctacataaatgaaacttgaaatcaaccagtattttctagaaaatatttttaagtagaatcagaaaatgctgggtgaataaatgtcaatttttaaattttaaatattttaaatcatcatttatttttaaatagttattattgtatatcataaaatttaaatttatgaaacaaatccctttcacttaaaagtatcctgcaataaatttgcatggaatacagaatgactgtcaatttgccatacttaatttcttttcttttccttcataaatctccaacatttatgcagggtaattataaaaataagagcgcttaggatttttctttcactgaaagcattgagaataaaagcttagaaatgctacatgcaaacaatttattttgaatctgctcattaaatgattcagattataatgaatttataacaaacttatttacaagagtggtcatttgtggcatacgtaatacatttaagtattttactttctattaatcatttaggcaagaactaagaaactgtatataccaaatattttaaataaaaaccttaaaatggcctctatttttgattggtcaaaatacctgcacgattggttgaaaccaattgagaattgcttgtgtaaatatcattttagtagcttcagaaatggagctgcgacgactttggagcacttataaatggcataaaagcattctgctgctcatcatagagagaatgtgtaggccaacaagaggtatctttgaaaccccatgcttattaaagcaccctctacagccctcacgtacacacgattcccactgacctcaatgggaaatccacgtgcgtaagggctgttggattgagccctattagagttgttttttaagaaacaaagctgtaaattagcaaacctggttggctgtggctgttgcagcgaagggaacacttgtggcagatgttgttgctgcggacacagtggctggcgtagcaccgtgcaccatgggaactttcggagggaaaatcatataagcgaacatacagaagagtgtagcaatatggaaaccatggcaacatggaagagataattgggcatggtatttatcacagcaataagccatgtgacaggacatcatcaccagcgagtgacatgcaatcacagcgcaaagcaggacaacattccaaggagagaaggggaggagggatgaaagagaaaaaaaagggggaaaaaagcttgttaccatcaaatcaagaaaattgacacaaacaggcttaatatgctaagtcaaaaacaagaattttatatagtgttcatagtcagacattcaaaatctaagtcaaaatacaagtatttacttcatatatacagttatctgtttgaatgaaagtatttttttctcatttactattataaaaatatacagtatattacttttatgaaatagattttttttacacaccagaactcatagtccaatcaaaatccaccaaaggtgactaaaggaaactgttgtgtgtaaagaaaacacttatgtgagtccatgtcaattaaacagaaaatggcatttaattgacaagtgttagtaaaagggaaatggacttgcccaatagatataagttaaacttagcagtggattttgaggggctgtgaggtacaccataggtttaagataatcaagaaacaaagctggcacctaccaacacttgtagcgggtgtcatgcacaatattgagcctgcccatcatgcattgcaacaggaaggtggatttgaaaagggaaaagaattaaaacatcccatcacacgtgtaattagaaaattcatttgaacaaagaagaaaaattgttattatgggaacagtggcatgtaactgtcagcacaatcaaatcatacaatagcacagtgatcaattagaactagtctcaagtgaagaataaaagccagtttaactgtgtgctggtacactttgtttctcttaattgttgcctataaacaaaagtattttggaagtaatttaaatccacttaattcttttaaaaataatattgtaatttgttttgttttaatctgattactaaccatctggtcgttttgctatttctgactttaacttatgaatgccttaacattttctttatatcaggcacatattaacttactaaagatatttattattaaatactaaataattcaatgtacaaaactgacttaacaatataatgaaacccaaacattcattttcattccttttgctttattttcctgttcattgtagcagcaaccatataaacatgaaaggggttgtaattattcatacaggatttgtatttggagggatgccaagcaataaattatacataaaaaagtgaaatttgtgcctttccttagtttgaaattaaaatgtaggaaaagcattaagggggaatataatttcttataagtatcaaattggtttacttcacagtatctaggaaatcagagtggttttcattgctggtttagaccttcaagacttctgggagtagcaaatgttctacaaaatttcacacgcaagaaactgctaattagagttcaataaaaaccttgagtgggagagagtgaaaatacatacatcacatatggggtgttagcactgatgctgacaattgttcaaccatgataagcaaaaataaatgttgcatatatagatagtccttgttctctttgacatgtaaatattgaaaatttaacttattttaccaagtacaaggcactttcccatatgcagaactactgttctttctatgggattattttagaattctaggttttaaaatatccaaggattttatatttctatctaaatcttagcatatcctgtttaaatactagcagcatctgggacgaacatttgttagaaaaatatctgccaaatgaatctcgtcagagatggccctataaaataaagctgccattgagaaactcagctgaaacacggattacttaactggcatctctgtaacagctgcgattagtttgttatcacaattagactgtgggcagagtgatcaacgattaaactctgtaatgtatctggggacacatcctatcaagtggaataatattatattgacaagcattaagacacttgaagatctctgtcatttgctactactactgagtcaaagacttgtgaaagacaaacagaaacaagccagtaataacaaagaagttataataatttgagacagtagagcaagcaaaacttaataccggatctacatcttataaaatcattactgtcttaatggtagggtgagagaattggaaaagaaatgatgaatgaaaaagaataatgtgataattaagtaatattaaagccagtttaaatattgtacaggttatatttttcaattatttattattaggctgagacttgcctactgtatttcatcccatgcataattaagtctgcacatgctgaaaatgagttaaccttatactatctctctaaaatcctaaagctattatgatttgaattttagtttgaattatcttcctcattagcattataaccaatgcacacagttttgagagggatttgcagcaaataaacataaggcagcaatgaaaatactagccagggtgcaataactcacaaatatgaggacataatgctgtaggacccacttaccaaaaatgaaaatcacttttgaaatgaccatagtttccatctttacatgggttgatttactactaataatgtgcaaatggccaatttaaatttttcctcaattttcagcacaaagcaaaatttaagtgaatgtatttgtcaatttccaatttctcctacaaagatatttgcagagcagaatggtgtgcttctgagaaatgtgttattttaattgcatgaccttttaaatcaaaaattttaattgatatgtatgaaaatgtaggaaaaactaggatgataatttacaaataagatgtatgcatacttaaaattacttggagtagaagggaagtaagtagaagagagaaaaagaattgtaatgaagatttagttggaagttagaatttcgatgtaataattcagtcctatttaggttgattataagaagtattaggctgattaagattttctaaaaatagtgtatatcattttaagactaaaagttaacaatcagttggattattctcaaaattggtatccaaacaagcagtaccttctttatttttattaattataagtaatttattaatatacataattataaatgattatatgtattaatgatactaaatgtgacaaatctttttctcttctttgcataaacacaaccctgcctacccctgcccttagacctacaccaccacctaagagtttcctggcctttcgttgccttattcttggtagagttgtaatacaagccaaaatagaagttgtttaaagtaaatgtattttcagaactgttaaaactcataagccaacactgattgagggagatatgctagagagggagacaagaggtgtgattctgaagatggtaggtaagcaaaaatggtgatggagggcagagaaaaaaattcctcaagattgaagtggcaggcagtgtgcagctccacaggtagctgggtaggtagcctgttctttcacaatagccctgcagacatcaggtcctcaagggcatgggagcctggagggcatagacaaggaagcctatatccaaggcaagcacagaacccctggagtacctgtcttaagagctcttgcaagcatagacaatgatcacatcagcagtgagcagcggtgactgaagcatgaagaatgcatagcctgtctgagaatactagactgtacaggacctcacattgaggtaaggtcaggaaagagagggagctggggcatgtagtcctggattcccagtaatgcctgttatttctctcaacccagggagatagagatcacagttcagagctagacttaatttcaacgaaaaaagaaatggtgtaaaggaaagtggtatttcttacacgccgtaatttcatgagtgaaaactcatatatataacataaatagatcctaaattatgcataatatctacaaataatcaatctggtcctgaaaggggaaggttaaaacaagtatatatcgaaatttgaaaagacaaaacttcaatatgaatttaacctaatacttatatttatctttaaatgaggtggaaggtgtgaaacaccatggagttaggtgttcagtaagggctacttccactctcccaaatcatttttaaggtcttcgtgtaatagatattgagagactaaccaagtcagcctgacttgagttcaagttgtacttaaatctaaaccttacaaaagccatttaacttgggacaaatcactgtaccttactaggctccaaattactcattcgtaaaatgaaaatattaatgccaaccttctgggcgttgtgaaaaaaaatgagataatgtaggcaaagcactcagtgcagcagggaacaagagcaaccattcaataaaacgtagctcttttgaacaaaatatctgaaacaacctggcctaaggcaatagggaattgtagcgtttggaactgaagggtacagtatgtgtcctatctaaaggatttacatttagttttcatttaaacactcttaaacaaaaatatttctagatactagattttacccttgagctatcagtttgcaatccttcacataaatactggtataccatgtggcatacaatcaatgtttattgactgaataaatggaaagatgggtggatagataaatggggggatgaatagatggatggaaaactgaaggacagaggaagggaggaaggaaaaaaggataaagagaggaaaggaaaggggagaacagaatgataggaggatggatggatgtatggttgaatgatgcttagatgggtaatgtccatattaaatccaattctgttcttaaaagttaaagtatgtagtaatttttcttagctagctggctggcttgtcactgaaccctgatcttttgccagcaaactactctatacgcagccacctgctctaagaatttagctaaccatgcttcactgtaatttgaataaaatatatctacacatctgaagttatcattgaaacaacagactacagaccactaaaattctgagctgcaaaaaataaaagaattccattttcttcccagttccaataaagccttcaaaagtgtaccttccaaattattaaattgtgttcagatcggattccttgatcatctaattcttctgtattatttgtctgcagaacaaccaaactttggaaaatgaaattccttttctcccaggtattagacatgagattacatgtgaatgtgtggtaagatgaatttcctttagttctcaaagggtgtttttaaaaaactgaattgccaaaatttaaatattgagaaatttcacatataaacatacaaatgtctagagtatctgggaaaaaatcataagaccataagacctagcaacactgtatgtcagggctactgtgttaggttgtgcgggtttcttacaaccaaccctatgaggcatatacacaatcaattgtggtttacacagactatgatataaatggagccacaaagggtttgcagtggacagcaagtacaacctgccaggcagacaatcctctgaggcaacaaaaggcaaagtctgaacattgactatactctttagactgagcctgtgctcccctgtgcctcccagaccccacagctcccaatttattcttgcttcacttgtgtttcctgcctggcccctgaggcttttgcatatacattccctgcattagacttctttcctttctgactgtctgacaaagtgatggggcagaaataatgaagagctatccattttaaccttttcatgccacagcgtcaatttttgtgaatgcaggtatatattatataatgaaaatattttaaaataatcatggagtcactacctacttctgattatgtgattaataaaggtcaacttgctgtttcaggcccttataactgagttgcaaataaatgttattttatgttactaatgcaataatttcacactatattgattatatttgagaaatatgtgtgtgtgtgtgtatatatatttgttgttgttgttttgtgtggttttttttttttttttttgagatggagtctcactcctttgcccaagctggagtgcagtgatgtgatcttggctcactgctccgcctcccaggttcaagggattctcctgcctcaacctcccaagtagctgggattacaggcatgcatcaccacatccggctaatttttggatttttagtagagatggggtttcgccatgttggccacgctggcctcaaactcctgacctcaagtgagccacctgcctcggcctcccaaagtgctaggattacaggcatgagtcactgcgcctggccaatatttgagaaatattgatcaagaatagaatatctctgatgcaaaatgcatcataataaatgcaaatatatcttaaaattttcagcatatttcaattaatgcagattttatttaaattagcaatgcttaacctagcacagagagacaagtttgattctgatttatgaatgagtttattattttccctaatttgaactttatctagcatctttggctctatccacagacaaaaagctattctagggagacactagtgtcacaagtaagggtcatcataccatgtaattggttatacttatttagaaaaaaaactatagtcatttgagagttgttgaaaaaactaatgtgaaacctatttgataaaacagattttttcagctttctttaaatagcacagatttgttttttagactttagtagagaaactatcatattttttaagactagtcaagtgcagcagtgagaagacagcaatgagtagaacgaggagttcaatctgtaactgactgtgaacaatctattgagataactcactacctctggtctagctgaaacggtcatttatcatggtaatgttttagccaataaaataaactgacaaaaataagttttaatttcttcaaagagattatgatagttacatataatcccttgaaactttgctcatctgactatagaaaaactgatggattgtttgttgggggcagcgaaaatctagggacacagcaacttgcacaagagcaaaaagattaatttctgaaaaactatgcatgttgagaagaaagttataatattacaaaacataagagaaatgtgaggctgcaggtcaaaatgatttagtttttgttccaatatgggcaaactgcaatttgaaagatactatttcacaagtacaaatatcattttatccacgtgtctggggcactggctatttcagctagtggaatattgtagttaattgttacttcgtatttattttacatatggatgactgattttcaaatatgtactgtataaaacttatggttagtattaaaagctcatataatttattttgtgaatcaaaaataaattcacattctcttatagcattatgaacctaatacactgtaaatactgccagtatagtctaatataaaattgggagctggatttttgacatatatatctactcattaatttaattaataaaataattttattaagtaagtctctaaaaccatggtattctgaaaataagggtgaagcaataaagaggaaagtgagatttgagtttctggttagtaaaattccagataataatgagcttatatgtattttctgaagtaagttcagagtgaataaaaagagtaaatttccaggtaattaaatgagtagctagtctgtgttttaaactttgcaatctgtgtgaataattctagattatgtatacattaccaaattgaaaataagctgaaaccacaaatgtagaactccataataaattaaacattgctgagcacttagggttatttcaatattagcttaggaacagtcataattttaaacagtgtactgattgatgccaataagagccctttttaagagctctagaacgcatagttgttttcattcttgaccttgaaaacaaaaaggctgaaaaataaaaatcaaaactgaaagtgctgttttatataatttaaattaactctatggaataatgaaggcaaaggggtcttacagcaagaaagtatcataaaatagcttgacagacatatataagtgttgaggaaagagaaaaaaagagaactatatttcatttccaaattacacaaacacaaataaatatataaaataccactgatctttaatccacatttcattaagctacaatccttagtttttaaggaaaaccacatgagatacctcagataagtttccatcattgaccaccttacctgacacctcatctataattacaaacaaacttggggtgtggtttatctgctctaacagtaggactctctgtagatcatcagattcatttattaagaaaccccaccccttacctggtgggagaaatgctgtatgctgttgtaactgcatgttggctagagcctgttggtattggaaaataccagtgttaaagactgcggtggcaccgttggttttttcaagagcaggcctctttggtaatgggggaagtacagcttgaggaattccctgtttagtgaatgagtataaaaaacaaataccagtaaaaagagaaaaagaaaaaagaaaaatcagtcgaaggctaaaattgttaggaagcatgagcaagcaagcagcagagcacttaactacccgagggaaaaaatccaatgaacaaaaaattaaggaggaaaaaaaaaaaaaaagcaagataaaagctttaaaggaagcattatttttgtccaaaacaaaatctcactagtacaagagcacatgttataatgtgttaaagtgctttatgtcccataatgcttcaggctttctgtgagaagccattgatttgggaaaagaagaaaagccgcactgcgagctccatgaggattgacaagtataagcaatgttaatagttaattgtacagagtgactgaaacagataaaataaaaactaacccactctgctcctccccccagatctacctagacatgcaaatgtcccagagcatgcaagtttttttccttaaatactgaactataaatattaaaatgtaaataattctaccactaaagccatgctaaccaaacaggtacataaatatacagtcaaaaatacactctttatgtcctccgactatttcttcagaacattctacaatgtagttaaactgaatgtgggctgctgggctttcagaatcttttattgtatgatatccatctatgtacttagattatagtctttctactaattttgtcaggaaaccacactcagttttttcattgtactttacaactctataacagaaaaaaggatatatattttaaagttgatttaaaaaaaaaacttgtatctacaataaagctacatgccaagctaaaaggtgaaaggtcatagtaccaggtcaaaggttgcctcgaggggtcgcttcagtgatttgacagccgactgagtcttaattagcaggcagcgagcacatgatggcaatgggccagtggggttcaagcgcattaacataaacagcaagcagaggtgcatcatgggggcagcagtgcatttttgggtaggtgagaaaaaacaaataaaaaaacaaatcatcggaatgccatatacaacgaataacaagactaagcatgcacaataaaggcactactgagttgttattgggaggataactcctctttgtagttaattacaaacaagatactctaacagaaaaaaaaaagagtgaaaggaagagaggaggagagagtctgccttctgtatttttgctcaagtatccataaacacagaaaagatctctctcgtgattatttcactgtgttatgaaatactacacagtgacttttaaaatgagtatttcattgatttaagtcatatatttatgtaaaaaaatgacaacattaaaacaggtaagcaaagaacaaagaatgggctcattaaaatcagctactagatcacattaaaatttaccttgagaatatagtttagtagctattcttaatgatccaatttctaactccttgagtactgctgtctctctcctgtctatataatggcatagtcaagcttctctagtgttactattatgtttatgccacaatattatttcagacaatctagatagtatactactcaaaatcctgtagctaattctaagaacaattttgttgaacaattctcctaaatagttccagatcatgttattgttaaaagcaagatatatgtaaagaagagccttgatgtgcaaaagaacacaccaaaggaaaacaatggctgattagatggcacacagaaataagaagactgaaaatggcaatatcgttaagttgaaaaggagacaggtggttctttacaaagcagagatttcagaaaccctacatccacaataagacagattaagagttaggccaagagtaggagcaatctgaaccatttgaggagttaccctcacttctgtgaaagtaacttctttatatattgtctgggatacctgaacaaacatatcttcagcaatttttttaaaaaggttactaaatgaatagcttgtagtcagatatagttgctcactttgcttttctgactgctaacaaggagagagctgatatctctactcaccatggcagctgcggtggctgcagcctgtgcagctgcagcctggttgacctggtattgggcagccttgatcttggcttgcaaatgtgcagggggatgaaagtatttgcacttttcccgagagcatctccctttgatgtaatccatacacacagtgactgtgttgtcattggtgtcaatcattgtgctgtcagcaggatgagcaaaccgacaatcattttctcctcggttgcaattgccacgttggtactctcgacatacctatgaggtcattaagtacatgaggtttagtcaacatgaagaagaagaagctttctgaagattttaacttaaagtgcaagactggtgacagaaggctatagatgaaaagggaaaatgattttcaaacaaggcaacaagtaacttcagcatttcctagtttagttacaaattataactccatttcagtataaatgtccataagaaaatgcatgtataatgttaattatggtaaaaatacaatctgaaatggtgttgataaacttattaattgcaaagggaaaaataataacttcacagtaaagaaacatggaaaacatcactttaaccaagtgatcaaaattaatatcaccaataatga

SEQ ID NO: 1709 - DNA, 13405 bp, Homo sapiens; identical to SEQ ID NO: 1708

SEQ ID NO: 1710 - DNA, 11599 bp, Homo sapiens
gtgagattccagtgtttcctccagaaaggcacattattcctccaccatggtcttctttttcctgtgtaccttgaccctgtaggagatgagacttctaaagtgattcctttccctcttttctcctcatcaccccttcccactctctaaggttttcaggtgctggttccatggctcttcctgagccgaaaataaggaaactccatagaccttgtccactggaactcgttcccatctaccctccactctatccagccccatgaggacaaggaacatgattggttttgctcactgccgtatcttccgtacctagtacgtaacaggacatcaataaatattagttgaatggaagattaaatcaacaaaatgggtgatggatctctgcagtaagtggaagagttcttcatggcccccaaggttatatccatctagaacttcagcacgtaatttcatctggaaatagtgcctttgcggatataagttaggtaaaactgaagatgagatcatactggattaggatgggatctaaatccaatgaaaatgtcttcataaaaaacaggaaagaacccatagaaacacaaggaagaaggtcatgtgaagatggaggcagagattggagggatgcagccaccggcccaggaatgccagcagccacccagaagctggaaggaaatgagggattctctcctagaacctttagagagaacatggtcctgtgaacagcttgattttggacttgcccatagcttgtatactcttactttggatacaattttatccaaacttggctaaacagtttctcagcctatggaaaatttaaaatggagaagattcaactcgattcttacagattcaaagcaagaaaatgatgggaacataggaggagaccaagaaagcctataaaaagcaaaaatatgaagtgaacattgtggtagctttaagatgtttagtgtagctgcaggcaccctatacacatgaaaacccccaaggggaatccccatatcacagtgtagtgtgatatttgacattcgtgatcatctagagatgtacagaaaaggtgaatctgtgttctgtatattctgcctaaggcaaagaaatgtttagctctctttaaaatagttccataattttttctaaaaagctttgcttgaaaactgtaagcttcccatatctggagcatttcactttaaatatttggataaatatgttatcttcttacttggacatttcatgtgtttagggattgtcttctaaattcttcctaattcatatagctgctaacacttcccgcagagctaaaccattacagatatgaaataaagacctattgatttgacttacttttacttgtaaaaccttctgagtgttataacctcatttaatctttcagcatttacagtttcaagagtttgtgtcacaattagaagaattcagctgcacctccaagtgacagcagttgctctggttggtgggtgatctcaggaggcttgagaattgctttgtctgtgagggaagtaagacattttcagagccccactttagaaggtgtgaactggctagataatgaaccccagggctaacgctgctatagcagtgggaaggaggtgatgggttttcagtttggacctcaaacatcaataccctcctggtacggggaggaacagagtccctcctttacttctccattagaaagaatgagatggcaagacaatgaaacaggcaaagtgaacagagatgcaagacaaaattcaggtgagagagccagagcatcactcagccattcctgacatgtaaaacaggcaactagaaatttgcagaaaggaagcgaagtctccataaagatgtttttaaagtgagcttgaagtatttggagacaattcagtgttacataaaatctgcaaatctctggataaagaagcagagatcccagcatgggacaaatggagcctcaaaagtgggaagaagacagagaagaccagggcagaatgcatctcttcctttctcttggctttcctggataaggactgcatcattcctgtggaaggacaggccatcagctccgaaacactctgtaggttacctttggtgctattccagttgtgcctcattctgtgacctagaccgaagaggaagcctctactctgagctcctggaagagagacaaagagcaacagtgggagcgtgcaatggcatatagaacttctactatactggggtatttgtcacttctgttcacatttcattggccaaattaagtcacatggctaagcctgatgtcaatgaggcatggaattgtaatctcattgaaaaggcagctcataattcagaactaagtacaatctaccttatttttagagtagggcctaactttatattttcccaaatacttagctaattgcttcaatactatttgttaataacctgattttttacactactctgtgataccacttttatcccatatcacattctaataggtccttcttcctgttcctaaactttgtgttgggtttcactgagcaccaggacagttagtgctttttaaggcagatagggtaaggcccactttatttcccttcatttaaaaagagtcttggggccgggcacggtggctcatgcctgtaatcccagtactttgggaggccaaggcgggtgaatcacttgaggtcaggagtttgagaccagcctggacaacatggtgaaaccccgtctctactaaaaattagctgggcatgttgttgcccggctgaggcacgggaatcacttgagcctgagaggtgtaggttgcattgagctgagatcgtgccacttgcactccagcctgggtgacaaagtgagactctgtctctaaataaataaatagtcttgggtattctctatttactattctagttgaatttttgaaaacctgtattcattccaaaaaaagaagccctattgagatataggttggaattgcactatataagtggattaattcggaaaagaactgatttgtttgcaatattgtcgtttcatccatgaatatagtatgccactttatttgtccatgtctattttttatttttcttagagttttgtagatttttagaagcgtgtcttaagcttcagatttatttttttcaagaaaaaataagtttttgatacttttgcaaaattagtttcccctgtgatattttataagtagttgtaactggttatttcattcataattttttttacaagagtaagaaagattttagaaggagggggaatcttactgatatttatgaacttttcctctaaccctagtgcagtaggattgttcaaccaagaatacagttgaatttatcaaaggctttttttttgtccttaaagctcttcacaggattttttgcttgtttctattattaaattatactgatgattttataatattgaactatccttgcatgtctaaaaataatgctgactcgacagtgatattctttgaatatgcagttgtattaacttgctataattatttggatgactttttgtatctatatttaaattttaatttgtcttcacatttcctttagggatatttttgtcagctttttctgtggtatcagagttatactgattttattaaattagagaatcttctttttaaaataacattttcgaagagtttggaagatataggaattaattgctttcttaaaagtattcaattgatcctaaaccatgttggggagaacttgttttctttttacttcttacatggccatttggatttttgagtttttgagtcaaattattaataaatgatattgaagcaattagttaaatgaactcttgagtcagttttagctatttataatttccagcaaaattttcccgttagtcataatttaaaaattgattgacatagcctctaaagtatcttgtaccatttaaaatatttcagaagttgtaaattaaaaacaatattgaaatttcactttacaagggttttaaggtacgaacaaaggcagagcaaaggtgtcaactccatctgctaccaacagatggcgatacagtcactttatgttactttagatttaagaacaaatggactgaaaaccttccagaacctgatttctttagaccttttaccattcctaacattatgtgattgccttgcttctctcttccctccctccttccttcctccttctcttcctccctttcttcctccttttcgtcctccctctttttctctttccctgtcttcctttctcttgtgtagacttggaatgcattagtcttttcaaaaaattagagattggatttgttttttgatttatatttgttaattcctgatttttaaatttcatatccttttccagctttttaaaaagttaagtgcttagtttattttccatattatttaataatgaaagcatttaactccgtaaataactcactgattaacaccttgactgtattccattggttttgatataatctgttttcactgtaattaatgtctaaataaggtcattgcaattttgttatcttcttatacataattacgtaggacagaatttgttttatattccatgaagggaggtctttaatatctaactccctatagttatgaagttgtataaggtagcaaagttgttgtaacatgaaaggtttactgatgaattaattacttataaaattgctcttatcttcaatgtttcttgaccagtaagaccagggcttatacctgttaatctggtcatatttctttgtctagtaaccgctagttgatttatgcatatttttctgacaaaacatagcagacacattagatttgattaaaaagagatcctgtagaattttatgaagttgatgaaagtgatgttggagaactgctggaatcactcaaatttctttgataaattaggatctggcagaatgcagctaaaagagaaaaatctacaaagatgatgacatggtagcttcagagaagaaatatctaaatagaaaatcattaaaaggacctttgggaaactgataaaggctttgatatttcttaagaaaaattactcttgattattcaaatacgaaggatggctgtatcctgagctcctaaattttgtcagaacaaatatgccaaaaatcaatgtttaatttttcccagcactttgggaggccgaggtgggcagattacttgaggtcaagagtttaagaccagcctggccaatatggtgaaaccccatctctactaaaaacacacacacacacacacacacaaaagttagccaggcttggtggtaagcacctgtaatcccagctactcaggaggctgaggcaggagaattggcttgaacccaagaggcggaggttgcagtgagccgaggtcacgccactgcgctccagcctaggtgacaagagtgagacttggtctcaaaaaataaataaataaataaaatgtttgttctttaattttattatatatgcaataaaatagactccctgtgataattttttgtttgaattttcaaggtaaagttccactccaacttttttttcacattataaaattttgaacttccttataaggggatttgctttgaaaggattattctcagaatctattatcctcaggcaatgcctgtaatttatttatagtattattgcactttattatgtgttctgtgtcagtggtccacaacctttttggcaccagggaccagtttcatggaagacagttttttcatggacgggtgggaggaagggatggtgttgggatgattcaagagcattacatttattgtgtactttatttctgttattacattgtaatatataatgaagtaattatacaactcgccataatatagaatcagtgggaaccctgaggttgttttcctgcaactagacagtcccatttgctggtgttgggagacagtgacagatcatcaggcattagattctcataaggagcacgcaacctagatccctcaaatgtgcagtttacaataggattcgccactatgttgcccaggctggtctcaaactgttggcctcaagtgatcctcccaccttggcctcccaaaatgttgggattgtaggcatgaccactgcacccagcccaaaattctttgtagtttttgtttttaaaattaaactttcaaacttttaatattctagattatatatatatatatatatatatatatatatatatatatatagtctaattgacctgcctaaaacagaaatggtatgtttgagtttttccaaattacagtttttgtcagtttttctttgtattgctaacattaaaaaatgtatttaaatggaatattctgaggaatagaacaacccaaaaaagttatttatcttactttaacttttagtagcagttagcattagatgttttacatgattttttttgaaaagctgtgagcattgataagtatttgctgaatagtgcgtcgtatccttattttgaattatgactcttattcttgtaaaatgtccccctttgttccatttagtgtttttgtctagattttttttaatctaatattcattttacatttgtaccatgtctcttacatttcttgttttttaaacatgttataatcacttttgtatttgtattttgtgaaaaacatgttgtttctgacccatcataatttgggggcctaatttaagaatctttgcctctctctgggcatttatcccattcaccttggtccttatgatagatattgcccctgctatcttaactcatgttttttgttaacttcttgctgtctcctttattttctaccttaagctgtgtagagtataatgacttaactgttatatttgtcggtgttttagaggctaatatagcacgtaagttctagtaatgaattatctttggtgttttaaatttgtttctaagatcaggagcaaagcagttatgtttgggctcccaatgctctgtcttctatgtgagagaaagtatttagtataattcacttcctccttcttcacagatcttggtaccaaattattattacatcgttactttcccctttccattttaaaactagacttaggccaggcacagtggcgggcacctgtaatccctgctactcgggaggctgaggcaggagaattgcttgaacctggaaggtggagattgcagtgagctgagatcgtgccactgcactccagcctagatgacagagtgagactgtctcatgctaacaaacaaacagaaaactagatttaaaatgactgaagtatttttaccagtttcagtatttattgccgacccattcctaagatttaaattttgattagatcatacaatcaggcaggttctttttcaagaagggcacatgaaaagtatattttctgagttcttgttaatatgagaatgttattgtgttgtctatacatgtaaatgactactttctttgtataaaatggttacaggtttaaactgttaaaactttagctcaccactttctttatgatatcttcagattttgcttttgttgtattttttctctttagtcataatttttatcttatctttgttctctaatctccattttccataattatcataccttccttcttcatcttaaaatctttgtctttttatgctaaattctgaggggcaaggggaaagggagtattctgaagtttactgtccacgtcatgtactgtcaattgtctacaatgttggtttttttgtttttttttttttgagacagggtctcactctgtctcccaagccagagtgcagtggcacaatttcagctcactgcaacctctgtctcccagattaaagtgattcttctgcctcagcctcctgagtagctggggttacaggtatgcaccaccatgcctggctagtttttttgtttttagtagagacggggtttcaccatgtttgccaggctggtcttgaatttctggcctcaagcaatctgcctgtcttggcctcccaaagtgctgggattacaggtgtaaaccaccacgcccagccttacaatgttgattttaattttactacagcatttaaagtttccttgaaatcttttctgtcattcacattaaaaaaaaaatctttctgttgcctattcatctcaatcttatgactctctagtattagaaaagcttattattttttgttcttttttgagaatctcagctaggttttgaaatttttcttctagattttggagtagcttatctttagaggtaggctgttcctgactttcttattatttagtaggtgtgtcttttctcagattaaattccttattttcccacttaccttgtgctaaagaatattgaaattacagctttgtagataattatacattcagaaaagtgtaataattcactcttaagagaaaaatattcttcttcttaatatgtatttttagctatactgttaatttagatcaataaaataaacttttttccagagataacttggcctttaatggtcttccacctattctgaagagtcaatttatgaaaatgcttttattgtttttttgttgttgtttaagaaccttggtttaaaaacaatgttatttcttagaatattttttgatttacagaacatttgcaaaggtaatagagagagatccatatattgctcagttttccctattattaatacaatacattaatagggcacatttgtcataattggtgaccaacattgatacattatcattaactaaagtctgtattttcttcagattaccttaatttttatcaatattcttttttctgtcccaggatcccatccaggatcccacattacatttgattgacatgtctccttatattcctcttagttgtgacagtttctccgacttcccttgtttttgatacccttgacagttccgaggagtactggttgtatattttgcagaatgccctttggctgagatttgtctgatgttttcctcatgatttgactgggattatgggtttttgagagaaatatcatttttatcatgtcataacaagggtacatgctgttcacatgatttgtcactgttgctgttggtgttgatcacctggctaaggtagtgtttgtcaggtttctctaaagtaaggttatcactgcttaccccctcaccctttccatactgtactcgttggaaggaagtcactatgtgcatcccattcttaaggagtgggaatttatgctcaatctccttgaggcgggagcatctatatacattacttggaattctcctgcacaggaaaatggtctattctcaaccattttcttatttagttatttcactattgaatcataaatatttattttatactttgaatttaatccaatactacttcatttattttgactcaaattgtcccagcttcggccactggcagcattttcagttggctcctttgacatgcccccatcgctgtgggtttatttatttttgagcacttccttattttctggaatcataagatgttccaggctcatcttggatatttcccatcctagtcctggaatcagccattcctctaaagcaaaaacactctggttctttttactggagaacagtattagaaatccggatctgggcagtgggtttcctcaatgctactggggtgttgttacttctagaccctctcagttgacagaataaggaaatgtgtatatacctacctgcatatatatacatatttttatacataactatctgtatctatattaagtggaatatgttcacactgacatctccagctccagtccattaccacatggattgttctagcctcctcccatcacttctctgtagactgcttttccagaatcttgcttttaaaacacatttccggccaggggcggtggttcactcctgtaatcccagcattttgggaggctgaggcgggcgggtcacgaggtcaggagttcgagaccagcttgaccaacatggtaaaaccctctctctactaaaaatacaacaattagccaggcatggaggagtgtgcctataatctcagctactcgggagactgaggcaggagaatagcttgaacccaggaggcggaggttggagtgagccaagatcacaccactgcactccagcctcggggacagagtgagacttcgtctcaaaacaaaaacaaaaacaaaaacaaccaaatgcttagcatgtcagggtggaataagacagatcaagactctgtctagaaaaaaaaattaaaaaacattgtttttatatgtttaaataacattatgttcgaatgctataaatatatctatgttttaagtgtgtatgtattaaaggttcgttgcagaacatttggaaaattcaacaatgtctagggtagaaaacccaaatctctttctagactcaatcactgctaacatctttacacatatgcacacaattctataaataaaactgtggtgatactagacatactgctttgtaatctgctatttctactcaacaagatataaggaactttaccaccatgtcattaactatttttcttaaaggtcatgattttaattgcctgcagaatattaacctttagttttgaacacttgagttttgatgttttttggtattaaaaataactataataaatactttaaaacataagtcattatgcacatatctgatatttttagttagactattttgtggaagttaagttactgggccctagagtaggaatatttcaaggagtatgataaacaattccaaatttcctttcagaaaagaaagcagtaatttagcttccttccaaaattgtatatgagccattttctctacatccttagcaacactatatattgaaataatttttaaaaataattgattaaaatgacatttcagtgttgttttatactgaatttcttttattacaagtgtgtttgaatagcctatttcgtaagttcattgcccatgtgtatttcatttctatatttcctgttaatgctgttttcagtttttttctgagagtattttaaaaattatttcaaaatagcactttaatttcaaaataagtgtgtactcaatagagaaactttaaaaaaacacagaaaaagacaaaggaaatgtaattacttatgattccgttacccattcttacttgattgctgtcattttcactttgatgtgtgctgaggtctgaatgtttgtttcccctctgcaaatttttacattgaaccctaagcaccagtgtgatggttttaagagaggcacctttgggagatgattaggtcaccagggtagagccctcatgaatgggatgagtgcgcttataaaggaggccccccagagagctgtcttgcctctccatcattccaggatgcagagagaaggtgtcatctgtgaaccagaaaatgagccctccccagtacaatctgccttgatcttggacttcccagcctcccgaactttgagaaataaatgatgttgtttacagtttacccagtctatggtattttgttatagctgcccaaatggactaagacaatgtgtctatttaattccagaaattatattttataaatggttaattgggaaaatgagtctctaaaatggttataaaaaggtcagtctgccttgatcttggacttcccagcctccagaac

SEQ ID NO: 1711 - DNA, 11599 bp, Homo sapiens; identical to SEQ ID NO: 1710

SEQ ID NO: 1712 - DNA, 7684 bp, Homo sapiens
ctgcacagcttgttatatctgcttgggggtcatggataggggcagaggggctgcagtgagcaatacaatgcaggggaaccttgcacaccacatggtgagttacattcagacccccctgcaaatgaaaacttcccacccctgggctgtttcccgttgatttgtcacagaagtggacaggtcctggactgagcttgtccatgggcttccctcaggaggggaggaggaatgcaggagtctctttacttcccagttcgggaggccatctggatggctctgatccactctgtgcgctccttgggggtggctgcttgcaagaaatagtgcacttcatctgctgtgatgatctcaaaaaggttctcttcctcactcttcctgcctggggaaagagaaggcaaatggcagcacgcacaggcatcagaaagaccacttgctccaccctcctctgcaagccatgaaatctctgttttcttcgtgttctaaggaaattgactatgtggctttcaaacatacaaacaaggtatgattataggataattcattgcacagttatatacatagtattgatagagtagatacatagtatgactgtgtgtatatatatatttttaagaaataggtaaaacacttaaggagaaacattttctttcatagtttacaggcaaactaaatttctcacctttgtatagcaacagcgtttaatgagtaacctctaatagtttctaatgggtaccttccctctgctcataatataaatcaagggttgctcctgatatctacctatctatctgtctttctgttaatatagatttgtatttataatatatatttatatatttatatttataatacagatgtgtgtgtgtatatatatatatgtttatatacatacacaaagccagacctaccaacagtaccacaagttatagcctgaactgtttttcatcaagcactaagtcagagttctgctgaagactaaaaggcaataacctggccaatactgtgacaagatttaaaacatcacaaatcaaataaagaaccagcatgctccctgccctaaaaccaaagtataattctaggtggtgggagtggaggtgggcaaattcaggcacagtaaaactctaggcatttgcagttatgatgttttcctgtcagcctttatcatactacaaaccaaaatgtcaggacaaaaccagggtttgggatgtcaaaaccacatcaccccagagatacaatttgtcctcagcacctgagaagtcaaactacacccacgtggttattccatgcaccaaatcatagccttgtggtctggggtcctctagtgcaaccccctcactgctcttcttctcagccattgtgaagtgatagagttttcccagcattgctcagggacttgcttgaggcatccacaaagccatccaactccccaaggcctggagagcctggacagcagttgggagacaaaaaataactctggtttctccaaggttttcagacagtaaattcattcctgcttttttttttgagacagagtattgctctgtcacccaggctggagtgcagtagcacaatctcagctcattgcaacttgccaagctcaaacaattcacaggcatgtgccaccatgcccagctaatttttgtatttttagtagagatggggtttcaccacgttagccaggctggtctcgaaatcctgatcacaagtgatctgccctcctcggcctcccaaagtgccgggattacaggtgggagccaccatgcctgccccattcctgcttatcctgattaattgattgattgattaatgttggcccaggatgtccaggtgtgggaggggagtctgagcagacccacctctctcacacagaaattcatcttaccatttgagttgctctccactgaagtcaccacacagcctctcaagtgaattgctcccaggggatcttctgcctaaagaagaaaggagttgttcattatgtttccaaaatgcagagtatagatagacctcatcctcttggtgaaaaagccagactcactctaatatagatcagggccccccaaaataagtaagagcagaaggagattaaagaaaaactgctgacagatctaaggtccttccagatcctccacaccctgcttcagtggggccaggaggctcaatgagaaaatgcaagacgatctggacttcaatctggagaaaagtgacaggagaggtggagacactgaggtcactgtatcccactaaaaaagagctacatgtttccagagctctttggtcccatgcacctgatgcagcaatataaccacccaggggaagtcaaatagcccagtgctgcaagcggagggtgagcaccctacccagagttgtcttcatgctttaaaagtggttcattttatggtggaaaaagtcctcttcgacaatcaacagcccaaattgctggacttaaacaataccctcatccaagttgacctggatgaggaattatcacctttatgcatattaaaccatggactgatttaattcccctgaaaatatcagattggggaaaaatatgttgagttgaccaaataaattataatatagtgatattttgttccatccctaagcttatactgacctcagaggcccaagatctcagatctttgcattgaaaggggatagaaaaaggtagaggagaatgggagaaaaaaaagtgggccagtaaagagaaaaaggggatatcaacagagtagagaggggaataggaagcccagattataaatgcagtggatttatttatttgaatggatttatgaaccacaggaccttaccccagcagggtcatagtagtgcaggtaggcagggtcttctctcaagatgaacttcctcactttccagtttttccttctatgcccctgtatccaggatcaacattaaaagaagggatggtgaattcccagcatcactctgtacaaacaatacctacagaataattatttgctgaattgagaaaagaaagagaaaatgaaatactaactccaggataacaatatcccggcctaggtctttgtcagggagatagtgctacagccaataaataatatggatgttattagatcgaagaggtggattaaattatttctaattattgtcttccagttttagtatgatataaggcagtactaggtacaatgtgctgtgttaggtaatgtagggggaataaagaggtttaagatgccctgatctttaaagagtttatgacctatgttgaaatataaagtagcaaatgcccaaatcaaataattggtatagataatggattccaaaggcattaagtagggaatatgtaattgtgggctttggatatcaaagaaagcctcataaagacctgcacttatccatgtgggacacaggatttagatgggcaagacaaaggtgggtaggaggacaactgacaacacaagagcagaagtgggaatgcaagagacatactcaggtgttgatgaataagaccagtctggctagaatgtagggttcatgaagagtagcagaggcaaggtgggaaaagtggacagagatttagtggaaataaaaggcagggtttgttgttgatggcttttgagtaggaagtgaaagaattacaattacattttaagaagattaatatggtgacaaagtgcaggatggaccagctggctagattaaaggaaagcccaggaaaagatggtaagtaaaaaagaattcattagggaaggatcacaataatccaggcataaaatcattaggaactaaaccttaggtagctgcagtaggaatggaaatgcctgttgctgtaacagacatgatgaaggaagaagaagaggcggaagaggaggaggaggagaaagaagaagaagaagaaggaggaggaggagaaaagggggaggaaggtaggaggaaggaaagaggaaggaagaaagaaagaagaagaagaaagaaggtgacgacttggcctttcccaacagaattaaacactgacattgtctagactgagttttaagggcaggatttgtgtcttgcttatctttgtttcccagggccacagtgcctggcatatagcagctgcttcatatctgtttgtacttgctgtgagttaccaagttatttccattagtgtgtagcagattttaaactgtcatggtaaacctgactctatgatttcccacaggaaattcaaatgacttaactccagaagccaaaaatagtattatattaaaagatacggagtttctatcttgccaatacaagaaatattatttgtaatttctaaagcaccacatattggcaagcatgtatacaaattttccaacatttttcattttacttgtgctgaaagcaataaaacatgtgtggtcttagcaaacagtgcctccttcataaatccagaggtgcttcaaggaagctttcagaaatgggcctaagttttttggcaaaacatttggtgaaggaactcacttccaaagaactttctacttcctgaaggatggagctggaacccctgcagagtcatatgcaaggacagaaaatattcctacctgctatatcatgtccaaaatggcttttgcaaagcatagacttccaaaagtatacattgctgctctttgccttaactaatgttgcccttcagaataacgacactaaagttgccaccccataccatttcctcttcactgacagacacacatgtcatgctgtattatgcaattgctggacaatcaccaacttattatgagccaatggaagaggaaggtaacaggaggatgtgaaatcagccaaccaccatattccctttaagccctcactgacatcacaatgtgacgtgttgaagagttggaagttagcaggtacatttctggtcatctttcacttaatgagcattttctaaggagtattaagaaatgcatgtatgcctcaggtttccaagaattgttactgaactgtcaaagccatctacttatatttgacttaattagctccccaagtgttcattgcctatgataaatcaagaaggatgctgaactctgcagcagatacaagagaagcatatataacacattgttcctctccctcaaggaatctaaatgtggttgagaattaaacaagcagatgctttattcattgtcataacagaaacaattatgtaaaaagggattatactgaatataatctaagatcattcatcctcaaacttgctgccaagtaggattatttatcctgggatgagaaaataatggggcagggataatggcctccagttagccacagctacttcccatctgtgaggcttcccattataacaagccttctatgaagttaatcctggctaactcccagcagtaaacacaagggaggcttacttttggaattttaagaaaaagtttttaaaattctgaaaatcccttgggtgattttgatgtaaactatggttactaaccactgagctaagagattagaaacattaaggggaagtgtcaattcaaatcgaagaggtttttgctccccaacctctgaaaaaaaattcagaggaaagaatattgtaaaagaacaaaattcctgaatgcacgtagatttctgttttcttcacataaaaaggaagcttctaagaaagactatttaacttgtatactgataatagaataaattagcttttaagaaaaaggctggctcagtggttctcagctttggctgcacatcagaatcacttgggagctgtaaaaatccagaggctctgattaaattggcctggcatgcagttttaacagttccctgggagatccaaatgtgcaccaaccgagctagctaaggctaaattgtacctatcaaaggccagacaaaggaaggcaaaggaaaacacataagttcaatccttgtccctattgtcttcaaaatacatccagacactcattacccacacacaatttttgaccatcccaggtctcctactgggctgcttcactgagacgtggctccagtccagtcccaactttatctactgttagccttcatccttggctttccaagagccccattctagattagggtttgcccaatcaactaattcaagaaataactgataacaatatagaattatggaagaaatcaacaaaataaagaaatttcctcccaagttactcttcttgtcttaacagccacattccagcacctgcaatcaaagagccaggaacataggaatatttggcaaaaccaacgagaaagcagcagcgggcaaactgtccgtaggcaactgcccgagccttcccggcataaggctggctctgccccatgcctttcttttaatctagccagctggtcaccctgtcataaaaaaatactataatagtccatgaattctttataaattcttgccatatatttcttaggacactgttctcttaaaacctgatatgaaggtaatttttccattcgaatgtcccacttccccctgtgaaactcaaaatccatacctatacctcctttcagctatcccagcccagagtccctctttataaatgtaaatatgggctcttctctggttcttccctccttgcccattccattaatcactaagatggacattcagggtcctaacatgaaataaatcagatcccccagtcccgtggagcctatagacagtacatggaaatctcctgatggcaacagattctctccattatatactgagcagcacttttaaggcagctcacagtgcagccaggaaggcaagaccttggtcctgcaaagcagccttggcctctaagatgccttgtgcaagtatcaactagcttccccctgaatattctcatgtcttcctgcgacttcctccaccaggtactggtcctggcttcctcagtcatcttggcccctgtccatctcttacctcttggcatcatatgccttggcacctggtaaccgactagagctcctcagcactctccagcccttgcctccaagactgatggtggcctgtacctgtggacacctggacatccccccaggactctgtccatgccctcaatctgcatttgacttttgcctgctgttcctgtgaactggcctctgcatgcccaggttttggtcttgtcatgccctaagcacagactggaatgactcttctttgctctcagtggtgtactctgttcctcttctgggtgtagcctgttcctgttttcctggttgctttgaagggaggagggacaggtaaaatggaagtacttttaccatgagacagctttgtcttttggatggcatctcttagacaatttatctcctccggccatatttttcttgaaacacctttttttttcctatgatattgataaaagaggcattttcctacttttagggacatcttctgccctgtcaaactcaatcttcctgatctaaagccactttgatatctaaagagctactcatctatctttcactttgtgggtttcattttctgcttgactattaaccaaacaaaccaaaagtcactgggtaacttagaaacaaaaaggaccttgtaaagggaaaaggctagatgggagcagttgtggccactcacctgcttcagtaaacatccctgcttgataatgacccctctgaattcttctttcagaatcacatcatcatcactggaattctcttcacagaagaacccactgtctggctgttggaaaatcaa

SEQ ID NO: 1713 - DNA, 2932 bp, Homo sapiens
cggaagactaggggtgaggctgctgcgaggaagacccggtcagctgtcccttcccccatcggtcctcttaggggaagtggagatgtgggcctcggagctgcgtggcccgggctgtgcggattccctaaacgccgcacttgcgcacagccccttacgtaaccgtcagtgccggggattccctggagggggtcattctattcaaccattatacacaccccgggctcctgccgccgcgccgccgccgcctcacaaaatggcggcgcccatagaggagaccgcggccgcctccccggccccattttgtgggaggcgagagatctgtcaacatggaaaacctctgctgaggatgcatccgagtttggaaaccccacttaagggatggagcctgggggatcacattaaacggaaaatgccaacgacttctaccacctctacgcgtttttagtttttcattttctcgaaggaagcgccagaagcctgtggagtaattgtaactagagggagaacggaaagctgaggtgactgctccggggacttggcgcggcgccttggtggctttggttgctcttccacgctcccggcagctgaccagaatctcttggagggtctcctgggccacctcggccgcgccagtcgtgcagtgagacttctgtagttttaaaatgccacagtccacggcccggtcggcaccgctcgcctgaatcgtgggctttgggaaccttggaggctgctgctccaggaactcgcggtcggccgggagccggggagcttcgttgctgggagcgggcggtattcgcggactccggcggccctggcgggtcgcggccgggatccgagccggggatgacgatgctgatggagctgatggggcaagagtgggaacggaggcacgtacactgaaatttaagtcatccaagttgggacttaagatagcaggttaatattgtctcaggcgagacttagaacgtcttttctggtatcccagtctgcagtgggcaaatctattgtctttatttctcatttaagggcagaatggagggatgacatatttttacttttcaagaggcggttgccacttttaagtcactgttgtgtgtgtgtgtgtacatacacaaacatacgatagtgtgttttcagagcaagtatcaaaggctaaagacttggagtgatactagtgtttaaaagcctttttaaaaaaattaagatgtgatgagaaactggagaattgacttttaaaaatttcttttctgtagaagaggctatcttcaaaatggagtcctaaagtatatctgatggatagaatttaaattcttaacactgtatataccctgtggtcaaaagcatcaacgtaaaacttgatgtttatcagattacttatgtttcaattttcctgtggttagaaaaattaagacagaagtaagctattaacggtatttgcttgtaagagtaacgttaaaggtttaaggaaaggtttgttgaaatcgatatgcatcacacgaatcatttattttcaatgttgttttccagttgcagcaatcatttgtgtttacatgactttgaaaaagggtttagtttatgttgattttgaccctcttatttaatctctagtgcagaagtgcagctttctgcaggctgcgcctcaatcgctaaatagatttctggatgatttggcccaaaaaatctgataagctttggggaattttttaatttttttttctcttaaagagaaatcagaaatgtgggatttttttaaaaatttattttcagtagatattggagattatgctttgtacattaaatccagtttgatttttaagtgataattttcaattaaagactttttaataagacaactaaaaaattaaattttagtcaattacaataatattttttggagaagcattcccagatgtgcttttgacggggagttgatttcattagttgtttgggttgtttaatccagaatttttaaaactgttatgggtttaatttgctacatttgtccattcttattcatttcatctgttttgatcactgaaaagttgtctaaaaactgtgctcattatacacagtttatagtattttaatactttgtttatagtatttaatagcttctgaaaactttaagagaacatactaaaccaaggaactatttattaatggtaatctatatttagtaataaatatatttgtaacttactaaatgtaagtttactaaatgtagattactaaatcactgagtaaatatttcttgaatatttggacaagagatggggggagggagaatgacttgaccctcaagaaacttaactgctacctttaaaaggttataatgaagctgggcacagtggtacacacctgtagtcccagctactcaggaggctgaggcaggaggaccccttgagccgaggagttcgaggctctgtctcttaaaacaaaaaaagttataaaaatattcagactggagggttcctaacttttaatacttaagcagggtctttaccacagagttaaatttaaaattctgtttagaatggtaacaaatttaattatgtacaaaacagcatcactttagtgttaggatcagtgttactcaaagtgttgtaatgttaataacaagcatttaaatcacattgtttgaaaactgggatctacaaaaaatatgattccaataattaactttttaattatgggaaaggcaagggaatgttcagtgaatgtaaaaaaaatatactactgagcaaacaaattgttttaatgaattttgattttctgttttaattttttggtacattgactcttcttgacatggcactttgctattaattaaaaaaaattaaaccccaaagacaaattaattctgtatttaatgcagatttaattcttgactagctgtaatgcttaaggagttggcagtcttgttggcaaaaca

SEQ ID NO: 1714 - DNA, 2932 bp, Homo sapiens; identical to SEQ ID NO: 1713

SEQ ID NO: 1715 - DNA, 792 bp, Homo sapiens
gccgcctatatgtccccctcctcaaccatgatagtcatcagaccaagccaaccatgagaccactgggaccttcctgacttccttctgttctgggaatgctttatttaaggagctttgtcctgagaggatctgccaatcattgtccaccaaccctcttttccccttctcatgcaagggtactgatatggtttggctttgtgtccccacccaactcatcttgaattatagtcccataatctccacatgtcgtgggagggacctggtgggaggtactgaatcatgggggtggttcccatatgctgttcttttagtagtgagttctcacaagatctgatggtttcataaggggctttcctctgcttgcactcattccctctcctgccatcctgtgaagaggtgccttctgccatgattataagtttcctgaggactccccagccatgcagaactgtcctgcacaccagtgaaactaatgaggtcagctgatctgaaggaccccatcgacatcagcagttctgaaggatcatacaaggagctgactcactgaatgcagtttccacatcctgacgacttcatccctttgaccccaaccactcaatgaccccaattttccagtccctcattctccacaatccccttaaaaaccccagcccagaactcctcagggagatggacttgaagatctcctctcatctccttgctcagccgccctgcaatcattaaactctttctctgctgcaaaccctactgtctcagtgtattggtatgttgctgtgcagtgggcatacaaac

SEQ ID NO: 1716 - DNA, 489 bp, Homo sapiens
gtgaggagcatctctgcccggctgccccgtctgagaagtgaggagaccctccgcctggcaaccgccccgtttgagaaatgggaccatgtagatacaggaaaacaagctcagggctccaactgattctacatcatgatatcctttcaggtcctgcacaccagtgaaactaatgaggtcagctgatctgaaggaccccatcgacatcagcagttctgaaggatcatacaaggagctgactcactgaatgcagtttccacatcctgacgacttcatccctttgaccccaaccactcaatgaccccaattttccagtccctcattctccacaatccccttaaaaaccccagcccagaactcctcagggagatggacttgaagatctcctctcatctccttgctcagccgccctgcaatcattaaactctttctctgctgcaaaccctactgtctcagtgtattggtatgttgctgtgcagtgggcatacaaac

SEQ ID NO: 1717 - DNA, 734 bp, Homo sapiens
tctttcctttttctagccataaatcttctttgaccacacacgatagcaccggaatctctctgaagtgaaaacaggttcggggggctgcccaatccacgagtcattctttgttcaatgaagagcacatctcttcaaggagaactacaaaccactgctcaacgaaataaaagaggacacaaacaaatggaagaacatttcatgctcatggacagaaagaatcaatatcgtgaaaatggccatactaccctaggtaatttatagattcaatgccatccccatcaagctaccaatgactttcttcacagaataggaaaaaactactttaaagttcatatggaatcaaaaaagagcccgcattgccaagataatcctaagccaaaagaacaaagctggaggcatcatgctacctgacctcgaactatactacaaggctacagtaaccaaaacagcatggtactggtaccaaaacagagatatagaccaatggaactcaacagagccctcagaagtaataccacacatctacaaccatctcatctttgacaaacctgacaaaaacaagaaatggggaaaggattccctatttaataaatggtgctgggaaaactggctagccatacgtagaaatctaaaattggatgccttgcttacaccttatacaaaaattaattcaagatggcttaaagacttaaatgttagacctaaaaccataaaaaccctagaagaaaacctag

SEQ ID NO: 1718 - DNA, 734 bp, Homo sapiens; identical to SEQ ID NO: 1717

SEQ ID NO: 1719 - DNA, 734 bp, Homo sapiens; identical to SEQ ID NO: 1717

SEQ ID NO: 1720 - DNA, 734 bp, Homo sapiens; identical to SEQ ID NO: 1717

SEQ ID NO: 1721 - DNA, 1557 bp, Homo sapiens
ctggagcatagtaagtgctgactaaatatctttcgaatgaatgactctactcttcctcagctggactcatgaattctgtcgggtcccaaaatacgtggtctaaagtcctttgggctcctgccgctgccagcactgatcatatgctcttgaccctggtcgggtggggggatgtctggatacctcctctgtggaaagaactggccacacatccgcagaggtgactcgggctgagaacccaggctcctcctccctttggtgacacgcccctcggtccctcactggcacttctccctccggccacacggcggcgtctcgccatagcgcagcggccgatggtacagcccgctcccccctcgcgctctcggacagtgggtccttccacttgtagaaaagcattgtgggacggaagcctgtcctttcttccttttggtgcgagcttgctgtggtttttgctctgggtcctctgggatggcgcctggctgtggccgcgtggtctctcacgcaggggcgccgggcgggggaacgcggccaccctgagtctggtgagtcgactgcggcggcctgtgtccgaagtgtccggggccgtgaacaagggcagcggcctggcctcaggcctgcgttcccacgtttggaaacggggagcttcgtcgatttgtgtttacatcatcgactatgccagggagttctccagataagcctggttttattttcgtcagtgaaaaggccttaccgtataactgactttatgcttgccctgcccccgtataaaataacttaaaagcagcgtgcctggttacagctgtttccacgtgcggtgctcgtcgggagtgatcacctaccctacaggtggaagatggatgcctgaagtgtagactgctgctagctgaataccatctgggagcataaaggtgacctgaaggatgtccttggtgaggattttgaaaatttgatcttcacaagagttgcctggatcatttgaaatttctgggagtctgaggagtactgacataattacctgctggagtctgtaaatacacatttaagacagtgaggatgtgaataaatatattaatgcactttggcatttgtgttttaagtgattaactgccagaaacagctatttctaaaaagttataagggaggaggggttcttttttgatcagtattcactgctgtcaccataattaatagccttaaaatagcttgtgtttggcccaaagagaaatgtactttcttccagtgactcaaaaatcgtggctagaactagactgatttctagtgacaggtgtgctttactgcactcaatgcgtatttttcctccaactaaattgtacatttaatgttgccatatcttctgcctttgctttgcaggaaacgacaaataatgtatagaggtattcaaaaaatttattgaaagcactgtactaggagctgagaacacgatgatgagcacaacacagttcttccctttggaaacatagataaggctgctggcagctgtggagagaactgtacgtggtaagggggagatataagatgtcctgcataagtattttc

SEQ ID NO: 1722 - DNA, 1557 bp, Homo sapiens; identical to SEQ ID NO: 1721

SEQ ID NO: 1723 - DNA, 1557 bp, Homo sapiens; identical to SEQ ID NO: 1721

SEQ ID NO: 1724 - DNA, 856 bp, Homo sapiens
ctcgccatagcgcagcggccgatggtacagcccgctcccccctcgcgctctcggacagtgggtccttccacttgtagaaaagcattgtgggacggaagcctgtcctttcttccttttggtgcgagcttgctgtggtttttgctctgggtcctctgggatggcgcctggctgtggccgcgtggtctctcacgcaggggcgccgggcgggggaacgcggccaccctgagtctggtgagtcgactgcggcggcctgtgtccgaagtgtccggggccgtgaacaagggcagcggcctggcctcaggcctgcgttcccacgtttggaaacggggagcttcgtcgatttgtgtttacatcatcgactatgccagggagttctccagataagcctggttttattttcgtcagtgaaaaggccttaccgtataactgactttatgcttgccctgcccccgtataaaataacttaaaagcagcgtgcctggttacagctgtttccacgtgcggtgctcgtcgggagtgatcacctaccctacaggtggaagatggatgcctgaagtgtagactgctgctagctgaataccatctgggagcataaaggtgacctgaaggatgtccttggtgaggattttgaaaatttgatcttcacaagagttgcctggatcatttgaaatttctgggagtctgaggagtactgacataattacctgctggagtctgtaaatacacatttaagacagtgaggatgtgaataaatatattaatgcactgaaacgacaaataatgtatagaggtattcaaaaaatttattgaaagcactgtactaggagctgagaacacgatgatgagcacaacacag

SEQ ID NO: 1725 - DNA, 856 bp, Homo sapiens; identical to SEQ ID NO: 1724

SEQ ID NO: 1726 - DNA, 1872 bp, Homo sapiens
agagaattcacctcagtttgtggtgtcccaggctaagggtcaagatctgattgggaagtaattttgcaaaaaatttggattcaaatttaaagagtatgcataaccaatcaaaaccactcaaataaatggtcatgaaaaacacccctgcccccattccaaaaatgcactcccgactcacactagtcccttgaccagggcggcaggaaggagtactcccagtcaacccacctaccccattcctggcctccacagagccgtcatgggaagagcgttttctctcccagggaccaaactgactgaagctttctagcaggtccagagaacaggaaagacctgttttccaggcccaggcctggagaacgtatcatggagcccaggccacatgggaaaagcagggagaccagacaccagtgacaagcccccaccccgagggctgtgctggtgtcctttcagcctgcctgcacccaccttcactggccctcagaccctgaactggccacagacccctgtctgcagttgctgagtggtttctccacagcttatttcctagggaatcctggctaccttttctttaacaagatggcaggaagcagggcaaagtcactttgggtgccagtacctgggtcacagactcccgctggccctaatggctaggctccattgccaccaaggaaggaagggcctgggcatacacatccccaaatatcccaggaggaaatggatcccgagaatgacggccaggttgggttcacctgcttagttcctaggttggcaagagaaggatggtacccaagataggccggggcagggagaagcagggatggatgggatccccacagtgtgacatagcatggctgtgaatgaggtgggtgggcgagggtgagccccagaagccaggacatctggactccagctaagggtgtggaaacaggctatgaagatcgccagggagaagtgactcatagttgtccccacctgactactccgttgactgcactcctggtgctgggaaaggcctccctgccatccagtctttctctcctctctccactctgcaggaacaactccagcctctacttgaggggcagctcttctccccaaaagaacccacagagcccctgtgggaagccgctttcctcccttaagccctgcgggcccttcagaacagctgtgtggtgaccagtctccaggaggccagtgttggctggcgcgagtgcccgcagttctccatcaccacctgccagccaatacgggctccacaccactgccccacagactgaggagggatgcgccacaggtgtccaagcagaaaccaccacggcttttggaatctggctggagatgctgacattcccaggtcctgtcccgcccctggcctgaaagaccattcccagcattcccagagccctgcagcttcgccctctccacgctgctcctcacccgtgcagccccaccttcaccacgctgcaacagggccacagctgccaagggggctatgggagagcgaatgggtgagcaagaaagttggaggaagaggaagaagggggaagagaaggagagaaaaagggagaagggagagggagggggagcacaagattgcctgtgcaagtgagactgcatgagtatcagagcaatccagacggcgagacactggatcactagtgaaagaaaaaggcaaccaagaaagctggggggagagccactgaagatgagggaaaaccaaacaggaaaggggtaagagagggcgagcaggagagcgagaagggaggtgagggacaagaacgaaagcaagagcccacaggagcaagaggagccagcgcaggcgcagcctgccacctacttcttcttgtccttgtccttcctcaggggctg

SEQ ID NO: 1727 - DNA, 1872 bp, Homo sapiens; identical to SEQ ID NO: 1726

SEQ ID NO: 1728 - DNA, 5608 bp, Homo sapiens
caggagggcagtacagccaggcggcagaagctaagaaaagagcttattttgtgactgcatccggaccttgagttctttggctcttgtgtgagtggatggtgacaccaggccagctggggattcttcccaggctgggctcacaggctggggctgggcacacggagcagctgcgggaaaaggatctggacaccagccccccagcgtgtcaccggcaggaaggtgaggtgggaacagagtgacgtccatgcatgttcagagacaaggtttccctacgttgcccagactggtcttgaactcctagcctcaagcagtccttctgcctcagcctcccaatgtgctgggattacaggcatgagccactgcacttgaccaagggactaagccagtggatcacaaacatcctggagagcagtgactctgtgattccatcacaagaatatgaaggactgagaagatctccagctctgcccattgcaccttcccattgagaagcagcatggcaccctggtggcaggggctgatactcagccgggccagggtgctctcctgttaaccataaccaagctcacaggacatgggatgagcccactgtgtgacacagggagcgggacacagtctgttaagtcttgcacagccatgctctgccacgcaggcaggcctttccttggcctccctctccctgttcgtgctcatgtgaacatccacctacgtggatagactgggctttggttcattattgctctgtgaattcctcgaacttccgcatctgcccaacctcccccaccccattgttttcattgtgtttcaccaaatggaaattctagagtaagcatgtgagtcctctcccaaacttgttcactgttgagagtgctaaaatgctaaccccagatgctaactgaggggtagggttaccttatctttagagcactgcgaattgtatgttaagtggaacttaatgaaaaaatagttaattgaccaacatgaatatcccctgaacagaatctcccctgaacagaatcctacaatgaaactaagggagataaataaagctgtttacctgaaagctctctctaatcaagatcctttgaaatttataaaacatggtcaatatttgcactggactttgtaaaaataaagcttgataagagaagagtttgaagtgaaatgctgccactttctatgcaatatttgatttaaatttaattcctagaaacctcagatgaatgtggttcatgtatcaaagcactcagcattatttatcgcggccttaaatacacagtgagcttacatgtgaatgaatacatatattatgtatctctctctatatatatactatatagataatatagtatatatatatatatagtgtatatatacactatatatatcgtgtatacatatactatctatatagtatatatgtatatggtatatatatctatctatagatagatagatagatatacttaaaaaaaccccattcccttaagagcagttaagggacaccatatatcaaatttcttggcacgttgtgaatattaatatccccaaagtgtcaatgtcaaatgatttgacttgaaatcactaagcttggtaatctcactatttttaaacaaggcctaacatcttttaatcttgaataccagcaagttctcagacttcagttgtttattttctcttttctttcctttaaaaaattctgacaagctcttttccttgacacaaagaaagcgtataaattttattttggtttgaacaacagaaatttgcctctcagaattctggagattggaaagtctaaggactaagctgctggccaatttagttcttagtgaggactctcttcctggcttgtagatggctgccttctcactgcatcctcagagagagagagagagagggctcttgtgtctcttcctttctcataaagcgtcagctctcttgtattagggtcccacccataattacccccttatatgccccatctacaaatagagtcacattgtgggttagagcttggcagtgaataattatggaggttattgttggctttagaatttcgtggtagaaacaataaattgcctttgtgtttacgttttattttatttttttaacattaacatgtatttgcaacaatgaaaacagcaggtgaatacattctgggtaggggaaaaagttagaggagtgctatccagaagttatatttcctaggaatatggggaataaaacattcaatattggtggttctaatagatgaattaaatttaatttgatgtggagtggccatgtcccctgtctcgggatgccgtgtgaagcctggctcttgtgacagctgtttagatttgctgaaagatgttttaagtgtcctaggaaagaggtttccattcattctagaactgatagttttctcttaaagtgttaatttacattttaatgttgatgtggtatccatctcaggttaatgtttggcactaggtaattgaatttttaaaaatctcattttattttctgtctgcttttgggagagagaagtggttaggtttttattacaggaaggatttttctctttctctattataatacctgaaagcaaatatatataagctatacatgaagtcattacaattcttttttctcattttattttcacttttgggaaagattgctgccaatatttgtgagatctcttttcagttctatcttttacttctgcatgtccgttatcttagccatgcaatgtttagtttgaggcagtttcacccaagggacataccttagaatagactctcatggccagtaatgaatgactgatggagggaacagcagtttataggttttttgttgtttttaaggagaaaaattaacacccttcatcaaacctcctctttcttccttctctcctcccctccatctcaccctgcctccccttgggatcttactcctgtgattagtttgggttccacacaaagaaagatttattactttaatgtctttgtgatttagttttatgtgatcttcctagggacaccagggagtacacgctcccctttctgaatatgttgtaagctcctttgaggcaaaaatgaatgttcctgtgttacaagaacagagcagcccttatcatcttctcgaatcttatctttctgagttaaacatttggcatcagtgacgaagtaagaccagacattgaggatgagacgtcaaatccaagtttgtagaaaacacacagttgatgcatctcacatctctcaaattcttctctgtggactctatgcttactgttcctgaagatgttcaccaaatgggaccaaacctccaaaaaaggagaattttaatttcttcttaccctacttagatgctggattgcataatgtggttgtaatctttaactatttttttaaaaaatatttgagattaaaaaatacttagaggggcaatagttagggcaggggagtgttcagtccctttatgaagatgttttttggctgggctagcacctcggccttgtgttgaaggagtgagaagtaacttgtaccaccggccacagctctagcttgtgttggaagttttgcagagttgttgatcctctgccaagtagaccagtgattccacctaaatggatagaatcttcaactcggaggcaccagtctctctcacttgaggaaagaatgcgaaggaaggaatggcctgacttcctcatgtgtgccctgtttctcggtaggcaccatgtgggggctgccacacatgtgccgaagctttgggaacgttccgtttaaataccaatttcgatgccaatgcctaacatggagcacaaatatccaggtttccaacttcagccgttggttcctcagccttctacgccttccactggaacccaaggctctttggtcaatgggcagcccgagtgtttgggctgcttagctttcagagggatgtgctgctgatgtctgtcctttttaaagaggtattttatgctcacaacacttcacacatcgttcccagaagatgcatctccaacatctcccagaatttgttacatgctcaaaggaaatgagatcccactttctgttttgatgacagtgggactggaaaagacagattctaggttgtcaacagtcactgtcttacagcaaagcagtttataccagagctagagctgaaaccttactgggaactggaagatggaaacacagcggtgagcctggagcagggcgacgccagcctggaggccctctcttcctgcccacaacctcacctcctcacatctacactgcacacttgcaccggccttctttctgcttcttgggaccacagactgagaagggacccccagtcctgctagctccttgcttggtctcagggtgaagacgagtcccgagtttgagtccagcctcaaatctgctgaccttggataagtcacttctcaccgcttggggctttggtttcctgaatagattgagttaaaatctttgtgggtttttaacattaaaaaaaaaagtggaacttgtttttcaaataaaatgttacacgaaaacttaatactaaaagcagaataagctggatttgctcccgtattctgggtgcctccaagtatcccctccccctcttatccatccttgtgtaccccctgccacctagcagcccccttcccagttcatcaggggccattggagggaaaggcttgggaagtacaactctacagagttcacgctaaggaagaaccttgcaggaaatgcttttaaacgtaaaccagcaacatctagcttctcctgtgtagagagctgcccagaccccaccaccaactgctaattctgatttttctccgctggacattggctttcttaataaatgtttggatttttaaaatctaccatttttgaaaaaaataagcatttccgcatagaaatcagaccttgtctgcgagccggagatgtcctccgcgtattcccggtgacaacgatgtggcctgtgagcctgcatggggctgaatggttctgtgatttcctagcacggaacagaactagtgaatgccgctgtgtttggggctaggatgctcagaggccatcccctctcctccacagaggctcgactactcgaaatgcattgcttctgagcctaatatgtgtcacaatttcaccttcaaaggccaagcatccagaagcaggagaataaagatgtttagtaagtgcagcacatcgattcctcttcatctggagctgcttaggagccaccaagattgttactcctgctctcattatgaatgcattagcattgaacttaataggagggtcccccagagaaagttaagaagcctgcctcagaggccactgcagggagacgtgtggggcccatgctctgggcatcgctgcataaaggagactgcacctgctctgaccccttccccaagacgttcagttgctcagtcagaaagtcaaggatgaaaagtgtgtgtctctggctgggtgtggtggctcacacctgtaatcccagcactttgggaggccaaagagggtggatcacttgaggtcaggagttcaagaccagcctgtccaacatggcaaaaccccatctttactaaaaatatgaaaattagccaggtggtgtggtg

SEQ ID NO: 1729 - DNA, 23796 bp, Homo sapiens
agactccgtcaaaaaaataaataaataaaaataaataaaataaaataaaagctagtgcacatttttgttatggtgaaagtcatgtgaatatttgcattacatgtgatcatacccaaaaactctataagggtcatctagagactagatactcatgcatatctcctggggctgatttaggcaccatgagatagttgataacacctgtacagaatgctgtggcatgccacccaggccctctactttcatcctgccagctactgggagttttgtctgctgatggcccacactggatccttcccacacaggtgtcctctgtgaaaggaactgtctcttccaaggtgacaccttgtattggtgtcacactactataaagaactgcctgagactgggtaatttataaaggaaagaggtttaattgactcacagttccacctgagtggggaggcctcaggaaacttacagtcgtggcggaaggcaaagggaaagctggcacatcttctaacagggcagcaggagagagcaaagggggaagtgcccacacttttaaaccatcagatctcatgagaactcagtcatgagaacagaacacgagaacagcaagggtgaaatcgcgagaacagcaagggggaaatccagccccatgatccaatcacatcccaccaggctcctcccctgatacatggggatgacaatttgacaagagatttgggtggagacacagagccaaaacatatcacagctcctgagaggcagccacgtcatgactgactgatgcctagccccttacctggggtagaacacaactgggaaaggccatgccagcctcaagccccctgtggaactggctgagtcctctgttgcaactgcattaggatctatctgtcttctcctgctgcttagtcctgtttccctcatgggcattgttcctgagagcacttcctaataagtgtcctatatacaaatctgtatcccagagtgtgttgcccaggaaatccaatttacagcagtccgtaatacaaaagaaattgtatagtatgtagtttaattgacctgtgcttctaacaggcatgcaaaaaaattgtgtgtataaattgcccaattaactagccctgaatgagtgagatcttagaattaaaaggattcatacaaattagaacaagtcttaaacttaatttttttttaagactgggtcttgctttgttgctcaggctagagtgtagtggtgtaatcacagctcactgctgcctcaacctcctgggatcaagggatcctcctgcctcagcctccccactagctgggactacaggagtgtgtcaccgtgcccttctaatttaaaaaaaaaattgttgtagagatggggttttagtatggtatccaggctggtctcaaactcctgagctccagtcatcctccctctttggcttcacaaagtactgggataataggcaggtgccactgtgcccggccttcaattttatttccttttgatgacgatattttccatgggtacgcagccatcaaagtataaaggaaacaagtagagaagaataaagattctgcaagtgtttgctttatacagcccttttcagaatttattatagactatactatagattttatttattataatatagaatttataatttcatacataaagataacttcaatcctaaatctgcatcaataaaggagaacacctaacaatgatctctttcacttttaatcaagagaacaatctttaagccaatagaaacagtctttaatcacgctaaaagagaaaaaaactgaatattgaagagcaaaataaatttaaaaatctttagggaaaagcttacatttgaaagagtcaactgttctaaaacgtttgtgaaataccattttcaatgtccaaaataatgaatttattccctggtccacatttttgcctgaagcacctcccccctcccacaagtaattaagagttattttatgggacaagagttagccagtcagatccaattactgtgaatcagaaagacaaaatttatatatccttttctgtcctcccataattctgatcttctctttaccaaatgttagccaacagctactttaatcataagcctgataatgtactacttcatggcaaatagaccttaataattctactcctctctcgctgccaatcctgtactgaacagtgagaatacattgacattgtcaaggttcaagacacattgattaatcaggtaatacacattctaaacacttagtgaaacggactgtaaaaaaactattttactgactctgaggggcaacaatttgtcttcttctactttaatgacgatgctgtgtctatgtctttacagtcaatggtacttaaaattacctggaatgactgggtttcactgattgagtatcacttaaaagccaactgaattttgctaaaatttccaaaattaaacaagaaatactgaacaattttcagcatgctaagagatagagaagcgaatgatagaaaggatagaaattattgaacaatacgttctagataggatgatgcacaaggctaatttcactttgaatacagccaagtggaaaatgatgaaaatcccgttcaatgtaacagaaaataaatgtgcatgggtgcaattttaatagaatagtactgccattcatttggctgcaccggagccaaggagacactcagggagtgcttggtaacaaaaaatatggacctgataaattatgcagccaaattagcaagtaattagacagaagcattgaaactgcaccagaaacagcagctatcccagaaattccaaacacgtactaaaacaaataagtggaagcttgtgaaattcactatatttacaattgcgcacttctgttctcgaaatcctaataattaatttccttgggggaaacttctggaatcccccagagttggtttccttgtcatctgttttcgtagcatcttattttcatttcctgcacataacttaatattcctgggattcagtaatttgtgtttccctcctccaactagctccatgagtctagagacctcatgtctgtttggttctttgcatgcctagcacagtgtgggtttacattacaggtgctccaaatatactttttaataaattaataatcttctcacacactagcagttctcttcactttccaggcttttctgggttgttacttgcattgtctctagatgctcttcctttctcttccactaccactctgatgagaatacaatagcagacagcatccctagaacaacacgacatctacagaaaaggggcatgcccctcccacccctttgtactctgcacaccaaaatagatcacttgttccagtgcagtcaggcatccctgatgggccccaaaatacataggcaataatctcacaggaatcttacatctctgtctgaaatcatcttcagaaccacacaatatatatcttactaggtgctctgtagataactaaagtgatgcagaaaccacacatgttcatccagtacctaccacgtgacagttattgcaaaattatcccacatcaaggacagacagatagcaaatctcccttgaatccttctgtccagctatggtcatgctcacactttctaactttctgcctgcagcaacattctctccatcaccccacctgatgccttaactgccttacctttgacctctataacattatttccaaattcttttttttttttttttgagatggagtctcattctgttgcccaggctggagtgcagtggtgcaatctcagctcactgcagcctcctcctcccaggttcaagcaattctcgtgcttcagcttcctgagtagctggaattacaggtgcacaccaccatgcccagctaatttttgtatatttagtaggactgaggtttccacattttgcacaggctggtctcgagctcctgacctcaggtgatccacctgcctcggcctcccaaagtgctgggattacaggtgtgagccaccgttcctggcctatttccaagttctgttgttgcatcattgtcattgtaacagacaccatatttcaatcctgcctgtgcccccacacagtgtgtgtgtgagtatatgagtgtgagtataagcctgccatctattaatgtattcatttaaagattgtgctctgattgtcagtgataaaagacaaaccgtattttcattttacaggatatttcgacaggtctaatatgagatttcttctcactccatttattcatacttatttcattatctccctgttttacttgcagctgtgcccatcaaccactaattatttttcttttaggaagaaataatacataacatcataaatttttttttttttttttgaaacagagtctcggtcacccaggctggagtgcagtggcacaatctcggctcactgcaacttctgcctcccaggttcaagcgattctcatgcctcagcctcctgagtagctgggattacaggcacaagccaccatacatggctaatttttgtattttttagtagagacggggtttctccatgttggccaggctggtcttaaacttctggcctcaagtgattctcccgcctcagcctcccaaaatgctgggattcaggcatgagccaccacgcccagccacccgtcaatgttaactctaaaaaaattgcttcatcttaccaccagctatttgggactcaacattggaataataacctaggaatattctataaagtgaaatgactttcagaaattacaaacatatacgtatattttatatatatatttatttacatatacacacatctcgagtggcaggatacatgtatacctatagttgtctcaatgtgggttgtcccaaaagcagaccacaagacaaggactgaaatataagccaggcatgggtggctcacacctgtaattccagcgctctgggaggccgaggaggctgaatcacctgagatcaagagttcaagaccagcctgaccaacgtgatgaaaccccgtctctacttagaatataaaaattagctaggcatggtggtgcgcctgtaatcccagctacttgagaggctgaggtgggagaaatgcttgaaactgtgaggcggaggctgcagtgggctgagatcatgccactgcactccggcctaggcagcagagtgggaccctgtcaaaagaaagaggaaagaacgaaaggaaggaaggaaggagaaagaaagagaaaggaagaaagaaagaaagagaggaagaaaggagggagggagggaggaagggaagaaagaaaaagaaggaaggaaggaaaggtaggaaggaggaaggaagggaaggaaggaaggaggaaggaagggaaggaaggaagggagagaaagaaagaaagaaatgtaagtaggttgtttaggagataattgcaggtaaaatgggagggaagcgggaaggtggagatacggtggtataaggcctaaaattaagatccaatattatgcatgctttgacatctgggaaaaactgtgagggcctcaaatgccctaactgcaagttcccatccccactctttttccacagataaggtaccctagccaagccatcctccttatcacaggaaccagtcacggttcctgcttatctctgagtagtggggttcagttgcctgccaccccatagcattattcaaacgagacagtcacatcctcccacaggcactagaggaagctccaccctgctgatactacaaagccagcctcccacagcccctgcttcttcactctgttcccaagtgctggtgaccctgtgtggcacgcgatgtcctcttctgccctgctgtgaacatgtgggactaatacattgccatccatctccttatctagtgctgggtgtcatgtgtctaggtatccccataatcctggggtgagaatctccctttaccaatggggtgactaggaggcaattaaaacagatacataaggaaatgcatgtcataaaatgcatgctatctagcaagtttttacatggctaactgagaaactgcagcaaaaaacggtgtggagagttctgggagccagtgagaaccagcttcagagatacccaagtgggaaaaagagctggcgtttttaaaagccaacacttgtcagtcattaattgaaggctgctcccagggacattaattctcccacatctcaaggaaagtggttcagccagccagagaaagccctcaagcaaagaaatgttcaggctggcaggtggaagttgacttgcaagcactttcgttgtaagacctgaggggctacgggctgagcctggctgctacaatgtaaaagcgtggtggtcttttagaccaaaatcctgtcccttcttgatattttccacaaaattcatggatctactggcagaaagacttcatcttttggtacagaaaaagttctatgcacggggccaggcgcagtggctcacgcctctaatcccagcactttgggaggcagaggtgggtggatcacttgaggccaggagttcaagactagcctggccaacatggtgaaaccctgtctgtcctaaaaataccaaaattagccaggcatggtggtgtgcacctgtagtcccagctacttgggaggttgagacaggagaataatagcttgaacccggaggcggaggttgcaatgagctgagatcgcaccactgccctccagcctgggagacagagcaagactgtgtctgaaaaaaaaaaaaaaagttctgtgcatgaaagggggaaagggggataaagaaaaaacagagaaaaatgttcaatgccacggtctgatgatcaaagatactgctaatacctccagcattgaggaatgagagttctcagatgttagcatgtatcaaagtcattaggagggactgggtttcaactggagggtctctcattaagtcttctggggtgagatctgagaatctgtatttctaaggagttccctggtgctgccaatgctgctggcctggggaccacacttggctctaggccaaggttctacaaccaaaggttttcagatgtagagcgatggagacctgatggagacctgggatggggatgtgacagagtcagaatgattccagaagaggcctcttcaaagtgcgctgcaccatcacagcatgagccgaagccatagaacaatcagcagctttgtctttgctgcctcacagttacagaggagaaggtgatgggatttcctttctatagatcaaggtcacggagacagtcaagtgaaaacaagaacttgaggatggcagctgaatgtgaattcagccaaagtcctgatatacatggacattcttctccagggacagtatgacaaggggtttccaaaaaagacaatattgagaactgaagtcagactcagtctcacagaggcaatcattggacacttgcctgttgataaggcgatgccttgcacttcgtcctttattcctgaaggagcaggagcaatggcctatcagaaatggccaggtatcttggattcatggaaacacacttgctgatgaaaagaggacagccctgactagcactttctctttttgcctctgagtttgagtaggcaagaagtacacaagagtccttctatttgtatgaagaaaaagaaacaagatcatcgtgtttattgtcagagcattttgagacattgttttgacttcattttaagccctgttaacttttagtcttatctctagcagatttcctcactaaagtgagtgaccaaatctccctcaatgcccatttctttaaatgctatcgcataaaacctggaacatgtattccataggttgctttgatgataagcagataatatgtgccaagcacccagctgggtgtgtcctggtgcagccgccatcggcccttcccctcccctccccacactctggccctccttagttgtcttgctgatggcttcctgtctgtagagcacattacaaaccctaatactttcattcattcactgatgtagcaaatgcttatttttatttgatatatgaccctccataaatgctggagatacaaaaatgatgggtagtccctgctgttgcattgttctcaatctaccctagaagtgggcaaataaagtcagtcgacactggcgtcatactgacctatgtggagaaacacacagggagaaagttacagagaggagaggccgttggaagggcttcccgaggaaagcagccgctgagctgtgtctccagggaggagctaagcagccggctaggtagaagaggaggcggccaagcagaaggaacagcaagtaaaagggcgcagaggccagacagaagaatgtgtctgaattgatagaaaaggggacaggaaggtgaagagcagtgccaagaagcagaggacagccacagagctggcatcgtgtgatgcggaaggcatggtcaaattcgaggaagcaagtaatacaaggatagatgcctgttggctatgttgccgaccatctcggcagaaagcctgctgggagaacagtaggtggggcagaagtcagtccatgataacctgagatatgaatgggggttgaacgctgtcaacatgttatgtggcttttgtggcctgagctgcaccgccacacccccttcctgttgtgtgtggggattcatgatgatattagtagcacatacagtaagcgggatctggggcttcatttaacatcttgtgtttcgttctgtagtgccccctcctcctgttggtttatatctagtattagtagatatatctctttaaaacttggtttcatattttggactacatcaattacccttacaatttatgatcgcttattcatttatactgccagtttttcactttagggatataatagatcatcaccacgactaaccccaccaccagcacccccacatactcctcagtactttttctaccttttatttctatttttcttttctgttttcgaggcagggtgtcactctgttgcccaggctggagtgcagtggcatgaattcagcttttcttttacttgctgttccttctgcttggccgcctcttcctccacctggatggttgcttagctcgtccccggagacacagctcagcggctgcttttctcgggaagcccttccaactgcctctcctccctttcactttctccctgtgtgtttctccctgtgtgcccatgaaatcttcaactcccacctcccgggctcaggtgatcctgtcacctcaccctcctgagaatacctgggactacaggtgcatgccaccgtgctcagctaatttttgtatcttgtgtagagatggggtctcactatgttgcccaggctggtcttgaactcctaggctcaagcgatctgaccgcctcagcctcccagagtgtcaggattacaggcgtgagccacaatgcctggccttactttttcaacttctatttgtacttcacgttttaccatttggagcttcatttagcatctggtaccttcttctatagcatctcttctcttccaaatatttatattctttgttaaaatttttttatttcaatagtttttggggtacaagtgtttttttgttacatggatgaattgtacagtggtgaattctgagattttagtgcacccatcgccggagcagtgtacattgtacctatgtgtagttttttgatccctagccctcctcccatcttcccctttctgagtctctaaagaccattatatgcaccctgtatgcctctgcatactcatagcttagctcccatttataagtgaggatatacagtttttgattttctactcctgtgttacttcattaagaataatggccgccagctccatccaggttgctgcaaaagacattattttgtttcttcttatggctgggtagtattccatggtgtatatacaccacatcttctttatcaactcattggatgggcacttacgtcagttccacatctttgcaattgtgaattgtgctactataaacgtgtgtgcatgtgtatttttcatatagatttcttttcctttggctagatacctgatagtgggattgctggattgaatggtagatccacttttagtggaatcttcacgctgttttccataaaagctgtactaatttgcattcccaccagcagtgtctaagtgttcccttttccccatcctcgccaacatctgttgtttttgactttttaataatgtccattttttttgccagagtaaggtggtatctcactgtggttttaatttgcatttccctgatgattagtggtgtcaagcattttttcctatgtttgttggccatttgtatatcttcttttgagaactgtctattcatgtcctttgctcactttttgatgggattatttttctcttgctgatttgtttgagttcctcgtagattctggattctagccctttgacagatgcatagtttgcaaatattttctcccattctgtgggttgtctatttgctctgctgattattccttttatgttcttattaaggttacgtgaaagacttgctcagtgtgatctggggctccctcttgtggcagacagtggcccaaagccattcccaaacccctttcctttccctgccttcaatacacaggcaccaagcgagacatttatatttctagacttccagaagccaaggctgagcatgtgacacttatggctaaaaagatttaggcagaaatctttgagtagggatttccttttcaactacaaaggcaaagcctcattaggaagaagccctttgctctcgtccttttttctcttctcaactgtgatgcagactgccccaagggctgccacctttggccgacatgaggatgagaactagccgctgaggatggctggaagtcacctgaggatcaggtagctcccaccccgagatggagggtaagggaaagaaagtcagggcaggtcttttgaaccacatttgtaacatttatataaaagaaatttcttcacagtgctgttttaaaagtattttaagcacatcatttcaaagtgtgaccggaataatgatataccaatttgaaagcagttattttagtgaataaaagtttcgttttaaggggggggaaagggtgtgactgtaatatagatttatttggatttctgaaaaatatagcccgcctgggctatggtagaaaaagcataaactgttagaacaacaacgcagagcccgctggaaaaacaaggaaagaattcagaaagccagcgtgagatcctctctgtcctaaaaacaaccctgcgggaaggcgtcctgggttcaagtcccaagttgtatacttactaactgtgtgaccttaggcaaatcactgcaatttctctgtgcctcatggtcttcgtttggaaaaaaaaaaaaaaaaaggaatttgcccaacaaatagtcagtttctactatatgccattattattccaggcacaacagtaaatgaaacagacaaacatctctgtccacatggagctcgctgcctagtaggaggagatagataagaacaagtactgtgaaatatatgtggtgtcatatggtgaaaagtggtacaggaaaaaatagggcaaagaaagaggaagcggaaagtagggataggagtggaggctgaagggagagacagccggaagccggaagccgaaaaccggaagcaagaagtagactaggtgggtatctgggggatgctcatgaaagacccttagtccaggaagagaacactgttggagacaaggcgccagagcatactatgttctagaaataactggaagttccatgcagctggaacacagtgagcaagtagaattgaaagagatgaagtcagagaagcagtggggaccagattttttaatgactcaccagcctcggaaaggacttcagctttcactgagtgaactgaggagtcactggaggagaggacaggatggagtttgtatttaaaaggaccacttagtgtgctgttttgagaatagattctggaaggggacactagttctgaggcaattacaacaatccgggcagacaggaggagaaggtccttttccaccccacgcatttgccgtgatgtaatgcgtacgaatgtgaatttcaagagactacctgcgtttatgatacattattattgccagtttatgacctttatgctaaaaacatgctagcaggaaaaaatatagccaacaaatgcagttgcatatgagttcacagacaatgataaacacacttttcagcttttcaaagagttgacaccaaattggtgtctgatttagatcctgcttaatggctcaaggaaacagatgagtgagacctgttaaagcaaactaaatatggcctgaggactccgtacttctatatttgggtccttgtggacgaactgtaacctagcttaatagtcagacaagattgaaaagctaacttagaagtatgtgcctataacaatagctgagttttggccaatcccagcggccatacttcaacgactcatagactgctaagtgttcaaactgtgttcaaataagacaaacgccaacctgtaaccaacccagctgtttctgtacctcactgccaatttctatgtgtcacttccttatttatttatttatttatttgtctataaattcactctgacaatgaggcatccctggagtctctctgaatctgccgtgattctgggagctgcccaattcatgaatcgtttgttgctcaattaaactcctttaaatttaatttggctgaagtttctctattaacagaccaatgacaggtcacatcccaacttctctggcttctttatatgactcaggaacattttaaatctgggggaaaaaaaataacctgtacctttcctcaacaggacaataacacatttttatatcagcttgttaaacacacgtgacacatctatatcaagttgttacacacacacccttgcttaaataattgttaaacacctgtggtccaaaaaaataatcacagggcatcactaatttatttgccagattaaagatgtaagatagagctttaatatccaaccgttggtaatcacggaaattccaattaaaacaaagagataccattttcgcccatcaagctaacaaaaatataaacataataatacttaatgttcatgatagaccccaactgatcagaaacagatgctgggtccatggtaggcacttccccagtgtagacagccactcaaccaggtatccacctctggagtccctggaaggagggccaggggctggggacagagcacctgggactcagggatgcagccctctcagcactttaataactggtatggccatcctggcttgaatatcagctctgcctcactgtagccccagtaatctctccaaattacagacttcatcaggtcattcacctgaaaagccttcagtagagtctcaaaacctgtgagataatgcctgaattatttagcaaggagtgcccctttgttttctagcccccctatctacttttccagcctcacattcacctgtcctcaacacatatcctgggacccagccatcccgagggatttttcagcttcacaaacccatcttgttcttatatccttaagcctttagatgtggtgcaaatgtcttcttccctgcttgcctgctcaaggaatttctacttatccttccaagactcaaaacaggcacttgtacctgtttagcctcccctggcttctctcccctgggctaccccctcttcatgcctagacatatctcaaggacagcatttatgcagaatggtcattacacatgctgcttcccactctctagatgggggactccttgggagcagggacagatgctttcttgggactatgtccacagattctgaaactccggctgaccagggcagagtcccagaaaatcttctaagattcaacaattgacgtgctttgctacaaacactgcagatctggacctagcacctgccttcctaaggaaagaaggatgtttttacccgatcaaattaggtaccacctgcatattcaccctgttggtacccaggctctaagataagagcacaggtttcctgcagcataaatatccactgaacggatgaatgaagccattaataaccttttgactgtgtgctaagagtcagtactgtgctgagaagaatattttcaaaagaaaagaaaatcatctttttgagtgagttgggatagaatctttggatataaattcattcttttcttaggggacttgctcttaatgaaactcagggtgaatgaggcggatgtgcttattccctggaccttcctgaaagtacagtgcaatcccacaaatacagcctgtacgcagcaggaatgaagggtgaacctgtgtctgtaggtgttgggaggacacacacacacacacacacgggaaaggaaaactgagttggttaactgcaacttgggtaaagtaaataatgaggcctcagtgcatgttcactggcatggtttatggtttctcttgtgactttctggagagggcaactttctggaggtggccaccagaacaccagcttccgcctttaaggctgggcacagactctccgacccacccacacagattggggcagctccaagctcccagattcggcaaggactcccatgctgagaaagctctccaggttattttcaaaaatggcctggggcctaaattacactcagggggatgccagccccctggaaagccccctgaagctgaccatgcgtggcttattctgcattccttgttgctgctgcatatctgaattcattaagtttgacttcgtaatctgaagagattcaaagatctgagctgttctcttgcctctcagtatggtatgtggcttctaggccaaattctatcacttccaggtctccccaaggtcctctgtccccaaaagcctgtcatatgtgctcacctccttcttccaagtcccctaaatgtccagaaagctttatctccatttcctatgagacacactgcagcttatctctgtttcaccatctggagcctaattcccatgagggcaaagaccatgaggaacacagccttcagctttgtggcctgggacaagttactgacctctctgtgttttggcttctcctttggtaaaatgagaatattaccagttctacataataacattgtggtgagaattaaatgaaatcatactaagctgctgaaacctggcacttaggaacagttgaataattgctaaacttccttggttctattcagcttgacacaaagccccatagatcacagggactcccatttgggtgactattctctatcttaaacaaacagcatttcagccctgacttgaactgcttataaaatggggggttgggggggtggggggcaggcaatacaagaaatctgaatattaatggagaattttgcccattgtgtctgtgtctcacctcaagatattttttataacaatgtggattccctaacgagacttcttaaaagttgatgcacttcaaaaagttacatcctctcatatcccaacaacaaaattacttctgtgaaagttgattatgtgaattgggtgattcttgccatacccaaataaatcagagtctagggaccagcggagggaaagcattccgcacatagcacctgtttcaaaaattatccacaaacccagctactaaaacaatgtgctgtaaccctaagatgagttttacttagcagctgctggaatcacctgctgcgactctaagactagttttacttaccactgtcactcaccagtcagagcttgccagctcccaaaaccttctatcgtgccaatgagctttctttcaaaacaatacataacacttgtcttactgataaaactccaatattgtttggctgtgtccccacccacatctcatctttaattcccacatgttgtgggagggtccctgggggggaggtaattgaatcatgggagcaggtctttcatgtgctattctcatgctagtgagtaagtctcactagatctgatggtttgtttttgtttttgtttttttatactgtaagttttagggtacatgtgcacaacgtgcaggtttgttacatatgtatacatgtgccatgttggtgtgctgcacccattaacttgtcatttagcattaggtatctctcctaatgctatccctcccccctccccccaccccacaacagtccctggtgtgtgatgttccccatcctgtgtccaagtgttctcattgttcaattcccacctatgagtgagaacatgcagtgtttggttttttgtccttgtgatagtttgctgagaatgatggtttccagcttcatccatgtccctacaaaggacatgaactcatcattttttatggctgcatagtattccatggtgtatatgtgtcacattttcttaatccagtctatcattgttggacatttgggttggttccaagtctttgctgttgtgaatagtatctgatggttttataaagggtagttttcctgcacaagccctcttcccttgtctgccaccctgtgagatatgccttttaccttccaccatgattgtgaggcctttccagccacgtgcgactgtgaatacattaaacttctttcttttgtaaattgctcagtctcgggtacgtctttatcagcagcgtgaaaactaactaatacaaactcccaaccttctctttgttcttcaggcatacccaagaacactccatctgtgtgtatgccccaaattgcaattctatgattcccaaataaaacatttcacttacagattcatttctctctctctctctctcatacgtatttcacatatatttgagacagggtcttgctctgttgcctcaggctggagtgcagtggcgcaatcacagctcaatgcagccttgaactcctggactcaagcaattcttctgcctcaacctgccaagtagttgggactacacatgtgccatcacactcagcttttgtctgtgatccatgtggaaaccattcttctgtgtatagtgtaagggaaaccacctttgctttgacatatgtgtgtaaacggtattgtctgtcgaacgttgcctcgtgagtcataaaaagaaacatcccagcctctttgttaagagaagtgctgtcaagtaagtagtagagttatatgagtgagacagaaaataaaattccacctccaacaacctctgaaatgggaggtgggtcattcagacaccatttcttcatgaactgctgccctgttcctctacccagtccacagaggaaaggcaatagcagggcatttccttgtgtccttcaagctctccctggctctcctgtgcacgtgaaaagacacccacagaagctcaggggtgactgcagcccatactctgtagccctctacctgggccagctgccccggacaattgcacctgatagcttttccagagcagagcagccagagaggtgacaaagaatgaaagcactgaaaaatgtcaacctgggaagcaaatgtgaaacccatttccaaacagggaaggcaaggagaaaagcaagtcacatcagaacagagatgggggagaaacccctctgagtcttaaaagagaagggttgcaattaagatggaattaggaagtagaaaaagaagcagaatgcaagatttaagcccatttcaaagcttttcagaaaccagactcaaggcagctttaaagcattctgaatttttaaaatcagaacacatattcgtatcattacttcaaaaagcaaagacacaacagtgaaaaaccttttattgctcttggaagtaaaatctaatagccttcatctatttggagcatgaggtggaaaggaaagtggtaaaagggtaaaaatcaagtgttctagagttagggttagttttcttttttcaagctctagttcacactcatcttgaattttctgaagcctgtagttatgatcccattgtgaacatatacaacaaaaaatgtcaaataaaacattattacaactttcaatataagacagcagagagtaaacagtgcctgattttctctcttccagactatttacattcttacgaacagacacaagtctacacaaaatgacaagcgcacatttcggtggcaacagatcagctgcttcagaaatttatctggcttggggaagagatattattaacaaaagcaaatatggaaccactctgaggaattaccagcagctgatgtaaattttcacctcagaaacagaccaggtccagggagaaaaaaactagagaggttttgattctcctcccaccgtctgcctttcttttccaaagaatagagagcctgccccaactggaaaatcaggtagcttctcccacacaggaagggatctgctgcctgaggcagaaagggctgcttgggtgcctctgtccccagtgccccttcatttctgtcttcctacatcctcttgagattacatgttgattacattatattctattgtatcgtactacataatacagcaacactgaaagaatgaaaggaaacgggaaagggagtgaattggcctttgcaccctgaggataggaagagggtggtggatactgggacagcctggtggacccagccctcccagggttattagatgacatttgtcacgtaccattcctggcagcagcggcaggtcagggtgaccaggatcacctaggaatgcatgtacttctgacagtcatgaaaccaaggcatgagagcaagagatagttttggggtctggtatccaaaaattcaaattagtaaatttcatgttatgtgtattttatcacaattaaaaaaaaaaactcaaactttaaacattcagagatttgtttaaggggtatatggctctggtatccataatgctgtaaaaagggaaatcttttagtccctgaggtggacagcagcaagtcctaagtcctccaatctgataagcatagtgggacagaggactcctcacttgaggacatctaggtcgaaaacaaacaaaaaaaatcacaaaacttatgaaaatattctataatgtaggaggaggctattgctcttaaaatgcagagaaaaatcatacttttgaaaaacagttaactacaagaaacaggaaatctttagaaaacattcccttggtggactcaatgaaatataagaaaacacaaaataacaaatggaaagtgagatgtaaaaggctacttaaatgctttctgagatgtaaactgatacagtaaggttcaggctgagagaagaaaataattgtaaagaataaaaatgtaaccaatttactgtttttgatagagcacaacagagaagtgacacttcggaaaagtaattcagtaacatggaagacaaatttgagaagccatcccagaaagcagaggaaaaagacaaagccaaaatctgaaagagaaataaagttattaacttggggaggggatggtgaagaaaaggcagaataagaactatgcgagacagaaaacaaagattcacttcacaaaatagaggaaaaatgtctacaaagctttaagaataaaaagaaaaaaagggctgggagcggtggctcatgcctgtaatcctaacactttgggaggctgcagcaggtgaatcacctgaggtcaggagttcaagactggcctggtgtctaccaaaaaaaaaaaaaattagctgagcgtggtggcagatgctgcctgtattcccagctacttgggaggctgaggcaggagaattgctagaaccctgggggcagaggttgcagtgagccaagatagcgccattaccgactctgtctcaaaaaaaaaaaaaaaaagaaaaagagaaaaaataataaagctgtgatcaaataacagaatccatgtatgaaaaataagaattgtggccgggagcagtagcccatgcctgtaatcccagcactttcggaggccgagggggctggatcacgaggtcaggagttggagaccagcttggccaacatagtgaaaccccatctttactaaaaattagtaaaccctatctttataaaaattagctaggtgcagtggtgtgggcctgtaatcccagctactgaggaggcggaggcaggagaatcactggaacccaggaggcggaggttgcagtgagctaagattgcgccactgctctccagcctgggcaacgagagcaaaattccttctcaaaagaaaaaaaacaaaaagaattatgtccttaaaatacaaggaaagctttcatgaactaccaaaaaaaaaagtgccctcaaatatctaaagtttcatgactataatccatattccaatgctaaaaatattagacttatgcaaataaataccaagcttatgaccaagaaagaaataaagaacaaagaactgaagaaatgaggaggggatcatttaaaatgataaattccaagcaatgaaaagataatctaaatagtactaggttgttaagcaataactcaattcaaatcaaaaaataattttcataggaaaaagtgtataataaaataataattactaactaaaaagtccacccctttgccacatgaccccaaaaactatgtagattaatttaactaatattaaaatttaaaaaaaatttttttttgagatagagtctcactctgttgtccaggatagagtgcagtggagcgatcttggtgagatcatgttcaagtgattctcgtgcctcaacctcctgagtagctggcattacagacacccgccaccacatctggctaatttttgtatttttagtagagacaagagtttgaccatgttggctgggctggtctcaaactcctgacctcaagtgatctgcctgccttggcctcccaaagtgctgggattataggtgtgagccactgtgcctggcctagtttgaggatttctaattagccttaccaattagcaagtagaggccaaagtccttctgcagaggaaaaggaccacaggaaagggagagaaaggccattaagataaatagcaggcgaacctctataggaaaacagagacatgaaggtgaggtcccccgtctctggtaaactcatggttcaatcatcacagatgggccaatgaaacagacaccaactaaccaggacattcaaagaataacagcagttgctgtccaggacgtcacggccagccacacaatcccaaatcatcaccacagatgtttaaagccaaagtggacagctgccaccaaaaggtgccaaatcatagccaagacatggatgttcccatggaactccaaattagctagttacacaagcttgtgcgggccgtttcattaatctcccaataattcaacccctcatttctaatgattggatatttgggtactcacttatggcattatggcagggtttttattgttgttgttgttcttgttgttgttgttgttgtttttgagacagagtctcgctctgtcacccaggctggagtgcagtggcacaatctcggctcactgcaagctccgcctcctgggttcactccattctcccacctcagcctccctagtagctgggactacaggtgcccgccaccacgccaggctaattttttttttttttttttttttgttagagacagggtttcaccattcacaggatggtctcaatctcctcaccttttgatccacccatctcggcctccaaaagtgctgggattacaggcgtgagccattgcgcccggccggcagggttttattgagcttctttcataatcaaaatgaaattaatattatttaagaaaataatattttagaataaaatattcaaagtcttcacctaaatgactctgaagataaacaaaaagttctaaaatgtaattataaacagtttagaatgtatttttaaaaatctaaacatatatagaaactgaagaaatgagtccaaagctgcattcaatggaaaattcatagtattaaatatttttgttacaaaaaagaggaaaaataacataaataaatcaagtattcatttcaagatattaagttgaaaaaatagaatattttaaaagataaaagtaccacaaaggaaatagaacatgaaaatatatataaattgagaaataaatccaagagctggttatttaaagaacaagaaagccaatgaaaaactttgacaaagcttattagcaagagaaaggatccattgtaatggggtgatattttgaaaactactagtttattttctcttttgtctttctgagtatatgaccttaccctagaccacttgaaacatctttgcagggaggaagaagagattaagactttttcctgaaagaatgcaaaaagagaagataagcattattaccatgaggctcatgtgggaagatcagaccagctccagaaaaatgaagaaattacaatttctctatacaaccaagtagtatggtggattaaaacttgcacccctgctccataaataaccaaaatcataaatgataaaggggacataaaataaatcaaaacataaagaggcttttacaaacacagaatggtataaattttagaaagcttaataaaatgggccatattcagaattatgagttacctatattagcccaagaagtatgccaagtagaaaagaagtatgtcaaaagaaagtgaaaaattcatcaaagattacctctaaaaacgacctgagatcaaaccatttaatgagtacattctttccaactttccccaagggtcaaccctcgaatgtgtaatagccacaggactcgggaaaagatggaatgcttctcagctcatcaagaaagctaggctacctatagtacaccaacctgaatagaataaaactataggacactatttttctcaaaagcttttgttactccaggaggtcctagtgcctctaatatgctgtgaaattccaatgagggggtggcaggcagtggtgttcctcaattcagggtttatccagccacttccagacccttcttagagccgtgctagagcttcctggagttacaccatcagaagattaaggtggatccaagagccaagaatatagagaagcatacgcagaagaaaagggatttgcaagagataaaaagaggaaaagagaccgtatagcagattgcaatcataatagcaatgctaaggcaggaagcagtacattctgcttgtgaaaatgtaaattgattcagcccttcgaggaagcaactgacaatgtgacttagaatctaaagagtacatactctttgacttactaatctcaactcctgtctgtccatcttgggtaattaatttgaaatgaagataaagatttacatacaaggatgcatttcatagaattactgatggcaaacaaaataaaacagaaacaagaagcaacctaaatgtctgaaaatggaaactattaaatagattatggcatgttcagataataagttatgcaacaatccaaagcaatgtttttgtggggggaggggaatgtaatgacaggtataggtctaggatttttagaaaaaaggcagaacataaactgcaatgtataatctaagttatatttttgaaatatatgtatatagaaaagactactggaagaaatatagaccaaaaccaccttgaatatggtctctgagaggtaaggactctgaatgaataacattttcttttatacagttctattttctaactttctgcacaaagctgtattacttttacaatctgaaaaaaaaacaattactgcctatgaataaaaacacatgtgaatgataagaaaaaaaatttaagcctccagtcactaaggacaaaatcattcctagcacgcaaaacaaacctgaatcttaacaccggtgccctttaaagcatagaaaagaaaaagcaaaccaaccaaatccctccataaagacaggctg

SEQ ID NO: 1730 - DNA, 23796 bp, Homo sapiens; identical to SEQ ID NO: 1729

SEQ ID NO: 1731 - DNA, 1508 bp, Homo sapiens
tttcttttgtaaattgctcagtctcgggtacgtctttatcagcagcgtgaaaactaactaatacaaactcccaaccttctctttgttcttcaggcatacccaagaacactccatctgtgtgtatgccccaaattgcaattctatgattcccaaataaaacatttcacttacagattcatttctctctctctctctctcatacgtatttcacatatatttgagacagggtcttgctctgttgcctcaggctggagtgcagtggcgcaatcacagctcaatgcagccttgaactcctggactcaagcaattcttctgcctcaacctgccaagtagttgggactacacatgtgccatcacactcagcttttgtctgtgatccatgtggaaaccattcttctgtgtatagtgtaagggaaaccacctttgctttgacatatgtgtgtaaacggtattgtctgtcgaacgttgcctcgtgagtcataaaaagaaacatcccagcctctttgttaagagaagtgctgtcaaactatttacattcttacgaacagacacaagtctacacaaaatgacaagcgcacatttcggtggcaacagatcagctgcttcagaaatttatctggcttggggaagagatattattaacaaaagcaaatatggaaccactctgaggaattaccagcagctgatgtaaattttcacctcagaaacagaccaggtccagggagaaaaaaactagagaggttttgattctcctcccaccgtctgcctttcttttccaaagaatagagagcctgccccaactggaaaatcaggtagcttctcccacacaggaagggatctgctgcctgaggcagaaagggctgcttgggtgcctctgtccccagtgccccttcatttctgtcttcctacatcctcttgagattacatgttgattacattatattctattgtatcgtactacataatacagcaacactgaaagaatgaaaggaaacgggaaagggagtgaattggcctttgcaccctgaggataggaagagggtggtggatactgggacagcctggtggacccagccctcccagggttattagatgacatttgtcacgtaccattcctggcagcagcggcaggtcagggtgaccaggatcacctaggaatgcatgtacttctgacagtcatgaaaccaaggcatgagagcaagagatagttttggggtctggtatccaaaaattcaaattagtaaatttcatgttatgtgtattttatcacaattaaaaaaaaaaactcaaactttaaacattcagagatttgtttaaggggtatatggctctggtatccataatgctgtaaaaagggaaatcttttagtccctgaggtggacagcagcaagtcctaagtcctccaatctgataagcatagtgggacagaggactcctcacttgaggacatctaggtcgaaaacaaacaaaaaaaatcacaaaacttatgaaaatattctataatgtag

SEQ ID NO: 1732 - DNA, 10062 bp, Homo sapiens
gtggagcaacaggcagttttaatgaatgcctgaaggcagaccttcaggccatttcaggccgaggcctaaaatggcatcagccccaaatgaggacgggcaggggttttacagtctcccgtaaacaggaagtgtttcagtctgtgtatctactgctacgtgatacccggtaggcctctctctgggtcttcagaacagctctctccccgcttctgctatcttgctgacgcacgctgatgacgtaagccgccttgcgccttgggactgggcctgagaagggaggagttattcaggcctccgccagcttctaggccctggggatggtctttcacctccctctttctgatctctttttcatgctcctccttgctccaaagaaaagccggatggcaaaagagcccagaacctattggaactgacaaaatcaagtcacggcgcctacaaagatgaggggcagattctggctgccttttaatttcgtccttcacctgatatctgtgccagagaatgttgtctttcaggaacttggggcggcccctgtccagttcaaaccagctgagaccaccaaccctctgaatgcacctgcatggatgtcggaaaagtgacacttgccatcagagggccaaaactccaccctcagatcatgttaacactgctattttctgaccatgtgtcctaagaagagccgtgagcccagactgcacttgctcagatcaccagttacctcacttctccccaccctcaatcacctttccccaccttagaccatcctaattctttactccataaatatccctaagcattatccttgaggaggtagatttgagagctgttctcccatctcctggctgggttgccctataaaaatcataataaaggaaataatggaagaggagacttatgttactggggacatctaacataattattttcctgattcagtggcatggttcagtcttccaggagttctgctacagagaagagagtaacccccatccatcatggccaaagcacccagtcaggctccgctctggatccagcccgacaaatgcaacccttgaatagggtttgtgcaagcaaactggatgacgaccgaagaaaccctgtcgcttctgagaagacacccaatccaagaatgaaagcatcaggttcaatacctaggaactcctgtagagggtgttgtggaatcttctttaaaagaacaaaacaaggcaaaacaaagtttaatagggtagagcagccaggtgtggtgggtcatgcctgtaatctcagcaatttgggaggccaaggcaggatctcagcaatttgggaggcgaaggcaggcagatcacttgagcctaggagttcaagaccagcttgggcaacatagcaagaccctgcctataccaaaaaaaaaaagtgaacctaggagtatgaggctgcagtaagctgtggttgtaccagtgcactttgggaggccaaggtaggcgggtcttctgagatcgagagtttgagaccagcctgaccaacatggagaaaccccgtctctactaaaagtacaaaattagccggcatggtggtgcatgcctgtaatcccagctactcgggaggctgaggcgggagaattgcttgaactcaggaggcagaggttgtggtgagccaagatcgcgccattgcactccagcctggacaacaagagcgaaactccatcacaaacaaacaaacaataaacaaaaaccatagagtgatttctggccaacagagcaagaaagaagtgaaccaatgaaaaccggtccaagtctgggagtcaatatggaaaagctgcctaattaatgtggaagccccagggaaatgatataccatgaaaacctaacactacaaaaactagttgtcagacacatgtgagcagtgaacagaatcctaatatgctggtttaacattcaaaactggagagtgtttgtgtatcttctaaagactgtttggggtttatttgtggagttcagctgagtgtcatcagaacaaagattagtgcaaaaaatctttcagaaatcatgcccaaacatttgcatgcaccttaaataagaaatgaaatagcaagaagagtatgtcacaataaagtataaatagcaagtgatatgtctcatcgtactgagacagttttataaatgaggcaaaggccttgtcaaaaaataatgatgattttcaaaattctgaaacgcaaaggaggaaaactacttcattcagttaacaggaagcacacaagaatctccccatcaaccaagattttttttttctataacccacgctttgtaagacaataatagcaaaaactataaactagaatttgttgaaagaacaacttctagaatttgccctttatgtgctgttttaccattgtcatgtctgtctctggtatgacttcctcatctattagtagcctcctaataaatttgaacaaatgaatgaatgaataagagacaactaagcatgaggtattgcaagatggtaactcatccagggaaaattaaaacctggagtggatcagatggaaaaacaaaataagacactagaaaaaaatcaccaggagggtttcaaaccaaaagatcccctggttaaccttcagctaattataagatttaattaactagaaaaactcaatccttgtttattctatttaattgagattttaccatatttaaaatgatgttactcaagtgttctcattaatatttaatgaaagtgtgagagaattggctaaccaaatttactgtgcttaggtaaactgtaattaggaagggttagcagagcatcccaagggacctatcaatcacaaaatgaagcgatacaattacagatgaatttcaacaaggaaacacacaaaacagtgatcctcaaaaaagatggaataaaattacttgaatgtggtagtcggttctgagaaatgcaatcaatcacatgtcatttcagacaactcagaaggaataaccctacccaacagacttgaactctttgtgtgtgtgtgtgtgtgtgtgtctgtgtgtgtgatagaatttcactcttgtcgcccaggctggagtgcagtgcgatctcggctcactgcaacctctgcctcccaggttcaagcaattcttctgcctcaccctccctagtagctgagattataggtgcccaccaccacacccggctaattttgtatttttagtagagaaggggtttcaccatgttggccaggctggtctcgaactcctgacctcaggtgatcttcccacctgggcctcccaaagtgctgggattacaggcatgagccactgcacctggcccagacttgaactcttgattgcatgaaagtgtattaatcttctatctgcttattcccaatttcccagctgataaaatgccccactgttatttcacttaaatttggaataacctgcatctagttaagttggagctactttgtcttgttgcagattttcttttgctttgctgtcttcattctaacttggcagagcccaggtgctttgtctctatttgcctgcaagacctcttttccaagacatgtcaggtttctctctaaagtaccttccacctggaggatatctgttcttgttctttaattcctggccctatttcctattcatctgaaaaactaggctttgtgagcaggatcatgcatggcaatgagttctaatgagtttttaatgtttcacacttcatgatgaacatatatttgcatttcagaaaatgcttttaaggaatgtttttttttttctgccctcactcctaactcagttgcctttaagcaaaaccaaagagagccatggccagcctgttcaaatggctgcaatcatttaagcccctctcgctgcaccctggcccctcttgcctccctagcctgcccatgcttgcccctgtctcaacttctacccccactccagctgaagagatttgccattctcagctttcacctttggggatccctcttgaccatggttagcaattgctgtgaccatcctcacatcacagatttttgggcttctgtttcttaggacaatgcctgctctccctgctagcctatccctcatcccaggccctccaacctccagccactgcaactctagagccacatcctatcccattgactaacccaactgccaagccaagcccaatccccagacctggagctcagagaaattattaatccaatcaaaggcactaaagttgggattctgactctgaagcaggtaccaaattttggacagagaggggctcctgaaaccatactattcctgcattaagtgtctggcactaggcaggggatatgatgtgatctaacaaggccatgcactggaattaacctgcgtgagctccacttggctgccctctaaaggtcaatgcattgtttgagcctaggggagccagtcactgctacatcaatggctgcatcacggtatcctttttaggactaaacctgcattttcctaatattcaggtctgtagaaactttgactgcaagaattttacaggaatgggtaaatatctgtaagtacttaaaagtatatatggtaatatacaatatgatagaagaaataagacctaatgttagatagatcagcagggtaattatagtttacaaccatcttttgtacaattcaaaatagctacaagagaaaaaggtgagtgtttttagcataaagaaaagacaaatacttaatggatatcccaagtatactgatttgatatttacaaattatacaaatgtattaaattgtcatgtgtactccaaaactatgtacattattatgcatcaattaacaaaagataaaagtatgtatgaatcagtaagtacttctaaggacctgtaaatccatataagtgcacattagtataagagaactaaggagaatttgagatcagtgtttacacagtgctagcattttgttatctaaaacacctctttttcaactctatcaaagattgaatgcattttttaattcaaggaatataatattcaggatgattatttttattacagctgtgggctttttccttgggcattgaacgcttccatttagttcaactacttattatcttttcttctcctcttcttttttttttttgcttaactttctatttctttcccagtaataacatatattttctcaacttcttaaatctctttattagatacagtcgaatgtaatttggaatttacgagtcttatcacattctcattctgcttgagcaattcaagatataagaaaaacagactgtctacatttcttcagagttcctccaactattggcttaaaattcctgaaattaaaattatagttctttgacatcgcttctgtctaatcattgctgatacctggaaaacaccaaatggcttacttacacagtgtcccactctgaaatttctcacataaaggattgtcttacacagaaatactgaccattttgacaagggaatggccctagaattgggccagagctaaaaataagcagaataaacaattttgatattcttcttcaatggtcataaatctagttagcatgttatcatttacatattatgattttgttcatgatagttgtagtagaatggcctaaagaaatcaagatctgttttatcttctacattactttagttactgtaagactgataactcacattgtcgtttaccaagtatttccatttgttccttggaataatcctgtgaagtgggtattttttatcactagtttcatataatgaatatattactgttaatgtcaatacattctatttatccagctcacttattctagtattctctctgcagtgattctttaatctcattgagaagcccccatgcccaatacacgcctcctatcttcatacacgcctcctatcttcatttccctccttccccaactcacacccttgaaaacattcttatctctcttgtttctttttctgttgtccttgactggcaaatttggaggcatggatgtacccaactctttgccatttggggctacccccaactagccaaatactgctagagaaactctcctgaatgatttcactctaagttctatgaacttcaaatgggcatttaaggatacctggcagtcctactatgttttcctaataaatttcattttcctctttcaaaattgttatttattctcccgtctcctccaacctcccatatccccacctccacactcactctctgctgctgatgacctcacttcatactttattgaaaaaaatagaagcctgcagaggagcaacactttcatactgctcccactgtatctaaaaatctctaagtttctgtgcctgtcttagtcagcttgggctgccataacaaaataccataaaatgagtggcttaaacaacagaaatttttcatctcatattttgaagactcaaaatgttggcatcgttggtacctggtgagggctctcttcctggcttgcagacagctgcctgctggctgggtcctcacattgtcttttcttggtgcatgcatgagggagagagtgctagtgtctcttcctcttcttataaagacaccagccctatcaaattaaggggtagctctatgacctcatttaaatagaattatctccctaaagaccttatcttctaatatagtcacatttgagactgtggcttcaacatgaattttggggagacagaattcagtccttcagagtgcctgtgtttttcatcttaccatatgttacaacagaaaaaaatgtccctgctctcatcaaaaatcagtaacccccagtatgttctggctcctgcccgtctcactttcttaacattactgaccccctcatctcttccttctcttacataactagggttatccttctcacaagcacacaaacacgctcctcccttgactccataatccctctccatctcccaactcatttttctaccccctgtaagcaccacttctctaacaaattatctaaaattactgcttccccttcctcaacaatctattccctcatcagaagacttaaaactggctaatgtagcttctgggactcagaaaatgaaagcccaaaatatgacacttcagacttcaaactgagagcacatggagagcagcaaatgcagagaaggactttccccaaaggtccctccctacctaaacacaggattctcctaagatactcaatcattgtcaatcgcttccccagggtatctcaatgactgggagaagactgaagcctatcccaggaaaagaagactagaattgatgacacaccaggagtccagatgggctttgtctcagactaccatctgttcttcaggcccattcatcttccctaaaactcatttactcctcctctaaattgtctgcatcccacccttccccctccctgtgaagaagggtatataagcttctaaatcccattgggtcattggacactcaccttcctggaatgcacgcatacacataatatatgtgttagccttttctctcgttaagtgatctgttagtttatttctcagactcaaatatcagacatgcagagtggaaagaaagggctctctcacccaacatggctcatctcaagctcatcaaaagcccccatgttccaaattcaatggacgcctcacttgtcttttttttttttttttttttttttgagacagaatcctgctctgtcacccaggctggagtgcagtggcatgatatcggctcactgcaacctccacctcccaggtttatgcgattctcctgcctcagcctcccgagtaactgggattacaggtgcgccaccgtgctcagctaatttttttatttttagtagagacagggtttcaccatgttgcccaggctggtcttgaactcctgacctcaagtgatccaccggcctcagcctcccaaagggctgggattacagaggtgagccactgtactgggccgcacttatcttacttgatctttcaagaacacctgacccagtcaactgctcctcttccctgaaaaccacatcacactctcctggttttctttctgcatccctggctgctccctctgcctctcctttgctggcttctgcttctctttcaagcctctaaatgtgggaataccctagaacttgctcctagatccccttttcttctccacctatctccagagctaagtgagctcattctactctctggctttgagtcctatctctctggcgatgacacccagattgatatgtgcagttctgacctctcccttgagctccagactcatttatatggtcgaaatgcccatctgacatttccaattggacgtctaatagtcttgtcaaatgtagcatatccaaaacataacctttgacttccctcttttccagtcttccccatctctatggatggtaatgaactgctcaagccaaacatttatcattcggattcctgtccttctcttctctcctatacccgggcttttgacgattcagccgtaaatccatctacttctctttatcggtacttctattgcctcattcaaggcacatcagctcttgtctggatggaagccatggccccataagtagtctttctgcttcaattgcctgactgccacacattctctatgcagctatcagagtactcttttaaaaacttaaatcatacttgtcatacatgacatattgtcatgcccttgctcagaacccttctgaggcttcacttattattagaataaaactcatcctcaccaaggcttgcatcctacaacataacctgacttagtaggtctatttcctcctttgctctctgtattggtccatttacattgctgtaaataaatgcctgagactgggtagttcatcaggaaaagaggtttatttggctcacagttctgcaggctgtacacaaagcatcgtgccagcatctgcttctggtgagggattcaggaagcttataatcatggcgggatgtaaaggagagccagcacatcacatggatagagagagagagagaggagacagtgccaggctttttgaaacaaccagatcttgtgtgaactcagagaataagaactcactcattactgccgagacattcatgagggatctgcccccatgacccaaacacctctcactaggcccacttctaacactgaagctcacatttcaacatgagatttggaggggacaaccatccaaaccctatcaccctccatgatccattctttctgcttctcaaatatgccatgtttagggctgctgttcctctgccttgagcgttcctgttagtgcttcaggtcttaactcgaatgtcaacccctcagagtgacttttgctactccctatggaatgctcacctcccacccccgccatcagcatttatttcgacttctttcctaccacttagcacagtgagctccaggagggcaggcttttgtctggcatgctccctgcacattctccagcaccaagcacagacctggcacacaatgaatgttcactgaaagaatgaagttgatctcagactctccacccagctccaggctgccaaaataagcccctaattgccttccctgcttctccttttgttcctgccccatctgtctcctagggagaattgtctcagctagaccagtcctgggctcttcacacatcagagttagagagttgacagggaattaatagaagatagaacctgaaaggcttaggaggggtaagacttggagaaatctgttgtcagtcaaaaataataaagtacagaggtgtatgtgaggaggtaggggagggagtacaggaaggggaaagaaatctatatagtccaggtgtaagtgagaaagttctttcagcatttgtcaaacttgagtttgggagagggtgtgggaaataaataactgagaagagtaaatgggattgcagcatagatgaggattctgaattagggccactctgtcacccaggctggagtacagtagtgcgatcaaagctcactgcagcctggagctcctggtctcaagcaatcctcccacctcagccttccaagtagctgggactacaggcatgtgccaccaaactcagctaatttttttttgcatttttttgcag

SEQ ID NO: 1733 - DNA, 10062 bp, Homo sapiens; identical to SEQ ID NO: 1732

SEQ ID NO: 1734 - DNA, 7702 bp, Homo sapiens
tgtggagcaacaggcagttttaatgaatgcctgaaggcagaccttcaggccatttcaggccgaggcctaaaatggcatcagccccaaatgaggacgggcaggggttttacagtctcccgtaaacaggaagtgtttcagtctgtgtatctactgctacgtgatacccggtaggcctctctctgggtcttcagaacagctctctccccgcttctgctatcttgctgacgcacgctgatgacgtaagccgccttgcgccttgggactgggcctgagaagggaggagttattcaggcctccgccagcttctaggccctggggatggtctttcacctccctctttctgatctctttttcatgctcctccttgctccaaagaaaagccggatggcaaaagagcccagaacctattggaactgacaaaatcaagtcacggcgcctacaaagatgaggggcagattctggctgccttttaatttcgtccttcacctgatatctgtgccagagaatgtcttccaggagttctgctacagagaagagagtaacccccatccatcatggccaaagcacccagtcaggctccgctctggatccagcccgacaaatgcaacccttgaatagggtttgtgcaagcaaactggatgacgaccgaagaaaccctgtcgcttctgagaagacacccaatccaagaatggtcttgctctgttgcctcaggctggagtgcagtggcgcaatcacagctcaatgcagccttgaactcctggactcaagcaattcttctgcctcaacctgccaagtagttgggactacacatgtgccatcacactcagcttttgtctgtgatccatgtggaaaccattcttctgtgtatagtgtaagggaaaccacctttgctttgacatatgtgtgtaaacggtattgtctgtcgaacgttgcctcgtgagtcataaaaagaaacatcccagcctctttgttaagagaagtgctgtcaagtaagtagtagagttatatgagtgagacagaaaataaaattccacctccaacaacctctgaaatgggaggtgggtcattcagacaccatttcttcatgaactgctgccctgttcctctacccagtccacagaggaaaggcaatagcagggcatttccttgtgtccttcaagctctccctggctctcctgtgcacgtgaaaagacacccacagaagctcaggggtgactgcagcccatactctgtagccctctacctgggccagctgccccggacaattgcacctgatagcttttccagagcagagcagccagagaggtgacaaagaatgaaagcactgaaaaatgtcaacctgggaagcaaatgtgaaacccatttccaaacagggaaggcaaggagaaaagcaagtcacatcagaacagagatgggggagaaacccctctgagtcttaaaagagaagggttgcaattaagatggaattaggaagtagaaaaagaagcagaatgcaagatttaagcccatttcaaagcttttcagaaaccagactcaaggcagctttaaagcattctgaatttttaaaatcagaacacatattcgtatcattacttcaaaaagcaaagacacaacagtgaaaaaccttttattgctcttggaagtaaaatctaatagccttcatctatttggagcatgaggtggaaaggaaagtggtaaaagggtaaaaatcaagtgttctagagttagggttagttttcttttttcaagctctagttcacactcatcttgaattttctgaagcctgtagttatgatcccattgtgaacatatacaacaaaaaatgtcaaataaaacattattacaactttcaatataagacagcagagagtaaacagtgcctgattttctctcttccagactatttacattcttacgaacagacacaagtctacacaaaatgacaagcgcacatttcggtggcaacagatcagctgcttcagaaatttatctggcttggggaagagatattattaacaaaagcaaatatggaaccactctgaggaattaccagcagctgatgtaaattttcacctcagaaacagaccaggtccagggagaaaaaaactagagaggttttgattctcctcccaccgtctgcctttcttttccaaagaatagagagcctgccccaactggaaaatcaggtagcttctcccacacaggaagggatctgctgcctgaggcagaaagggctgcttgggtgcctctgtccccagtgccccttcatttctgtcttcctacatcctcttgagattacatgttgattacattatattctattgtatcgtactacataatacagcaacactgaaagaatgaaaggaaacgggaaagggagtgaattggcctttgcaccctgaggataggaagagggtggtggatactgggacagcctggtggacccagccctcccagggttattagatgacatttgtcacgtaccattcctggcagcagcggcaggtcagggtgaccaggatcacctaggaatgcatgtacttctgacagtcatgaaaccaaggcatgagagcaagagatagttttggggtctggtatccaaaaattcaaattagtaaatttcatgttatgtgtattttatcacaattaaaaaaaaaaactcaaactttaaacattcagagatttgtttaaggggtatatggctctggtatccataatgctgtaaaaagggaaatcttttagtccctgaggtggacagcagcaagtcctaagtcctccaatctgataagcatagtgggacagaggactcctcacttgaggacatctaggtcgaaaacaaacaaaaaaaatcacaaaacttatgaaaatattctataatgtaggaggaggctattgctcttaaaatgcagagaaaaatcatacttttgaaaaacagttaactacaagaaacaggaaatctttagaaaacattcccttggtggactcaatgaaatataagaaaacacaaaataacaaatggaaagtgagatgtaaaaggctacttaaatgctttctgagatgtaaactgatacagtaaggttcaggctgagagaagaaaataattgtaaagaataaaaatgtaaccaatttactgtttttgatagagcacaacagagaagtgacacttcggaaaagtaattcagtaacatggaagacaaatttgagaagccatcccagaaagcagaggaaaaagacaaagccaaaatctgaaagagaaataaagttattaacttggggaggggatggtgaagaaaaggcagaataagaactatgcgagacagaaaacaaagattcacttcacaaaatagaggaaaaatgtctacaaagctttaagaataaaaagaaaaaaagggctgggagcggtggctcatgcctgtaatcctaacactttgggaggctgcagcaggtgaatcacctgaggtcaggagttcaagactggcctggtgtctaccaaaaaaaaaaaaaattagctgagcgtggtggcagatgctgcctgtattcccagctacttgggaggctgaggcaggagaattgctagaaccctgggggcagaggttgcagtgagccaagatagcgccattaccgactctgtctcaaaaaaaaaaaaaaaaagaaaaagagaaaaaataataaagctgtgatcaaataacagaatccatgtatgaaaaataagaattgtggccgggagcagtagcccatgcctgtaatcccagcactttcggaggccgagggggctggatcacgaggtcaggagttggagaccagcttggccaacatagtgaaaccccatctttactaaaaattagtaaaccctatctttataaaaattagctaggtgcagtggtgtgggcctgtaatcccagctactgaggaggcggaggcaggagaatcactggaacccaggaggcggaggttgcagtgagctaagattgcgccactgctctccagcctgggcaacgagagcaaaattccttctcaaaagaaaaaaaacaaaaagaattatgtccttaaaatacaaggaaagctttcatgaactaccaaaaaaaaaagtgccctcaaatatctaaagtttcatgactataatccatattccaatgctaaaaatattagacttatgcaaataaataccaagcttatgaccaagaaagaaataaagaacaaagaactgaagaaatgaggaggggatcatttaaaatgataaattccaagcaatgaaaagataatctaaatagtactaggttgttaagcaataactcaattcaaatcaaaaaataattttcataggaaaaagtgtataataaaataataattactaactaaaaagtccacccctttgccacatgaccccaaaaactatgtagattaatttaactaatattaaaatttaaaaaaaatttttttttgagatagagtctcactctgttgtccaggatagagtgcagtggagcgatcttggtgagatcatgttcaagtgattctcgtgcctcaacctcctgagtagctggcattacagacacccgccaccacatctggctaatttttgtatttttagtagagacaagagtttgaccatgttggctgggctggtctcaaactcctgacctcaagtgatctgcctgccttggcctcccaaagtgctgggattataggtgtgagccactgtgcctggcctagtttgaggatttctaattagccttaccaattagcaagtagaggccaaagtccttctgcagaggaaaaggaccacaggaaagggagagaaaggccattaagataaatagcaggcgaacctctataggaaaacagagacatgaaggtgaggtcccccgtctctggtaaactcatggttcaatcatcacagatgggccaatgaaacagacaccaactaaccaggacattcaaagaataacagcagttgctgtccaggacgtcacggccagccacacaatcccaaatcatcaccacagatgtttaaagccaaagtggacagctgccaccaaaaggtgccaaatcatagccaagacatggatgttcccatggaactccaaattagctagttacacaagcttgtgcgggccgtttcattaatctcccaataattcaacccctcatttctaatgattggatatttgggtactcacttatggcattatggcagggtttttattgttgttgttgttcttgttgttgttgttgttgtttttgagacagagtctcgctctgtcacccaggctggagtgcagtggcacaatctcggctcactgcaagctccgcctcctgggttcactccattctcccacctcagcctccctagtagctgggactacaggtgcccgccaccacgccaggctaattttttttttttttttttttttgttagagacagggtttcaccattcacaggatggtctcaatctcctcaccttttgatccacccatctcggcctccaaaagtgctgggattacaggcgtgagccattgcgcccggccggcagggttttattgagcttctttcataatcaaaatgaaattaatattatttaagaaaataatattttagaataaaatattcaaagtcttcacctaaatgactctgaagataaacaaaaagttctaaaatgtaattataaacagtttagaatgtatttttaaaaatctaaacatatatagaaactgaagaaatgagtccaaagctgcattcaatggaaaattcatagtattaaatatttttgttacaaaaaagaggaaaaataacataaataaatcaagtattcatttcaagatattaagttgaaaaaatagaatattttaaaagataaaagtaccacaaaggaaatagaacatgaaaatatatataaattgagaaataaatccaagagctggttatttaaagaacaagaaagccaatgaaaaactttgacaaagcttattagcaagagaaaggatccattgtaatggggtgatattttgaaaactactagtttattttctcttttgtctttctgagtatatgaccttaccctagaccacttgaaacatctttgcagggaggaagaagagattaagactttttcctgaaagaatgcaaaaagagaagataagcattattaccatgaggctcatgtgggaagatcagaccagctccagaaaaatgaagaaattacaatttctctatacaaccaagtagtatggtggattaaaacttgcacccctgctccataaataaccaaaatcataaatgataaaggggacataaaataaatcaaaacataaagaggcttttacaaacacagaatggtataaattttagaaagcttaataaaatgggccatattcagaattatgagttacctatattagcccaagaagtatgccaagtagaaaagaagtatgtcaaaagaaagtgaaaaattcatcaaagattacctctaaaaacgacctgagatcaaaccatttaatgagtacattctttccaactttccccaagggtcaaccctcgaatgtgtaatagccacaggactcgggaaaagatggaatgcttctcagctcatcaagaaagctaggctacctatagtacaccaacctgaatagaataaaactataggacactatttttctcaaaagcttttgttactccaggaggtcctagtgcctctaatatgctgtgaaattccaatgagggggtggcaggcagtggtgttcctcaattcagggtttatccagccacttccagacccttcttagagccgtgctagagcttcctggagttacaccatcagaagattaaggtggatccaagagccaagaatatagagaagcatacgcagaagaaaagggatttgcaagagataaaaagaggaaaagagaccgtatagcagattgcaatcataatagcaatgctaaggcaggaagcagtacattctgcttgtgaaaatgtaaattgattcagcccttcgaggaagcaactgacaatgtgacttagaatctaaagagtacatactctttgacttactaatctcaactcctgtctgtccatcttgggtaattaatttgaaatgaagataaagatttacatacaaggatgcatttcatagaattactgatggcaaacaaaataaaacagaaacaagaagcaacctaaatgtctgaaaatggaaactattaaatagattatggcatgttcagataataagttatgcaacaatccaaagcaatgtttttgtggggggaggggaatgtaatgacaggtataggtctaggatttttagaaaaaaggcagaacataaactgcaatgtataatctaagttatatttttgaaatatatgtatatagaaaagactactggaagaaatatagaccaaaaccaccttgaatatggtctctgagaggtaaggactctgaatgaataacattttcttttatacagttctattttctaactttctgcacaaagctgtattacttttacaatctgaaaaaaaaacaattactgcctatgaataaaaacacatgtgaatgataagaaaaaaaatttaagcctccagtcactaaggacaaaatcattcctagcacgcaaaacaaacctgaatcttaacaccggtgccctttaaagcatagaaaagaaaaagcaaaccaaccaaatccctccataaagacaggctg

SEQ ID NO: 1735 - DNA, 6276 bp, Homo sapiens
gggttttacagtctcccgtaaacaggaagtgtttcagtctgtgtatctactgctacgtgatacccggtaggcctctctctgggtcttcagaacagctctctccccgcttctgctatcttgctgacgcacgctgatgacgtaagccgccttgcgccttgggactgggcctgagaagggaggagttattcaggcctccgccagcttctaggccctggggatggtctttcacctccctctttctgatctctttttcatgctcctccttgctccaaagaaaagccggatggcaaaagagcccagaacctattggaactgacaaaatcaagtcacggcgcctacaaagatgaggggcagattctggctgccttttaatttcgtccttcacctgatatctgtgccagagaatggaacttggggcggcccctgtccagttcaaaccagctgagaccaccaaccctctgaatgcacctgcatggatgtcggaaaagtgacacttgccatcagagggccaaaactccaccctcagatcatgttaacactgctattttctgaccatgtgtcctaagaagagccgtgagcccagactgcacttgctcagatcaccagttacctcacttctccccaccctcaatcacctttccccaccttagaccatcctaattctttactccataaatatccctaagcattatccttgaggaggtagatttgagagctgttctcccatctcctggctgggttgccctgtgagtaaatcttttctcttttgcaaaacccattgtcaccatgactggcttactgtgtgcaggcagaatgaacctggtttggtgtcatatctacgagctcccagacaatgccagtcccactggactaagggtctcactttgagtaacaagttcttaaaagtctcctggatcaagttcttctgccctgaccgtctttttcataatagtctagagcaagacttcacacacaagaaatgttggactgtctcataggcagaagggtttgtgggaaaagcagtgagtccatttgaaagctacaaaagtaaagtgagctctcatcatgtcaccaataagtgttctgtttttaattttcagataaaaatcataataaaggaaataatggaagaggagacttatgttactggggacatctaacataattattttcctgattcagtggcatggttcagtcttccaggagttctgctacagagaagagagtaacccccatccatcatggccaaagcacccagtcaggctccgctctggatccagcccgacaaatgcaacccttgaatagggtttgtgcaagcaaactggatgacgaccgaagaaaccctgtcgcttctgagaagacacccaatccaagaatatacagtcgaatgtaatttggaatttacgagtcttatcacattctcattctgcttgagcaattcaagatataagaaaaacagactgtctacatttcttcagagttcctccaactattggcttaaaattcctgaaattaaaattatagttctttgacatcgcttctgtctaatcattgctgatacctggaaaacaccaaatggcttacttacacagtgtcccactctgaaatttctcacataaaggattgtcttacacagaaatactgaccattttgacaagggaatggccctagaattgggccagagctaaaaataagcagaataaacaattttgatattcttcttcaatggtcataaatctagttagcatgttatcatttacatattatgattttgttcatgatagttgtagtagaatggcctaaagaaatcaagatctgttttatcttctacattactttagttactgtaagactgataactcacattgtcgtttaccaagtatttccatttgttccttggaataatcctgtgaagtgggtattttttatcactagtttcatataatgaatatattactgttaatgtcaatacattctatttatccagctcacttattctagtattctctctgcagtgattctttaatctcattgagaagcccccatgcccaatacacgcctcctatcttcatacacgcctcctatcttcatttccctccttccccaactcacacccttgaaaacattcttatctctcttgtttctttttctgttgtccttgactggcaaatttggaggcatggatgtacccaactctttgccatttggggctacccccaactagccaaatactgctagagaaactctcctgaatgatttcactctaagttctatgaacttcaaatgggcatttaaggatacctggcagtcctactatgttttcctaataaatttcattttcctctttcaaaattgttatttattctcccgtctcctccaacctcccatatccccacctccacactcactctctgctgctgatgacctcacttcatactttattgaaaaaaatagaagcctgcagaggagcaacactttcatactgctcccactgtatctaaaaatctctaagtttctgtgcctgtcttagtcagcttgggctgccataacaaaataccataaaatgagtggcttaaacaacagaaatttttcatctcatattttgaagactcaaaatgttggcatcgttggtacctggtgagggctctcttcctggcttgcagacagctgcctgctggctgggtcctcacattgtcttttcttggtgcatgcatgagggagagagtgctagtgtctcttcctcttcttataaagacaccagccctatcaaattaaggggtagctctatgacctcatttaaatagaattatctccctaaagaccttatcttctaatatagtcacatttgagactgtggcttcaacatgaattttggggagacagaattcagtccttcagagtgcctgtgtttttcatcttaccatatgttacaacagaaaaaaatgtccctgctctcatcaaaaatcagtaacccccagtatgttctggctcctgcccgtctcactttcttaacattactgaccccctcatctcttccttctcttacataactagggttatccttctcacaagcacacaaacacgctcctcccttgactccataatccctctccatctcccaactcatttttctaccccctgtaagcaccacttctctaacaaattatctaaaattactgcttccccttcctcaacaatctattccctcatcagaagacttaaaactggctaatgtagcttctgggactcagaaaatgaaagcccaaaatatgacacttcagacttcaaactgagagcacatggagagcagcaaatgcagagaaggactttccccaaaggtccctccctacctaaacacaggattctcctaagatactcaatcattgtcaatcgcttccccagggtatctcaatgactgggagaagactgaagcctatcccaggaaaagaagactagaattgatgacacaccaggagtccagatgggctttgtctcagactaccatctgttcttcaggcccattcatcttccctaaaactcatttactcctcctctaaattgtctgcatcccacccttccccctccctgtgaagaagggtatataagcttctaaatcccattgggtcattggacactcaccttcctggaatgcacgcatacacataatatatgtgttagccttttctctcgttaagtgatctgttagtttatttctcagactcaaatatcagacatgcagagtggaaagaaagggctctctcacccaacatggctcatctcaagctcatcaaaagcccccatgttccaaattcaatggacgcctcacttgtcttttttttttttttttttttttttgagacagaatcctgctctgtcacccaggctggagtgcagtggcatgatatcggctcactgcaacctccacctcccaggtttatgcgattctcctgcctcagcctcccgagtaactgggattacaggtgcgccaccgtgctcagctaatttttttatttttagtagagacagggtttcaccatgttgcccaggctggtcttgaactcctgacctcaagtgatccaccggcctcagcctcccaaagggctgggattacagaggtgagccactgtactgggccgcacttatcttacttgatctttcaagaacacctgacccagtcaactgctcctcttccctgaaaaccacatcacactctcctggttttctttctgcatccctggctgctccctctgcctctcctttgctggcttctgcttctctttcaagcctctaaatgtgggaataccctagaacttgctcctagatccccttttcttctccacctatctccagagctaagtgagctcattctactctctggctttgagtcctatctctctggcgatgacacccagattgatatgtgcagttctgacctctcccttgagctccagactcatttatatggtcgaaatgcccatctgacatttccaattggacgtctaatagtcttgtcaaatgtagcatatccaaaacataacctttgacttccctcttttccagtcttccccatctctatggatggtaatgaactgctcaagccaaacatttatcattcggattcctgtccttctcttctctcctatacccgggcttttgacgattcagccgtaaatccatctacttctctttatcggtacttctattgcctcattcaaggcacatcagctcttgtctggatggaagccatggccccataagtagtctttctgcttcaattgcctgactgccacacattctctatgcagctatcagagtactcttttaaaaacttaaatcatacttgtcatacatgacatattgtcatgcccttgctcagaacccttctgaggcttcacttattattagaataaaactcatcctcaccaaggcttgcatcctacaacataacctgacttagtaggtctatttcctcctttgctctctgtattggtccatttacattgctgtaaataaatgcctgagactgggtagttcatcaggaaaagaggtttatttggctcacagttctgcaggctgtacacaaagcatcgtgccagcatctgcttctggtgagggattcaggaagcttataatcatggcgggatgtaaaggagagccagcacatcacatggatagagagagagagagaggagacagtgccaggctttttgaaacaaccagatcttgtgtgaactcagagaataagaactcactcattactgccgagacattcatgagggatctgcccccatgacccaaacacctctcactaggcccacttctaacactgaagctcacatttcaacatgagatttggaggggacaaccatccaaaccctatcaccctccatgatccattctttctgcttctcaaatatgccatgtttagggctgctgttcctctgccttgagcgttcctgttagtgcttcaggtcttaactcgaatgtcaacccctcagagtgacttttgctactccctatggaatgctcacctcccacccccgccatcagcatttatttcgacttctttcctaccacttagcacagtgagctccaggagggcaggcttttgtctggcatgctccctgcacattctccagcaccaagcacagacctggcacacaatgaatgttcactgaaagaatgaagttgatctcagactctccacccagctccaggctgccaaaataagcccctaattgccttccctgcttctccttttgttcctgccccatctgtctcctagggagaattgtctcagctagaccagtcctgggctcttcacacatcagagttagagagttgacagggaattaatagaagatagaacctgaaaggcttaggaggggtaagacttggagaaatctgttgtcagtcaaaaataataaagtacagaggtgtatgtgaggaggtaggggagggagtacaggaaggggaaagaaatctatatagtccaggtgtaagtgagaaagttctttcagcatttgtcaaacttgagtttgggagagggtgtgggaaataaataactgagaagagtaaatgggattgcagcatagatgaggattctgaattagggccactctgtcacccaggctggagtacagtagtgcgatcaaagctcactgcagcctggagctcctggtctcaagcaatcctcccacctcagccttccaagtagctgggactacaggcatgtgccaccaaactcagctaatttttttttgcatttttttgcag

SEQ ID NO: 1736 - DNA, 6276 bp, Homo sapiens; identical to SEQ ID NO: 1735

SEQ ID NO: 1737 - DNA, 5513 bp, Homo sapiens
aggtcccctttctgcaacagagagctttcttcattcacttattaaactttcactccgacctcaccctttgggtccatactccttaattctcttggtcttgggtgatacctcacaaggagagactgctacattgtggtgcattggtgagactgtaacagactcctttccaagtgtttggtgtctgagttttcagaaggtttgacatgcatttcttcatttaatgcttagaacagaccaccaccaataataacaactccacatcttatttttcagatggggaaactatgattcagaatgataacaattaatacaaagctgaagcaagattcaaatccaagtcttctgacttgaaatcctactttcttgccactttttaaactatttatctgatgttggcaattcatggcaatcagaggatggatgaagggctctggaggttttggttacagtcagggagcattagaaagaacaagtgtgcttagatgaggcgggaaagcccaggtacatgaaggaaaagaataatttgcctaagttgcctagtttaaaatcatttttaattggaaaggtatttttatcttcatttacagatgtggaaactaagattcagaatgattattcaaaaatcacatagctagtggcaacctcaaggattgaaaccaggtgtgtctatctctaaatatagtgataaaaagcatgcattttgggttgaactctgctctccacatagatcttggtccagcccgccccctaaccctggtgtcctcatgtgaaatgaggctaataattgccaggcctctgagcccaagccaagccatcacatcccctgtgacttgcacatatacgcccagatggcctgaagtaactgaagaatcacaaaagaagtgaatatgccctgccccaccttaactgatgacattccaccacaaaagaagtgtaaatggccagtccttgccttaagtgatgacattaccttgtgaaagtccttttcctggctcatcctggctcaaaaagcacccccactgagcaccttgcgacccccactcctgcctgccagagaacaacccccctttgactgtaattttcccttacctacccaaatcctataaattgccccacccctatctccctttgctgactctcttttcagactcagcccacctgcacccaggtgattaaaagctttattgctcacacaaagcctgtttggtggtctcttcacacggacacacatgaaatttggtgccgtgactcggatcgggggtcctcccttgggagatcaatcccctgtcctcctgttctttgctccgtgagaaagatccacctacgacctcaggtcctcagaccgaccagcccaacgaacatctcaccaattttaaatcaggacctaccagtctgccctgctcatacttgatctggatgagactgataccctgcgagacgcaacagaatcagctcctgggattgtgttagcagaatgacgggagtgtgagatccaccacatggcgaggcaccccaggaacctgttttcttcttgaagagcaaccgagaactatttccaagttatccttcactttgaggcaatggtcaggtggagtaaaacataaggaagaacatctttttggttcaaagcatgaaaaaaattgggacagcatggaggtgtctgatttctgcttgggctgaggattcaggagaagatgtgtggaacacagcctggacatgccccaacctggttgatgaattccaccccaagtagtggaagaaacacacctacaacatgagcagagaagatttttcttctgtactttccaggacttgaagctgctttgttttttggtcgctgggtggggaaggaggaacaatagtatagcttccagaagagagaagagagatatctcttgagtgtgaattaagcagtaccaagaggcctcaagctagctctctctcctgctttaaattctactgttaagagtttttctttaagtttaaaaccttgaaagctccatgatgctcctgagtagaacaataaagccattagtagtcaatggccgtctttaatatttttcttccatttcaattttagttctaattttatctgactcctaaaaatatgtttcatattctcatgagggctgggcccatatgtgtaaatggttgaaacatcttactttgttgactgaactagtctaaatagtcagtcaaattttttttttaggcaaaagtgaatttcatcaaattggttggcccacaatttcttaaattcatcattgattgattatctgtgatgtgccaatccctgtgcaagttcctagggcaacagaagtaaaaatccataatctctgtttccaggactctatcagtttgatagggacacaggcacataagcagacaatcataatgcagtggtagtagggatatgccactctcatccaggcagtgtattgatgaccatgtccttgagttcccaagtacattgaaaaaggtgtaataaggagatgctaaattagcaggtagtacttatatgaagttctactgtgtctactcctgtgccaggtgtttcggttgggaatgagtattgggtaagaggagaatagaagatggaaaggcagaaaacaccaactcagctgatatggttgggatgtttgtctcctctaaacctcacattgaaatgtaatccccagtgttagaggtggggcctagtgaaaggtattggatgaggggagtggatccttcatgaatggcttagtgtcatccccttggtgatgagtgagttctcgttctgttagtttacacaagatctggttacttaaaagggtgtggaacctccccctcctctctcttactccctctcaccatgtgacatgttggctccccttccccctcatcatgactgtaagcttcctgaagccctttccagaagcagaaaccggcaccatgcttcatgtacagtctgcagaaccgtgagccaattaaacctctttccttcataaagcacacagcttcagatatctctttgtaacaaagcaaaaactgactaacacatcacccattaaagagtttacaatttatttagaggaaataagatggaagtgtagggagttattagaaagcaagacaacctacaaatctgtaaagtataagcatcaaactttgtgaacaaagagtatgatgtaggtattgagaaaagaaaaagtgggatatagggtggaacagtctcagaaaagtcctcccaaaggacacaggtaagagaaagacatggaagaactggtccaacttacattggtagaatcagagggcttaggtcttttttttttttttttctttttttttttgagacagtttcactcttgctgcccaggctggagtgcaatggcacaatcttggctcactgcaacctctgcctcccgggttcaagtgattctcctgcctcgcctcccaagtagctgggattacaggcgcccgcaactacgcctggctaattttcgtatttttagtagagatggggtttcaccacgttggccagggtgctcttgaactcctgacatcaggtgatctgccctccttggcctcccaaagtgctgggactacaggcatgagccactgtgcctggctgggcctaggtcttctaagcagtggaaatggcagaggcaagtgtccagagctgggaataaggggatgttatgtgggtatcatagggatgggggcaggggacttcacaataagacaccagccagtctaaagttgagtttgtgtaggattttttactcatatattattgagggccatgcattgaactacatattatggataaataattaatacattcctgccatcttgaagtttataatctagtcctacaaagaaacttatcagagaggtttctctgaggcttagtgtgttgcggtctatgccttttcatttcatccttcaaatactgtctactcaatgaaatttacctggcctgttcagccaaaataatttataaaggcaataatagctaacattattaacactctcctagaccagtgtactgtactaactactttgcatgccttattcataataagttaaggtctcttatatttttcagtgtactatgcaccatgttatggtctttacaaagattacatagtgtaatctttacactaaactttgcaagggtgtactactattatccccattgtctctatgagaaagctgaggctctgcaaggttaaatgatttccccaaggttctcttaaacttcgtaggggaagatggaggatgcttagagagtggtatgaacaacattgtgtgcctcctgatgtgatacaatgtgcagcacatagcaccgcttttgaagtactgcatgcttgccaaaagaaaaattgaacataaactttcaagtttattgaaaatggagggtccaggagtagtgactcatgtctataatcccagaactttgggaggccaagccaggctgatcacttgggccaggagttcaagagcagcctagccaacatggtgaaaccctgtctctactaaaaatataaaaattagctgggcatggtggctcatgcctgtaatcccagctacttgggaggctgagacatgagaatcacttgagcctgggaggtggaggctgcagtgagctgagatcacgccattgcactccagcctgggcaacagagcaagactctatctcagaaaagaaaaaaaaatgagaaaagaaaatggagggataaaggattaagataaatgatgccacaaagaagtaaacagaaaaatttagaattttggagtgcagggactgcaggacaactgaccaaatttcttcaacatgtcaaatatatgtgtgtttgtgtgtgtttattctataaatataataaaaatatttttatataaaagtatattatatataaaagaaaatttggattggattaatgtaatgtttacagttatggtaatggctatgttaatgtaatgtaatgttaggccttgtttagttcctgatttgaacgaactaatttttaaaaaggcatttttttaataagtaggaaaatttgaatatggactggttattggagggtacagggaaatattctcaattttcttgggtgtgatcatggcactgtagttatgggagaaaatgctaatattttttagagatatgcacaaatgtgttgggaagtcacatcaaatgtgggatttgcttaaaaatatttagcaacaataactacaacagaaaagaataagtgatgcaaacatgatgaatgcttgctaattgttaaagctgggtgatgactacataaaggatcattgtattagtctctcaatcttcctgtgtttgaaattgttttaaataaagattcatttaaaatgcatggcttaaaatagccaatgaggctgaaaacagattctcttgtaccactgagcccagttctatgcacacagtaggtgcttaataggtgtattatgaattactagaattggagcatggaaaacagctacaggatgaatgaaaatcaccctgttct

SEQ ID NO: 1738 - DNA, 5593 bp, Homo sapiens
aggtcccctttctgcaacagagagctttcttcattcacttattaaactttcactccgacctcaccctttgggtccatactccttaattctcttggtcttgggtgatacctcacaaggagagactgctacattgtggtgcattggtgagactgtaacagactcctttccaagtgtttggtgtctgagttttcagaaggtttgacatgcatttcttcatttaatgcttagaacagaccaccaccaataataacaactccacatcttatttttcagatggggaaactatgattcagaatgataacaattaatacaaagctgaagcaagattcaaatccaagtcttctgacttgaaatcctactttcttgccactttttaaactatttatctgatgttggcaattcatggcaatcagaggatggatgaagggctctggaggttttggttacagtcagggagcattagaaagaacaagtgtgcttagatgaggcgggaaagcccaggtacatgaaggaaaagaataatttgcctaagttgcctagtttaaaatcatttttaattggaaaggtatttttatcttcatttacagatgtggaaactaagattcagaatgattattcaaaaatcacatagctagtggcaacctcaaggattgaaaccaggtgtgtctatctctaaatatagtgataaaaagcatgcattttgggttgaactctgctctccacatagatcttggtccagcccgccccctaaccctggtgtcctcatgtgaaatgaggctaataattgccaggcctctgagcccaagccaagccatcacatcccctgtgacttgcacatatacgcccagatggcctgaagtaactgaagaatcacaaaagaagtgaatatgccctgccccaccttaactgatgacattccaccacaaaagaagtgtaaatggccagtccttgccttaagtgatgacattaccttgtgaaagtccttttcctggctcatcctggctcaaaaagcacccccactgagcaccttgcgacccccactcctgcctgccagagaacaacccccctttgactgtaattttcccttacctacccaaatcctataaattgccccacccctatctccctttgctgactctcttttcagactcagcccacctgcacccaggtgattaaaagctttattgctcacacaaagcctgtttggtggtctcttcacacggacacacatgaaatttggtgccgtgactcggatcgggggtcctcccttgggagatcaatcccctgtcctcctgttctttgctccgtgagaaagatccacctacgacctcaggtcctcagaccgaccagcccaacgaacatctcaccaattttaaatcaggacctaccagtctgccctgctcatacttgatctggatgagactgataccctgcgagacgcaacagaatcagctcctgggattgtgttagcagaatgacgggagtgtgagatccaccacatggcgaggcaccccaggaacctgttttcttcttgaagagcaaccgagaactatttccaagttatccttcactttgagcggcagcagagaagccagaaccggaagacaccttgtagtctgagaccatggacacctcagcagttaatattgtagaccaggcaatggtcaggtggagtaaaacataaggaagaacatctttttggttcaaagcatgaaaaaaattgggacagcatggaggtgtctgatttctgcttgggctgaggattcaggagaagatgtgtggaacacagcctggacatgccccaacctggttgatgaattccaccccaagtagtggaagaaacacacctacaacatgagcagagaagatttttcttctgtactttccaggacttgaagctgctttgttttttggtcgctgggtggggaaggaggaacaatagtatagcttccagaagagagaagagagatatctcttgagtgtgaattaagcagtaccaagaggcctcaagctagctctctctcctgctttaaattctactgttaagagtttttctttaagtttaaaaccttgaaagctccatgatgctcctgagtagaacaataaagccattagtagtcaatggccgtctttaatatttttcttccatttcaattttagttctaattttatctgactcctaaaaatatgtttcatattctcatgagggctgggcccatatgtgtaaatggttgaaacatcttactttgttgactgaactagtctaaatagtcagtcaaattttttttttaggcaaaagtgaatttcatcaaattggttggcccacaatttcttaaattcatcattgattgattatctgtgatgtgccaatccctgtgcaagttcctagggcaacagaagtaaaaatccataatctctgtttccaggactctatcagtttgatagggacacaggcacataagcagacaatcataatgcagtggtagtagggatatgccactctcatccaggcagtgtattgatgaccatgtccttgagttcccaagtacattgaaaaaggtgtaataaggagatgctaaattagcaggtagtacttatatgaagttctactgtgtctactcctgtgccaggtgtttcggttgggaatgagtattgggtaagaggagaatagaagatggaaaggcagaaaacaccaactcagctgatatggttgggatgtttgtctcctctaaacctcacattgaaatgtaatccccagtgttagaggtggggcctagtgaaaggtattggatgaggggagtggatccttcatgaatggcttagtgtcatccccttggtgatgagtgagttctcgttctgttagtttacacaagatctggttacttaaaagggtgtggaacctccccctcctctctcttactccctctcaccatgtgacatgttggctccccttccccctcatcatgactgtaagcttcctgaagccctttccagaagcagaaaccggcaccatgcttcatgtacagtctgcagaaccgtgagccaattaaacctctttccttcataaagcacacagcttcagatatctctttgtaacaaagcaaaaactgactaacacatcacccattaaagagtttacaatttatttagaggaaataagatggaagtgtagggagttattagaaagcaagacaacctacaaatctgtaaagtataagcatcaaactttgtgaacaaagagtatgatgtaggtattgagaaaagaaaaagtgggatatagggtggaacagtctcagaaaagtcctcccaaaggacacaggtaagagaaagacatggaagaactggtccaacttacattggtagaatcagagggcttaggtcttttttttttttttttctttttttttttgagacagtttcactcttgctgcccaggctggagtgcaatggcacaatcttggctcactgcaacctctgcctcccgggttcaagtgattctcctgcctcgcctcccaagtagctgggattacaggcgcccgcaactacgcctggctaattttcgtatttttagtagagatggggtttcaccacgttggccagggtgctcttgaactcctgacatcaggtgatctgccctccttggcctcccaaagtgctgggactacaggcatgagccactgtgcctggctgggcctaggtcttctaagcagtggaaatggcagaggcaagtgtccagagctgggaataaggggatgttatgtgggtatcatagggatgggggcaggggacttcacaataagacaccagccagtctaaagttgagtttgtgtaggattttttactcatatattattgagggccatgcattgaactacatattatggataaataattaatacattcctgccatcttgaagtttataatctagtcctacaaagaaacttatcagagaggtttctctgaggcttagtgtgttgcggtctatgccttttcatttcatccttcaaatactgtctactcaatgaaatttacctggcctgttcagccaaaataatttataaaggcaataatagctaacattattaacactctcctagaccagtgtactgtactaactactttgcatgccttattcataataagttaaggtctcttatatttttcagtgtactatgcaccatgttatggtctttacaaagattacatagtgtaatctttacactaaactttgcaagggtgtactactattatccccattgtctctatgagaaagctgaggctctgcaaggttaaatgatttccccaaggttctcttaaacttcgtaggggaagatggaggatgcttagagagtggtatgaacaacattgtgtgcctcctgatgtgatacaatgtgcagcacatagcaccgcttttgaagtactgcatgcttgccaaaagaaaaattgaacataaactttcaagtttattgaaaatggagggtccaggagtagtgactcatgtctataatcccagaactttgggaggccaagccaggctgatcacttgggccaggagttcaagagcagcctagccaacatggtgaaaccctgtctctactaaaaatataaaaattagctgggcatggtggctcatgcctgtaatcccagctacttgggaggctgagacatgagaatcacttgagcctgggaggtggaggctgcagtgagctgagatcacgccattgcactccagcctgggcaacagagcaagactctatctcagaaaagaaaaaaaaatgagaaaagaaaatggagggataaaggattaagataaatgatgccacaaagaagtaaacagaaaaatttagaattttggagtgcagggactgcaggacaactgaccaaatttcttcaacatgtcaaatatatgtgtgtttgtgtgtgtttattctataaatataataaaaatatttttatataaaagtatattatatataaaagaaaatttggattggattaatgtaatgtttacagttatggtaatggctatgttaatgtaatgtaatgttaggccttgtttagttcctgatttgaacgaactaatttttaaaaaggcatttttttaataagtaggaaaatttgaatatggactggttattggagggtacagggaaatattctcaattttcttgggtgtgatcatggcactgtagttatgggagaaaatgctaatattttttagagatatgcacaaatgtgttgggaagtcacatcaaatgtgggatttgcttaaaaatatttagcaacaataactacaacagaaaagaataagtgatgcaaacatgatgaatgcttgctaattgttaaagctgggtgatgactacataaaggatcattgtattagtctctcaatcttcctgtgtttgaaattgttttaaataaagattcatttaaaatgcatggcttaaaatagccaatgaggctgaaaacagattctcttgtaccactgagcccagttctatgcacacagtaggtgcttaataggtgtattatgaattactagaattggagcatggaaaacagctacaggatgaatgaaaatcaccctgttct

SEQ ID NO: 1739 - DNA, 5362 bp, Homo sapiens
aggtcccctttctgcaacagagagctttcttcattcacttattaaactttcactccgacctcaccctttgggtccatactccttaattctcttggtcttgggtgatacctcacaaggagagactgctacattgtggtgcattggtgagactgtaacagactcctttccaagtgtttggtgtctgagttttcagaaggtttgacatgcatttcttcatttaatgcttagaacagaccaccaccaataataacaactccacatcttatttttcagatggggaaactatgattcagaatgataacaattaatacaaagctgaagcaagattcaaatccaagtcttctgacttgaaatcctactttcttgccactttttaaactatttatctgatgttggcaattcatggcaatcagaggatggatgaagggctctggaggttttggttacagtcagggagcattagaaagaacaagtgtgcttagatgaggcgggaaagcccaggtacatgaaggaaaagaataatttgcctaagttgcctagtttaaaatcatttttaattggaaaggtatttttatcttcatttacagatgtggaaactaagattcagaatgattattcaaaaatcacatagctagtggcaacctcaaggattgaaaccaggtgtgtctatctctaaatatagtgataaaaagcatgcattttgggttgaactctgctctccacatagatcttggtccagcccgccccctaaccctggtgtcctcatgtgaaatgaggctaataattgccaggcctctgagcccaagccaagccatcacatcccctgtgacttgcacatatacgcccagatggcctgaagtaactgaagaatcacaaaagaagtgaatatgccctgccccaccttaactgatgacattccaccacaaaagaagtgtaaatggccagtccttgccttaagtgatgacattaccttgtgaaagtccttttcctggctcatcctggctcaaaaagcacccccactgagcaccttgcgacccccactcctgcctgccagagaacaacccccctttgactgtaattttcccttacctacccaaatcctataaattgccccacccctatctccctttgctgactctcttttcagactcagcccacctgcacccaggtgattaaaagctttattgctcacacaaagcctgtttggtggtctcttcacacggacacacatgaaatttggtgccgtgactcggatcgggggtcctcccttgggagatcaatcccctgtcctcctgttctttgctccgtgagaaagatccacctacgacctcaggtcctcagaccgaccagcccaacgaacatctcaccaattttaaatcaggacctaccagtctgccctgctcatacttgatctggatgagactgataccctgcgagacgcaacagaatcagctcctgggattgtgttagcagaatgacgggagtgtgagatccaccacatggcgaggcaccccaggaacctgttttcttcttgaagagcaaccgagaactatttccaagttatccttcactttgagcggcagcagagaagccagaaccggaagacaccttgtagtctgagaccatggacacctcagcagttaatattgtagaccaggcaatggtcaggtggagtaaaacataaggaagaacatctttttggttcaaagcatgaaaaaaattgggtaacacaccttccttacatctagctgggccattgaaccagaatatgccaatgtttaaaacactgaaatgccagcttttctcttaaaggacagcatggaggtgtctgatttctgcttgggctgaggattcaggagaagatgtgtggaacacagcctggacatgccccaacctggttgatgaattccaccccaagtagtggaagaaacacacctacaacatgagcagagaagatttttcttctgtactttccaggacttgaagctgctttgttttttggtcgctgggtggggaaggaggaacaatagtatagcttccagaagagagaagagagatatctcttgagtgtgaattaagcagtaccaagaggcctcaagctagctctctctcctgctttaaattctactgttaagagtttttctttaagtttaaaaccttgaaagctccatgatgctcctgagtagaacaataaagccattagtagtcaatggccgtctttaatatttttcttccatttcaattttagttctaattttatctgactcctaaaaatatgtttcatattctcatgagggctgggcccatatgtgtaaatggttgaaacatcttactttgttgactgaactagtctaaatagtcagtcaaattttttttttaggcaaaagtgaatttcatcaaattggttggcccacaatttcttaaattcatcattgattgattatctgtgatgtgccaatccctgtgcaagttcctagggcaacagaagtaaaaatccataatctctgtttccaggactctatcagtttgatagggacacaggcacataagcagacaatcataatgcagtggtagtagggatatgccactctcatccaggcagtgtattgatgaccatgtccttgagttcccaagtacattgaaaaaggtgtaataaggagatgctaaattagcaggtagtacttatatgaagttctactgtgtctactcctgtgccaggtgtttcggttgggaatgagtattgggtaagaggagaatagaagatggaaaggcagaaaacaccaactcagctgatatggttgggatgtttgtctcctctaaacctcacattgaaatgtaatccccagtgttagaggtggggcctagtgaaaggtattggatgaggggagtggatccttcatgaatggcttagtgtcatccccttggtgatgagtgagttctcgttctgttagtttacacaagatctggttacttaaaagggtgtggaacctccccctcctctctcttactccctctcaccatgtgacatgttggctccccttccccctcatcatgactgtaagcttcctgaagccctttccagaagcagaaaccggcaccatgcttcatgtacagtctgcagaaccgtgagccaattaaacctctttccttcataaagcacacagcttcagatatctctttgtaacaaagcaaaaactgactaacacatcacccattaaagagtttacaatttatttagaggaaataagatggaagtgtagggagttattagaaagcaagacaacctacaaatctgtaaagtataagcatcaaactttgtgaacaaagagtatgatgtaggtattgagaaaagaaaaagtgggatatagggtggaacagtctcagaaaagtcctcccaaaggacacaggtaagagaaagacatggaagaactggtccaacttacattggtagaatcagagggcttaggtcttctaagcagtggaaatggcagaggcaagtgtccagagctgggaataaggggatgttatgtgggtatcatagggatgggggcaggggacttcacaataagacaccagccagtctaaagttgagtttgtgtaggattttttactcatatattattgagggccatgcattgaactacatattatggataaataattaatacattcctgccatcttgaagtttataatctagtcctacaaagaaacttatcagagaggtttctctgaggcttagtgtgttgcggtctatgccttttcatttcatccttcaaatactgtctactcaatgaaatttacctggcctgttcagccaaaataatttataaaggcaataatagctaacattattaacactctcctagaccagtgtactgtactaactactttgcatgccttattcataataagttaaggtctcttatatttttcagtgtactatgcaccatgttatggtctttacaaagattacatagtgtaatctttacactaaactttgcaagggtgtactactattatccccattgtctctatgagaaagctgaggctctgcaaggttaaatgatttccccaaggttctcttaaacttcgtaggggaagatggaggatgcttagagagtggtatgaacaacattgtgtgcctcctgatgtgatacaatgtgcagcacatagcaccgcttttgaagtactgcatgcttgccaaaagaaaaattgaacataaactttcaagtttattgaaaatggagggtccaggagtagtgactcatgtctataatcccagaactttgggaggccaagccaggctgatcacttgggccaggagttcaagagcagcctagccaacatggtgaaaccctgtctctactaaaaatataaaaattagctgggcatggtggctcatgcctgtaatcccagctacttgggaggctgagacatgagaatcacttgagcctgggaggtggaggctgcagtgagctgagatcacgccattgcactccagcctgggcaacagagcaagactctatctcagaaaagaaaaaaaaatgagaaaagaaaatggagggataaaggattaagataaatgatgccacaaagaagtaaacagaaaaatttagaattttggagtgcagggactgcaggacaactgaccaaatttcttcaacatgtcaaatatatgtgtgtttgtgtgtgtttattctataaatataataaaaatatttttatataaaagtatattatatataaaagaaaatttggattggattaatgtaatgtttacagttatggtaatggctatgttaatgtaatgtaatgttaggccttgtttagttcctgatttgaacgaactaatttttaaaaaggcatttttttaataagtaggaaaatttgaatatggactggttattggagggtacagggaaatattctcaattttcttgggtgtgatcatggcactgtagttatgggagaaaatgctaatattttttagagatatgcacaaatgtgttgggaagtcacatcaaatgtgggatttgcttaaaaatatttagcaacaataactacaacagaaaagaataagtgatgcaaacatgatgaatgcttgctaattgttaaagctgggtgatgactacataaaggatcattgtattagtctctcaatcttcctgtgtttgaaattgttttaaataaagattcatttaaaatgcatggcttaaaatagccaatgaggctgaaaacagattctcttgtaccactgagcccagttctatgcacacagtaggtgcttaataggtgtattatgaattactagaattggagcatggaaaacagctacaggatgaatgaaaatcaccctgttct

SEQ ID NO: 1740 - DNA, 5517 bp, Homo sapiens
aggtcccctttctgcaacagagagctttcttcattcacttattaaactttcactccgacctcaccctttgggtccatactccttaattctcttggtcttgggtgatacctcacaaggagagactgctacattgtggtgcattggtgagactgtaacagactcctttccaagtgtttggtgtctgagttttcagaaggtttgacatgcatttcttcatttaatgcttagaacagaccaccaccaataataacaactccacatcttatttttcagatggggaaactatgattcagaatgataacaattaatacaaagctgaagcaagattcaaatccaagtcttctgacttgaaatcctactttcttgccactttttaaactatttatctgatgttggcaattcatggcaatcagaggatggatgaagggctctggaggttttggttacagtcagggagcattagaaagaacaagtgtgcttagatgaggcgggaaagcccaggtacatgaaggaaaagaataatttgcctaagttgcctagtttaaaatcatttttaattggaaaggtatttttatcttcatttacagatgtggaaactaagattcagaatgattattcaaaaatcacatagctagtggcaacctcaaggattgaaaccaggtgtgtctatctctaaatatagtgataaaaagcatgcattttgggttgaactctgctctccacatagatcttggtccagcccgccccctaaccctggtgtcctcatgtgaaatgaggctaataattgccaggcctctgagcccaagccaagccatcacatcccctgtgacttgcacatatacgcccagatggcctgaagtaactgaagaatcacaaaagaagtgaatatgccctgccccaccttaactgatgacattccaccacaaaagaagtgtaaatggccagtccttgccttaagtgatgacattaccttgtgaaagtccttttcctggctcatcctggctcaaaaagcacccccactgagcaccttgcgacccccactcctgcctgccagagaacaacccccctttgactgtaattttcccttacctacccaaatcctataaattgccccacccctatctccctttgctgactctcttttcagactcagcccacctgcacccaggtgattaaaagctttattgctcacacaaagcctgtttggtggtctcttcacacggacacacatgaaatttggtgccgtgactcggatcgggggtcctcccttgggagatcaatcccctgtcctcctgttctttgctccgtgagaaagatccacctacgacctcaggtcctcagaccgaccagcccaacgaacatctcaccaattttaaatcaggacctaccagtctgccctgctcatacttgatctggatgagactgataccctgcgagacgcaacagaatcagctcctgggattgtgttagcagaatgacgggagtgtgagatccaccacatggcgaggcaccccaggaacctgttttcttcttgaagagcaaccgagaactatttccaagttatccttcactttgagccaggcaatggtcaggtggagtaaaacataaggaagaacatctttttggttcaaagcatgaaaaaaattgggacagcatggaggtgtctgatttctgcttgggctgaggattcaggagaagatgtgtggaacacagcctggacatgccccaacctggttgatgaattccaccccaagtagtggaagaaacacacctacaacatgagcagagaagatttttcttctgtactttccaggacttgaagctgctttgttttttggtcgctgggtggggaaggaggaacaatagtatagcttccagaagagagaagagagatatctcttgagtgtgaattaagcagtaccaagaggcctcaagctagctctctctcctgctttaaattctactgttaagagtttttctttaagtttaaaaccttgaaagctccatgatgctcctgagtagaacaataaagccattagtagtcaatggccgtctttaatatttttcttccatttcaattttagttctaattttatctgactcctaaaaatatgtttcatattctcatgagggctgggcccatatgtgtaaatggttgaaacatcttactttgttgactgaactagtctaaatagtcagtcaaattttttttttaggcaaaagtgaatttcatcaaattggttggcccacaatttcttaaattcatcattgattgattatctgtgatgtgccaatccctgtgcaagttcctagggcaacagaagtaaaaatccataatctctgtttccaggactctatcagtttgatagggacacaggcacataagcagacaatcataatgcagtggtagtagggatatgccactctcatccaggcagtgtattgatgaccatgtccttgagttcccaagtacattgaaaaaggtgtaataaggagatgctaaattagcaggtagtacttatatgaagttctactgtgtctactcctgtgccaggtgtttcggttgggaatgagtattgggtaagaggagaatagaagatggaaaggcagaaaacaccaactcagctgatatggttgggatgtttgtctcctctaaacctcacattgaaatgtaatccccagtgttagaggtggggcctagtgaaaggtattggatgaggggagtggatccttcatgaatggcttagtgtcatccccttggtgatgagtgagttctcgttctgttagtttacacaagatctggttacttaaaagggtgtggaacctccccctcctctctcttactccctctcaccatgtgacatgttggctccccttccccctcatcatgactgtaagcttcctgaagccctttccagaagcagaaaccggcaccatgcttcatgtacagtctgcagaaccgtgagccaattaaacctctttccttcataaagcacacagcttcagatatctctttgtaacaaagcaaaaactgactaacacatcacccattaaagagtttacaatttatttagaggaaataagatggaagtgtagggagttattagaaagcaagacaacctacaaatctgtaaagtataagcatcaaactttgtgaacaaagagtatgatgtaggtattgagaaaagaaaaagtgggatatagggtggaacagtctcagaaaagtcctcccaaaggacacaggtaagagaaagacatggaagaactggtccaacttacattggtagaatcagagggcttaggtcttttttttttttttttctttttttttttgagacagtttcactcttgctgcccaggctggagtgcaatggcacaatcttggctcactgcaacctctgcctcccgggttcaagtgattctcctgcctcgcctcccaagtagctgggattacaggcgcccgcaactacgcctggctaattttcgtatttttagtagagatggggtttcaccacgttggccagggtgctcttgaactcctgacatcaggtgatctgccctccttggcctcccaaagtgctgggactacaggcatgagccactgtgcctggctgggcctaggtcttctaagcagtggaaatggcagaggcaagtgtccagagctgggaataaggggatgttatgtgggtatcatagggatgggggcaggggacttcacaataagacaccagccagtctaaagttgagtttgtgtaggattttttactcatatattattgagggccatgcattgaactacatattatggataaataattaatacattcctgccatcttgaagtttataatctagtcctacaaagaaacttatcagagaggtttctctgaggcttagtgtgttgcggtctatgccttttcatttcatccttcaaatactgtctactcaatgaaatttacctggcctgttcagccaaaataatttataaaggcaataatagctaacattattaacactctcctagaccagtgtactgtactaactactttgcatgccttattcataataagttaaggtctcttatatttttcagtgtactatgcaccatgttatggtctttacaaagattacatagtgtaatctttacactaaactttgcaagggtgtactactattatccccattgtctctatgagaaagctgaggctctgcaaggttaaatgatttccccaaggttctcttaaacttcgtaggggaagatggaggatgcttagagagtggtatgaacaacattgtgtgcctcctgatgtgatacaatgtgcagcacatagcaccgcttttgaagtactgcatgcttgccaaaagaaaaattgaacataaactttcaagtttattgaaaatggagggtccaggagtagtgactcatgtctataatcccagaactttgggaggccaagccaggctgatcacttgggccaggagttcaagagcagcctagccaacatggtgaaaccctgtctctactaaaaatataaaaattagctgggcatggtggctcatgcctgtaatcccagctacttgggaggctgagacatgagaatcacttgagcctgggaggtggaggctgcagtgagctgagatcacgccattgcactccagcctgggcaacagagcaagactctatctcagaaaagaaaaaaaaatgagaaaagaaaatggagggataaaggattaagataaatgatgccacaaagaagtaaacagaaaaatttagaattttggagtgcagggactgcaggacaactgaccaaatttcttcaacatgtcaaatatatgtgtgtttgtgtgtgtttattctataaatataataaaaatatttttatataaaagtatattatatataaaagaaaatttggattggattaatgtaatgtttacagttatggtaatggctatgttaatgtaatgtaatgttaggccttgtttagttcctgatttgaacgaactaatttttaaaaaggcatttttttaataagtaggaaaatttgaatatggactggttattggagggtacagggaaatattctcaattttcttgggtgtgatcatggcactgtagttatgggagaaaatgctaatattttttagagatatgcacaaatgtgttgggaagtcacatcaaatgtgggatttgcttaaaaatatttagcaacaataactacaacagaaaagaataagtgatgcaaacatgatgaatgcttgctaattgttaaagctgggtgatgactacataaaggatcattgtattagtctctcaatcttcctgtgtttgaaattgttttaaataaagattcatttaaaatgcatggcttaaaatagccaatgaggctgaaaacagattctcttgtaccactgagcccagttctatgcacacagtaggtgcttaataggtgtattatgaattactagaattggagcatggaaaacagctacaggatgaatgaaaatcaccctgttct

SEQ ID NO: 1741 - DNA, 1470 bp, Homo sapiens
acgcgggcggcctactgtcgggtgtggccgcgaggggcggcctatataagctcttgctcgcggcttcagcgccctttctccccgccgcattcccggtgtcgacttactagctgcaagcctctgcctgccttcctgcgcgccgttccccgctagtcgctgctgctggcgcgcactcgccgggtttttcctcccacggcctcgagatggtggtgaatgtggcacggaggagccgggccttccaacccggtgggcccgagctccgaaaggccccctcggcagtgagaggggcgggagcccgcgggggccgcgcccttctctcgcttcggactgcgcaacgctgcgctctgggctgacaggcggataaaacggtcccatcaagactgagaaaaagcacaccagctattggcacagcgtgggcagtggggcctacaggatgactgacttagtctacagagatcccggcgtacttaagcagatgaagactcttaagatgacagaaggtgatttttctggtgatcgaggacttccggggtaatgacagtgatgaaatgcaggggacctggtaggtttcttttggagactaactgggggctgcctggtgggacagaacagcatgtttccaagggctgtggctggtcatagccatgggatctccaactgcatgcaagagcaacctggaaagactttgacagcgcaggttggctagatgggtctcgaacttctgacctcgggtgatccgcccgactcggcctccccttccaaagtgctgggattacaggcatgagccaccgctcctggccagtttagttttcacgctaagctttttgttctgcaggttgcccccaagtttcctggcagtgtgtgatactgaggaggtgagcttgtttctggagctgtgctttaaggtaaagttgatcagcttaatcctcctgatccctttcccatcggatctgaacactggtcttggtggtcgtaaaaggaggaaaagtaatagtgaagctggcctaaatgttgtaatctggtatatggcatgtgggctagtttcagacaggtttcagagatggttggatctctgaaattgtaaaatgaagtataatcttaggctaagggaaggatgcgtgtgaagctctggaggttggtatagtaatagctgacctattactgcatttgggagggatctgtcatagcttccttgcctcttaattaagggtggtgtttttttcttttagattcatgttacatgtaaagctgtcctcatttgtgactatggacctatggagttgggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagtatatttgtgtttgtatttttttgtagagaccgaactggtctctt

SEQ ID NO: 1742 - DNA, 1813 bp, Homo sapiens
cggcgcacgtgacccggcgttgctaggaaacgggagtggggcctgcggggacgcggctggagcctgcgcatttcttccttcctgctttcaaagttgcaatgagcgcagagcggtgcgcccgagggggttgaagcgttgaaagtgtgttacccagattttatctgagttaaacacgggccggccgctgtggctcacgtctgtactcccagagccttgggaggtcgaggcgggaagatcgcttgagcccgggagctcgagaccagacgcggcaacatggcgagacgcacatctctgcctttaaaaatgtggcgcgtttaccctattttaaaaaagttttaagttttagccaaccgggatcagcttagattgtgggcgtccaaccccagccaacagggaaaggacagaggaacagaagctcccttcctttgtcccgtgtgctctggagattgcatcccacgcaggcagcccccttccgtacaagagaggctggcggttacctttcttggggagacgcgtccgactgcttcattgtgggggcctcaggagcggaggatcgggtcccgcccgaggtgacgcgtaaacccagactctcagcaacgcgggtaggaaggacccttgaagttccgcggcgaccacgtcggctgaaaccagcagcccaggacaagtggaccagccagcaagacccagaccatccaaaccggctgatcctacgacaggacccagatgccagtgaaagtgaccacagccctgctctagtcaccccggaagctgaccagtctacgcacggccgaagcttcgtcaaggaagtaaatgtagttagaaatcttaagcccagtaattttccttgtcatcttaattgttttactattaacctgtcgctttgctcaaccccctcctctgggcaaacatctcttgtccatcctaggtacaaacatgctactcttccctttgttcttgctgctctcgctagatctatgtcagaaggagggatatgcggagagtttaatttaactaattgttgcctaaaaatcgatgacaatgaggaggacgtcatgaattaattgcgagaatgcgagacttagctcatgttccaacacaaacctggaaaccggaatggtctccaggttccccccgcccccccgtggttggttttcatccctcgggggatttaaaaccttactaggagtagttctggccatactgggagtccgcctcgtactcttgtctcttcccctccttgtcaagaatatcgacaaagccagagacgctcgtgtggacaggccgagtaccaccgagctcatcccataactacgtgtccacccctgccaggaaaagagctacttccccctgtagaagtaaataaaaaatagtgatgctttctattaaaccttatttataaaaagcatcaaggagggaataaagcggaaattgaagaaacggaaaatacctttttcgtataaagctgactcgccccaaagccagcaacaggcaaagcccccaggcaaggccttgaaaacaccatttaaaaagccagaaccccaaggaatgccgcccagacgcctcccagcactgcactccccccgtgcaaagataagaaccagactcctccttccgtttcccgctccccgtaaaatactctgccagttttgtaagctcctgttctttctcaatgcggccgcaagctcacaagctcggctgaggttacgaaacctgtcactgtacgattaactgcctctgtcctgcgtctgtaaattcactttcccgcactgcaagtttcacgccgctgcacgcttcaaagtcaagccctttgttc

SEQ ID NO: 1743 - DNA, 1813 bp, Homo sapiens; identical to SEQ ID NO: 1742

SEQ ID NO: 1744 - DNA, 1813 bp, Homo sapiens; identical to SEQ ID NO: 1742

SEQ ID NO: 1745 - DNA, 2859 bp, Homo sapiens
tgaggctcagagaggggaagcgcccaaggtcacacagctgggatgtggcagagctggggttccagctcctgttcccattgctggacagctgccacatctggcacccaatttaggaccccgcggggaggcccaagccccgggggtggcgggggatcctagaggaaagtggcaaggccaggaccctggagcagagccagagtagaaaactgaggctctgagagatgaagctacttgccaaggtcacgcagcacagtcacatcctactgaacatcatcctgttctctgggtggaatgtcaccatcgcccaggtggggatttttgtgtgttttgttcactgctgtacacccagcccccagcacagcgcctgtccaggacaagtgcccagtaaacacttgggaagcaatgcaagcgtcctcccagcagctcctgcaaacagacccccgacccaagcccttccttctgcctccactgccaccactgctgctcatctctgctggcacagaagtctcttccctggtcttccagaaatcccctctccacactcagccagagggagctattaaaactgtgggccagcccacatcagtccacagcaaagtcctctctaagggatctctgttgcttggagaataaaccctcggattccttccttggctctcggggcctcctctctgacctccctctgtctcctctcccagccttcctcctcactcaccctccagccatgctggcttcctccttgctcctgaaacagcctgaggcccacactgccccgggccctttgcactggctgtttcctctgcctggaacacttctcctaggcatccacagggctccctcccacaactccttcgggtgcccacatgggaagccatccctgaccacccccccgacttccttctgagcaaggtagggtctttctacctagtcatgagggcagggatttttgtctgttgtgttctctgtgtgcccccagtgccatcccagtgcctggcagatggtaagtgctcgacacacattggctgactgcctgaatgaacaactctatgagccgatggcagataaggacactgaggtcctctggggtaggtgaccagcccaaggccacacagctggtctgagattaggccaggagaggagcccgggttggtcacatcctggagttggcgtcttggaaactgcatcaggagaataacaaagatgagacgcaggctctaacaagtggataccagtgactctcgccccgccagccccagccctgcagccttgggcccttccaggagtcatggtctgcctgcctggggcattccaggcttcgacccaggtcctgcactttctattttgagcctcttagtcctgaggactgtgtgttcccagcaggcggcgcgggccagaggctgagcctgggtgtggctgtcaccctatctggggccagagacccagattcccgggcccttaacctgttggctgctgagggctctggcataagccctgttccctgcttgattgtctccccttcaagcccctgccctggtatcgtatcggcccatctcaccttggattatatccctgtttggccccatttgaatcctggctctgcccctttccagcaatgtgaccttgggcaagtcacttcatctctctgggtctcagtttcttcatctgggaaatggggacaataagagtacctgtctctggccatgtgtggtgactcatgcctgtaaccccagcgctttgggaagccgaggcgagagaattgcttgagaccaggagtttgagatcagccctgggcaacatagtgagacccctgtctctacaaaattctaaaaaaattagccgggtgtggtggtgtgtgcctgtagtcccagctattctagaggctgaggcgggaggattgcttgagcccaggagtttgaggctgcagtgagctatgattatgcccctgcacatcagcctgggtgatagattgaggccccatctctaaaaataacaatactaataataaataaaaatgaaaatgagtacctgtcttctggggttgcagaggagattcaatgtgatgaaattgatgagagtgccctgcagggagccggaaactcagggagcatcgataatgagtcccccaccatcagcagctggcttaaatataaaaactgtcatggcctctggagaaatgacaagaattcgaaggagcttccctgcactggccaccctacaccctacacccttacttcctcccctcaacttgcctggatttatcgacccccactaccccactggttgccttctctccacctggcacatttcgtatgaatttgcttgttggttcttgcctatctccccagtagaacattagctccttcaggacagggacttttgtctaccttatgcacctagtgcaatgcctggcacacagtcggtgcttaataaatgtttcttaaaagaaccaataaatgaatagtgacctctccggggagaggagccctgagctcacctcctgcccccagcccagggctcttaggtgcttgttggtgtcaggcccaggcccccctctcatcaagcagccaataaaactgccctggttggcgttctcatttcacagatggagagactgagcccagagagggagagtcacctgtctgatgtcacacagagaggaaggaatgctgtttgaaggtcaggtcaatggaaagagtcctattttcaggtcaatttggaccttgccaaagcctcttccttctggtgaccttagctgagaggtctgccactagcaggtgcttcatgaacagttgctgaacaagtggtgtgcatcatgctcccgctgtgaacttcagcttgcttgaaggcggattcctccag

SEQ ID NO: 1746 - DNA, 2859 bp, Homo sapiens; identical to SEQ ID NO: 1745

SEQ ID NO: 1747 - DNA, 2859 bp, Homo sapiens; identical to SEQ ID NO: 1745

SEQ ID NO: 1748 - DNA, 2859 bp, Homo sapiens; identical to SEQ ID NO: 1745

SEQ ID NO: 1749 - DNA, 2859 bp, Homo sapiens; identical to SEQ ID NO: 1745

SEQ ID NO: 1750 - DNA, 2859 bp, Homo sapiens; identical to SEQ ID NO: 1745

SEQ ID NO: 1751 - DNA, 3044 bp, Homo sapiens
ggatggggcagtgtgagatgacgggaccagagcacgttcctggctgcagaggccacaagtcacgctgtctctgagagtggaatgtcaccatcgcccaggtggggatttttgtgtgttttgttcactgctgtacacccagcccccagcacagcgcctgtccaggacaagtgcccagtaaacacttgggaagcaatgcaagcgtcctcccagcagctcctgcaaacagacccccgacccaagcccttccttctgcctccactgccaccactgctgctcatctctgctggcacagaagtctcttccctggtcttccagaaatcccctctccacactcagccagagggagctattaaaactgtgggccagcccacatcagtccacagcaaagtcctctctaagggatctctgttgcttggagaataaaccctcggattccttccttggctctcggggcctcctctctgacctccctctgtctcctctcccagccttcctcctcactcaccctccagccatgctggcttcctccttgctcctgaaacagcctgaggcccacactgccccgggccctttgcactggctgtttcctctgcctggaacacttctcctaggcatccacagggctccctcccacaactccttcgggtgcccacatgggaagccatccctgaccacccccccgacttccttctgagcaaggtagggtctttctacctagtcatgagggcagggatttttgtctgttgtgttctctgtgtgcccccagtgccatcccagtgcctggcagatggtaagtgctcgacacacattggctgactgcctgaatgaacaactctatgagccgatggcagataaggacactgaggtcctctggggtaggtgaccagcccaaggccacacagctggtctgagattaggccaggagaggagcccgggttggtcacatcctggagttggcgtcttggaaactgcatcaggagaataacaaagatgagacgcaggctctaacaagtggataccagtgactctcgccccgccagccccagccctgcagccttgggcccttccaggagtcatggtctgcctgcctggggcattccaggcttcgacccaggtcctgcactttctattttgagcctcttagtcctgaggactgtgtgttcccagcaggcggcgcgggccagaggctgagcctgggtgtggctgtcaccctatctggggccagagacccagattcccgggcccttaacctgttggctgctgagggctctggcataagccctgttccctgcttgattgtctccccttcaagcccctgccctggtatcgtatcggcccatctcaccttggattatatccctgtttggccccatttgaatcctggctctgcccctttccagcaatgtgaccttgggcaagtcacttcatctctctgggtctcagtttcttcatctgggaaatggggacaataagagtacctgtctctggccatgtgtggtgactcatgcctgtaaccccagcgctttgggaagccgaggcgagagaattgcttgagaccaggagtttgagatcagccctgggcaacatagtgagacccctgtctctacaaaattctaaaaaaattagccgggtgtggtggtgtgtgcctgtagtcccagctattctagaggctgaggcgggaggattgcttgagcccaggagtttgaggctgcagtgagctatgattatgcccctgcacatcagcctgggtgatagattgaggccccatctctaaaaataacaatactaataataaataaaaatgaaaatgagtacctgtcttctggggttgcagaggagattcaatgtgatgaaattgatgagagtgccctgcagggagccggaaactcagggagcatcgataatgagtcccccaccatcagcagctggcttaaatataaaaactgtcatggcctctggagaaatgacaagaattcgaaggagcttccctgcactggccaccctacaccctacacccttacttcctcccctcaacttgcctggatttatcgacccccactaccccactggttgccttctctccacctggcacatttcgtatgaatttgcttgttggttcttgcctatctccccagtagaacattagctccttcaggacagggacttttgtctaccttatgcacctagatggagagactgagcccagagagggagagtcacctgtctgatgtcacacagaggtcagcatctgggctgggattccagcccaggaccatgtggggtggggggcagtggatcaatcttttcctggagggagtcaatggtgatggtgggaatgggtcaggggtgctggcaaggagggtccaaggcccccaggagggagggaggcatgggagatgagtttgtccctcttgagttctgtctctctctgtgtctctctgtttctgcctctttctgtctccttgtatttctcagtccctgtcttcgtctatacctctttctctcttccttgtgtatctgacccactgcccaggaggggatgcaggcagagacccctggcttgggtcctggagttggggcccacgaggggattgacatctggggttgagctgggaatctgaagccagaccctgcagccagggacagcattccagtctcggctccacactccagggatagccttggaacgccaggcagttcagagagcctgaggtctggtcttggagacctgggttccaatcccagctttgccacattccagccatgtggccttgggcccttagcctttgttcctgtaaaatgggaccactgagagcccgatctcagggttttatgaggaggaacgatgagagggctgtgctgggcttcctgaagccctgtgtggcctggaaagcactcaatagatgataactcagtgtaatgatttcttctagcagatggggaaagcgagagttaaagaggcccgatcatttcactcactcattcctcaaacgttattaagcacctgctatgcaccaggtgctttgttttgtatccattaactc

SEQ ID NO: 1752 - DNA, 3044 bp, Homo sapiens; identical to SEQ ID NO: 1751

SEQ ID NO: 1753 - DNA, 3044 bp, Homo sapiens; identical to SEQ ID NO: 1751

SEQ ID NO: 1754 - DNA, 3044 bp, Homo sapiens; identical to SEQ ID NO: 1751

SEQ ID NO: 1755 - DNA, 4294 bp, Homo sapiens
ggaccatcacggacgccgagcttcgggtaactctcacagtggaaggtaagcccgtccccttcttaatcaatacggaggctacccactccacattaccttcttttcaagggcctgtttcccttgcctccataactgttgtgggtattgacggccaggcttctaaacctcttaaagctccccaactctggtgccaacttagacaatactcttttaagcactcctttttagttatccccacctgcccagttcccttattaggctgagacactttaactaaattatctgctttcctgactattcctggaccacagctatatctcattgccgcccttcttcccaatccaaagcctcctttgtgtcctcctcttgtatcccccgaccttaacccacaagtataagatacctctactccctccttggtgaccgatcatgcaccccttaccatctcattaaaacctaatcacccttaccccactcaacgccaatatcccatcccgcagcacgctttaaaaagattaaagtctgttatcactcgcctgctacagcatggccttttaaagcctataaactctccttacaattcccccattttacctgtcctaaaaccagacaagccttacaagttagttcaggatctctgccttatcaaccaaattgttttgcctatccaccccgtggtgccaaacccatatactctcctatcctcaatacctgcctctacaacccattattctgttctagatctgaaacatgctttctttactattcctttgcacccttaatcccagcctctcttcgctttcacttggactgaccctgacacccatcaagctcagcaaattacctaggctgtactgccacaaagcttcacaggcagcccccattacttcaatcaagcccaaatttcttcctcatctgttacctatctcggcataattctcataaaaacacacgtgctctccctgccaatcgtgtccgactgatctctcaaaccccagcaccttctacaaaacaacaactcctttccttcctaggcatggttagcgcggtcagaattcttacacaagagccaggaccacaccctgtagcctttctgtccaaacaacttgaccttactgttttagcctagctctcatgtttgcgtgcagtggctgctgctgctttaatacttttagaggccctcaaaatcacaaactatgctcaactcactctttacagttctcataacttccaaaatctgttttcttcctcacacctgacgcatatactttctgcttcctggctccttcagctatactcactctttgttgagtctcccacaattaccattgttcctggcccggacttcaatcaatccagcctcccatattattcctgataccacacctgacccccatgactgtatgtctctgatccacctgacattcaccccatttccccaaatttccttctttcctgttcctcacccagatcacacttgatttattgatggcggttccaccaggcctaatcgccacacaccagcaaaggcaggttatgctatagtacaagccactagcccacctcttagaacctctcaacaacatgcccgagtcaggaaactaaaatacctcttaatctaaatagacactttcactgaataagtaaaggcctttcctacagggtctgagaaggccaccgcagtcatttcttcccttctgtcagacataattcctcaatttagccttcccacctcaatatagtctgataacagacgagcctttattagtcaaatcagccaagcagtttttcaggctcttagtattcagtgaaacctttatatcccttatggtcctccgtcttcaagaaaagtagaatggactaaaggtcttttaaaaacacacctcaccaagctcagccaccaatttaaaaaggactggacaatagttttaccagtttcccttctcagaatacagcccatttaagctcctgtatagacgctcctttttattaggccccagtctcattccagacaccagacgaccaacttagactgtgccccccaccaaaaaaaacttgtcatccctactattttctgtctagtcatactcctattcaccgttctcaactactcatacatgccctgctcttgtttacactgccggtttacactgtttttccaagccatcacagctgatatctcctggtgctatccccaaactgccactcttaactcttgaagtaaataaataatctttgctggcaggactatgccgaatctccttaagcactctctaatcagacatcctgagtcgtcccaattcttagaccttttatacctgtttttctccttctgttattccatttagtttttacaattcatacaaaaccgtatccaggccatcaccaatcattctatacgacaaatgtttcttctaacatccccacaatatcaccccttaccacaagacctgcctccagcttaatctctcccactctaggttcccacaccgcccctaatcccgcttgaagcagccctgagaaacatcgcccattctctctccataccatcccccaaaattttcccaacactttaccattattttgttttatttttcttattaatataagaaggcaggaatgtcaggcctctgagcccaagccaagccatcgcatcccctgtgacttgcacatatatgcccagatggcctgaagtaactgaagaatcacaaaagaagtgaatatgccctgccccgccttaactgatgacattccaccaaaaaagaagtgtaaatggccggtccttgccttaactgatgacattaccttgtgaaagtccttttcctggctcatcctggctcaaaaagcacccccactgggcaccttgcgacccccactcctgcccgccagagaacaaaccccctttgactgtaattttcctttacctacccaaatcctataaaacagccccacccttatctcccttctctgactcttttttcagactcagcccgcctgcacccaggtgaaataaacagccatgttgctcacacaaagcctgtttggtggtctcttcacacggacgcgcatgacaaccccaccaccccaaggacagggactgtaaactcccaacggggtaaccttgcctgctgcctagatggagctgatttatcaagataggggaattgcaacagagaaagactttaattcatgcagagccagctgtatgggagacaggagttttatcattcctcaaatcaggataatttagtagctttatcaccaatgcgatgaccatgtagacacccagaaaactgtggcgcacctgcatatcatcttagccactcaagaggctcttccaagtttagcctcttaaagtttgaaaattctgcatcatcaggaactgagtcgtttcagaagttaacctgtatcacagaatcccagaaagaagaaaagacggatcagtggttgaagaagcgctcatggatatgcacagagacaaagtgtataatgagcaagtatcccagggttctttgcctcgtgaccaagaaaattaaggagcgtggacacaaagggtgaggttggaatgaatgtttaataagcaaaagaagaaagctcccaaccaaggagagagggcccaaaacagggttgccaactatgaggctgagtccagggtatgaatggactgggaaggggaggaatgtgctgactggtctgcaggctgttttggagaaagcaccacttagaaagaggtatcatagtgtaaagaaccaattggaggcaaaggcgaaggtttggcttgggaccttggcctgggaccaatcagaggctgaagtgatgactcaacctatgtaaatgaagacttagcccactgccaattacagaaaggtaggcatatgtaaaataggtgaaaagtaagaaaccagtaggtgaaaataagtgactaaggcatgccaaggagagagaaacatgtccaaataggggtagaatttgttcatctgggtttaccgagtaagtgtttccattcaaggatgcagtctctttcttatctggggcccgcagtttgattttcaggctgttctttgtttgaatgaatttttaccagggactcaccctaactgcctgcctgactggtttcttactttctcctctctcattaagagagtttaggaccctacaaatatttcccaaataaccatttataaaggaatagagacattgtgcatttgcttttccccggctataagaaggtagttaaggcaagacactggtacttagacaaaagagagagagaagaggagaaaggggaagaaga

SEQ ID NO: 1756 - DNA, 1098 bp, Homo sapiens
tgaggacataagaaaggaccagcacagagaagacaactaacttcggcacgctttgctcgaagggctcttaggaaagaattctgagttttaaaaacaggagtgggagggtgagatagtcctgatgattaaaaactaacgcaaccgcagtaagtcactttggcacactgtgtcatgtaaacatagctcaccgcaaaggacccctccccggcccacccctgctcttgacgcccggaccatccaaagccgcctcccagctcagggacaggacgccgcccccagggcatgggccgcacaagggtctgggtagacacgtgggatgataggaaggctgagagggcctaggggtgcgggcggggtaaaggtgaaggggcaaaggattcgtcagaaaacgtgattttaaaacgagccagattcatccatttccctccttacagtagtagcagctcgcaggggtgacgaggaacattcctgagcacccaggtagaagccaggcacctctccccgttatgactttcagttcataactgtctgtggtttaacaggaccccaaggctcctgtctcccgccctgaatcctcagtgtaaatgagcaggtattgtttggttctgacccttcctaattctttccccaaagccccctgaagcagtcatcttggccaggcggggtgtgggagggagctgcgggcggggcaggactcgctgcctggctggagctccccaggccagcaggtgtgcaggactgtgagccaggcctgtgccctggctgacgggctcatccctgacactgctggccattaattctgaaggcccagcgtgcagggctcagatcacaatgaagccaatactagcgtgtgacagctgcctggcatcattggtctgccctgtcgccagggggcagcggtattgctggctcacacagagctatggggtatgtcttatattccttagagaaaagaaatttaatgtaaaaagacccaaagtgatatctgtcaaaataagtaaccgctccaggttcacagatacgcacagcacgcaaggtggattctgacgcacagtagggactctcaggctgacgcccaacagggatgccggggccgag

SEQ ID NO: 1757 - DNA, 1098 bp, Homo sapiens; identical to SEQ ID NO: 1756

SEQ ID NO: 1758 - DNA, 9000 bp, Homo sapiens
cttctgtatagtacaggggtggtgctttgaggggataaacagctgaacaagacaatgacccaggacttccagtaggccccattttaatgtcacagtattataatatctataattttgaattttgaaaggtgaatgtttctttagcacaaaattcttcattcttctaactccagttgtaagaaaataatcgcaattaggccaccatgttcatagaattaattacatacacatttttaaatagtgttaactttaagtggcctcccactaagatatgaagtacatatctatttggaggattagaaagtaaaatttccagctttcaataagaatcaaactgatagtgtactaaaaataaactaaggtcatctgattgaaaggcttcacctctgtctcacactccagctcttttcttggaagagaagaaaccgtttcaaaaaattattaagggagcaacaaagggctgttttgtacattcattacattcacggtgagggaaatgttctgtcctgtcaatatcagtgtatctaatctaaaatcattaattccatacctgctagcttttttagtaaaactatattaaaattaaaagtaaaacttacagtatttgtttcgacctataaacctggttaacatccattagattagattggttttcattaaaataagtgctacacaagacctgtcataactaagcatcttcttgttttttgttttgttttgttttttctagagccccagcagctactattaatgagtgtctggaatatgttcctggcatttcacctaccctctctccaatccttccaagaaactcacaaagcagggctttttcttgaacttctcttcctcacaacagttaaatcatccatttaaagatgtcaaacaacctccgtgttctaaggtgagttgtcagatctcatttggttcaccttgtctaccacttatcctttgtttattcattcttcttgtaacctctttcttttccaaagctgagagtagataaaactagctatttcaataataactagttattatttcaataataccatttgaggagaaaatatttgtatatttggtagtgttgaatatgcaataaagctgtaaaaaatagaagaatgttaactactgtagcaaaattaataaacccagttttcctgaatagttaagttgaatccatgctgactctcaaatctgtctctttagtatcctattttaaaatcctcttccaattaatcctacatattcatggggataatcctaagagcagggtaatctttacttgttccccatattagtctgacaactcattcagtcaccgttgccaaagcctaaaatcgcccacaagaagccaaactgcctgtcatcatttttatccaggctgggatttccctccatgcttgaaataccagcttgtctgttttgcatccactttagaattaaaataaggaaaatgttatgaatcttttcccaaaatctctcccatattaaaatttacattcttgcagaagtgcagactcagtcctgcatttattactatcctaagaatctttgttttcttcagattttacaataccttcacacattcaatctgtggggaaaagaaaatcgtattttctgttaccagaatgtattcattcttcccttatgaaaatgactgcatgtgtgcacttctctctctactaaaccattcatacaaaaggctgaagttaaaatcacgctcattcaccactgaggctgttatttgctatcattttctcagttatgcacaatctaacttcactcttactacaacttattcttagttctttcatcctctttccctgcttatatagaatgcagccaagctcaaatgttatgcttttcctcatttttgtctacattgtcctgtgattcttagagcaacctcctcactttcatcttgcaatttcaatttttcttaatcaaaaacttgactacttaaatattagcccgcctaagtgaaaaacatctttcaccttcattagctattcatattcattcatctgtaagaaaaatacttttaaaactctgcattacacaaagagataacaataaacatccaagtatttacatatgtgatctgttctgtagaatctcacaataaaaataacttcatatatatgattcacccttcacaatatttatttttgaggataaaagaaaataatgttagtcttatgtgttaatcataaaaaatacatgcttaatgacaggaaaacagcaagtcattttttctagttctttaaaaatattttaatcgtgcaaaatcaccataatgtactctagcacaatgctaaaatgttatctaagatggagtggcttttattagttttacaggatgtatatttggcaatagttcttaaaaataattactcaaaaggaactctaactctattattttagaaacaatattttaaaatacagcagtaagcaacaaaaactattgctctttatacatttttggcataacactgccatacggttacagaattataaaataagtattttatagtaccatacagatccagaaactggttacaacttctaccacatacacatggtattggtactaacgaacatgcacagcattctgtaattcatactgcagttgaatacagagcacagagaaggcccagtggccactggagaatcagagcttatgttataagtaaaacacacatctttgtaacaatcgtaggcattttcctgaaatatttaaaatacaagggacacaatagtttccaaaatgacataatctaccatccttcttagataatactaaaaaagaaagattaccttacataggaaacaacttaaagccctttttaaaaacaggaggaaaatgcttgtcaaaggacctaacattttgctctcatttgtttctcacaattataatgccacacaattaatatgctgtcaactcttgacagtgtggaagttacttcactcacaaaccacctatcactgagtctttctcttatctgcagccagaccatcaacttaacttgtaaaactaccaactgttgctacacacaggcaaaggaattaaacttggtagctgatcatttgattacatctatcagtctactggagggcttcaacgcagagtaggtggaattcatggttcaaatcagagtattaatgggatctgtttgcacaccaatacctgatctccttggcacaaatacagagctgattcttaaagcatgtccccacaataaagcttttcttaatcattcgtcacctgcttccaataattctggcacttacacaaacttatcaagggttatgtctttatttctgtggtgagtttcctgttgctgtttctagacttttatttcatttgtattttatttttcttcacatgaaacaaaatctgttagcactgggaaagaaaagttcatttgactaatgagtgtagaatgtaaatgtttcttagtaccaaaacttattatatatctaatttttctagttaacgtaaattgttacacaaagtataatttaaaaagtaaaactatgacaaaccctaaagcttaaatatttttagagaaaaaggtattttagcacagtaagtgaccactactgccttttctctgaatcattttataaagagattttatattaatatacagctgtgaatgaacaacttccctaattttttaattaaataaataggagtgagggaaaaaaactcatatttcaatgattcccaagatcgttaagatataactacaatttactaatgcccaactgctcacagttttctaaacaactacaaaataaataaattgtagcaggtattttatgagaactgatacccatcaaaattgtgtatggagtccatgatggcctatcctccccagaagtcagagctcacagtgcccaacaccctcattatccagaggagaatctgaggacccatcatgccagtggagaaggctggagcccagcactggcgccactttcctgagatgcccacactgattcttgtcccttctccctctctgaactctacttccagccagtttgggtcataacacaaaacatttaattgtattctctacatgaaaactttagttcaggaaaataaacatattaagaggttatttccctcaaataactgaaacaataaacttcacaacagaataggaaaaaaaatgacaaagaacactctctgtagtctaggaaaaatgcaagaacagtgcttttaaaatgattctaatgagactacagcataaaagtttttcaaattagtttcagatttctccaactgcctactggaattaaacttttaataatttctctaacataattctatttctgcatccgcctacatctaagaagaagcaaaacataaatattatttgtagtaactaaggaacgtttaaaatgaaaattatagtatgtagctaaactacaaaaagcataaataaatataacagacagtatagttagtctttcttactctaaacacgttttgtcaaatgtaacacattgttgaatatcatggtgagtacacttcttgataaactgatgctattgtcccaaacagcaacttctccaaaatgataaagcaccacctaaatttcattaaaagaactgatattcatggtttagaaagttcccaatgatgagattttataatgtaataaaaatgtaaacttctgaatgaaaaccatttacatttgttaaggcacatctggatacctccagacattcatatttatagctatattattattcatttcaataataagggatttctaaaaacacattctgtccctgaacacaatctgctgggtgtgttggataactagaatgcagaaggagcagggtagtactcactgtcaccctagagattagccacacaaatatgttcctgtaataaacagtacaaaactcaaaaagaagccagcaaatgtacactcctaattttctagatcctacattgacccaggccatttttctctacaacttcacctacatttaatgattctagtgtgtctaaatacagcctaccttatactcaacgcatataccccaaatgagagaggggaatttcctaagtggaaaacaaaatagaaatcttcaaaaacattcctacaacagaggatcgccactcaccccaaacagacattaaagactggtagatgtagttacaatcaagcaagatcaagaatatcctttgtatcttagattagaaaacaaagctttagaagagcctcaattatagtttaaaaaatgcgtgattactcagtatggatgactactcaaccataactctattataaacttgaaaatttaatattaaaacaattaaccaaatattctccccccattggttaacccaatttttgaccactcagtgttgaggttcatttactactatgatttttcaaagactaactcagatgtaatactgtactgttttttctttccaccacatcatactttcactcagattaaagtataaaactagaagcagggtaggtgattttatatgacaaaatatgaaacaatgactatgacaggcattatggcattttcatatgtttatatttttactacttagcaaaaaaatacttagaacttctctagtaactcctgagttgtagattttattttctcattgaagctggaaaaaagtagtcccaaaacctaaattcaaaataaaactatgcaacataatttttgagttgacaactaggcttgatttagagaaagtaaacatattttcacctctatcattattcttttgaatttcttatgagatcgagaatgaaaatgtataatggtacaatattcttcatgttataaactctttctctactgtacagaaatatatcttataactatatgtcactttacagtatttaaaaatagtttcacataatctcctttgatatatgaaagcacaaaatattagaaatgttctagactaatcaagcgatataacatctatttgccatgaaatgcaagttagtattttatcaatagccaatatttagtatccttgcactccacagtacaacaataaagattatatatttgtaaagattcagtaatatttttagctatttggtcatgcttcactgcattttttataacagcttctcaatgaatttctgcaagcatatcgtagtttttaaaattacaaaacataggagtcaaacccagagcactgtttcatatataagacacacataaatacatatctatagatcttatttaaaaaactaatatacaaagcattaatagaaaaaaattctagacactcaatgtttatctccaaaaggaatgatatccttttacttgttctccactgaatgattatctaagttatttagggattaaatgtaagaaacatactattatatatgaatatgcatttaaaaacaccatagtgggaaaaggccactatttaagatggatgccaggaagtgtttctcttgagactaaatattctcgaatttaatgttacaatctaatcaaaatccctaagtaggaagaatattctaaaagttaagttgctaaatgaaatgtttttactcataagggctctaatatacaatttctaagtaattcaaattacattcattgattttagtatctggtaactttattaatatcataatatctggtcacaatcttttactattatgcatttagaaagttgtctgaatactttatcatgtatataaaattggtaagttattttgaattaaattatttgtgttctacaattcagcctaatttgacaatcgcttctcatcctctaaaccctgtagaactatttactgagctctacggagacacagctacaagcaccacgtaagagtgtccatgtttttcttgcatgtaaaacagaaattgaaatgcaaaagcagattgccaaatcctaatactcacagaacactaggaaagcaaaaactggcatattatgggaactaaaaatgagaaagtgttccatactatacttattggaacacaatgtacaacaaaagtgctactgagattcatataaaaaattagagttaagcaactggcatgtttcatgtaaacttcaaagcagtaaaatcatatttctagaggcatactataagtgtgattcttttcaagaaatccactgcagaaaatgtggatcaatagaggcaacagaagatgatatgaagtaggacatattacaaattccctaggggattaaaatgaatagaacttttcttaaaagcctaacaaaaaagttaattcctttctaaatgaaataaagtagacatgtttcatctattcattgctttaactatatttgtatatatgctttgaagttcttatcacagtgttttttgatttgtaataataattagtaataatatagaaacaaaattaattgttcttaaccagtgctatgtaacctattaagtgcttactagagttgcatatatggacttttaaatttgttctcaattttgaagtttgataacttagagatgtacaaaactatactttttaaaaaacacgtttgggctaagcaacattactaatttcgtaatccatagaacactgacatattcatggtttaagggactactgtcttgttcacagtgcaagaggcatgccttttaaaaaggaatttcttattttttaattcttcagtcatttacattcagaatcaaccatcaaatttatatggaacagccatagagagcaaaattcttgtcttgaacttttcaatcaaatttgtttttaagcacttaattctgaaaacagttattaatttaaacaaagcaaaatcttgaagtcatacaattagaagtcccactctgttccatgtagatttcaatatagatcatcctaatgtgtatagtggtcccttgatatctgtagggggttggttccaggaccctctgcagttaccaaaatctaggaatgctcaagtcccttatgtaaaatactttaaatcatctctaaattacttacaatacctaatacatacaatataaatgctatgtcaatagttgttatactgtattgtttagagaataatgacaaataaaaggactgcacatatttagtagagatgtaaccatccattttttccaacaaatattttcaatctgcggttggttgaatccacagatgctggacccctgaatatggagggccaactacactagaaacacacacgctagctgagaaagatggtggcttaagggtaagcatggaaagaggcaaggaggtgaggacagcaggactgatagataagctggggaggccagagctccacaaggacatccatttcacttatcagaatctaaaaataaacacgttgagatactagaatcaaagaatccaaattagtttctgaacacatttgaaaagatcaaactcttacagttaaaaaaaaaattaatcagccagacatggtggctcatgcctgtaatcccagcactttgggaggccgaggcgggtggatcatgaggtcaggagtttgagaccagcctgaccaacatggtgaaaccccgtctctactaaaaatacaaaaattagccaggcgtggtggcacacgcctgtaatcccagctactcaggaggctgaggcaggagaatcgtttgagtccaggaggcagaggttgcagtgagccgagatcatgccactgcactccagcctgggcaacagagactccgtctcaaaaaataataataaaataaaataaagtaaaataaagccataaatcaggtaaaagtgtagcaatccaatgaaattatcctcttgatttccttcatgtagactataatgtctcaaaagaatgtattttgtataccaaatactacatggtaatttctagatactctgaaaatattctcaaagtaattattatatacaaaatttgaaaattcacatcctaaaagcattacagaatacattcatttattgggtcttatcttaaatctccttattagatattcaattcattgtcatccaaaa

SEQ ID NO: 1759 - DNA, 9000 bp, Homo sapiens; identical to SEQ ID NO: 1758

SEQ ID NO: 1760 - DNA, 9000 bp, Homo sapiens; identical to SEQ ID NO: 1758

SEQ ID NO: 1761 - DNA, 9000 bp, Homo sapiens; identical to SEQ ID NO: 1758

SEQ ID NO: 1762 - DNA, 9000 bp, Homo sapiens; identical to SEQ ID NO: 1758

SEQ ID NO: 1763 - DNA, 5562 bp, Homo sapiens
atatgattcacccttcacaatatttatttttgaggataaaagaaaataatgttagtcttatgtgttaatcataaaaaatacatgcttaatgacaggaaaacagcaagtcattttttctagttctttaaaaatattttaatcgtgcaaaatcaccataatgtactctagcacaatgctaaaatgttatctaagatggagtggcttttattagttttacaggatgtatatttggcaatagttcttaaaaataattactcaaaaggaactctaactctattattttagaaacaatattttaaaatacagcagtaagcaacaaaaactattgctctttatacatttttggcataacactgccatacggttacagaattataaaataagtattttatagtaccatacagatccagaaactggttacaacttctaccacatacacatggtattggtactaacgaacatgcacagcattctgtaattcatactgcagttgaatacagagcacagagaaggcccagtggccactggagaatcagagcttatgttataagtaaaacacacatctttgtaacaatcgtaggcattttcctgaaatatttaaaatacaagggacacaatagtttccaaaatgacataatctaccatccttcttagataatactaaaaaagaaagattaccttacataggaaacaacttaaagccctttttaaaaacaggaggaaaatgcttgtcaaaggacctaacattttgctctcatttgtttctcacaattataatgccacacaattaatatgctgtcaactcttgacagtgtggaagttacttcactcacaaaccacctatcactgagtctttctcttatctgcagccagaccatcaacttaacttgtaaaactaccaactgttgctacacacaggcaaaggaattaaacttggtagctgatcatttgattacatctatcagtctactggagggcttcaacgcagagtaggtggaattcatggttcaaatcagagtattaatgggatctgtttgcacaccaatacctgatctccttggcacaaatacagagctgattcttaaagcatgtccccacaataaagcttttcttaatcattcgtcacctgcttccaataattctggcacttacacaaacttatcaagggttatgtctttatttctgtggtgagtttcctgttgctgtttctagacttttatttcatttgtattttatttttcttcacatgaaacaaaatctgttagcactgggaaagaaaagttcatttgactaatgagtgtagaatgtaaatgtttcttagtaccaaaacttattatatatctaatttttctagttaacgtaaattgttacacaaagtataatttaaaaagtaaaactatgacaaaccctaaagcttaaatatttttagagaaaaaggtattttagcacagtaagtgaccactactgccttttctctgaatcattttataaagagattttatattaatatacagctgtgaatgaacaacttccctaattttttaattaaataaataggagtgagggaaaaaaactcatatttcaatgattcccaagatcgttaagatataactacaatttactaatgcccaactgctcacagttttctaaacaactacaaaataaataaattgtagcaggtattttatgagaactgatacccatcaaaattgtgtatggagtccatgatggcctatcctccccagaagtcagagctcacagtgcccaacaccctcattatccagaggagaatctgaggacccatcatgccagtggagaaggctggagcccagcactggcgccactttcctgagatgcccacactgattcttgtcccttctccctctctgaactctacttccagccagtttgggtcataacacaaaacatttaattgtattctctacatgaaaactttagttcaggaaaataaacatattaagaggttatttccctcaaataactgaaacaataaacttcacaacagaataggaaaaaaaatgacaaagaacactctctgtagtctaggaaaaatgcaagaacagtgcttttaaaatgattctaatgagactacagcataaaagtttttcaaattagtttcagatttctccaactgcctactggaattaaacttttaataatttctctaacataattctatttctgcatccgcctacatctaagaagaagcaaaacataaatattatttgtagtaactaaggaacgtttaaaatgaaaattatagtatgtagctaaactacaaaaagcataaataaatataacagacagtatagttagtctttcttactctaaacacgttttgtcaaatgtaacacattgttgaatatcatggtgagtacacttcttgataaactgatgctattgtcccaaacagcaacttctccaaaatgataaagcaccacctaaatttcattaaaagaactgatattcatggtttagaaagttcccaatgatgagattttataatgtaataaaaatgtaaacttctgaatgaaaaccatttacatttgttaaggcacatctggatacctccagacattcatatttatagctatattattattcatttcaataataagggatttctaaaaacacattctgtccctgaacacaatctgctgggtgtgttggataactagaatgcagaaggagcagggtagtactcactgtcaccctagagattagccacacaaatatgttcctgtaataaacagtacaaaactcaaaaagaagccagcaaatgtacactcctaattttctagatcctacattgacccaggccatttttctctacaacttcacctacatttaatgattctagtgtgtctaaatacagcctaccttatactcaacgcatataccccaaatgagagaggggaatttcctaagtggaaaacaaaatagaaatcttcaaaaacattcctacaacagaggatcgccactcaccccaaacagacattaaagactggtagatgtagttacaatcaagcaagatcaagaatatcctttgtatcttagattagaaaacaaagctttagaagagcctcaattatagtttaaaaaatgcgtgattactcagtatggatgactactcaaccataactctattataaacttgaaaatttaatattaaaacaattaaccaaatattctccccccattggttaacccaatttttgaccactcagtgttgaggttcatttactactatgatttttcaaagactaactcagatgtaatactgtactgttttttctttccaccacatcatactttcactcagattaaagtataaaactagaagcagggtaggtgattttatatgacaaaatatgaaacaatgactatgacaggcattatggcattttcatatgtttatatttttactacttagcaaaaaaatacttagaacttctctagtaactcctgagttgtagattttattttctcattgaagctggaaaaaagtagtcccaaaacctaaattcaaaataaaactatgcaacataatttttgagttgacaactaggcttgatttagagaaagtaaacatattttcacctctatcattattcttttgaatttcttatgagatcgagaatgaaaatgtataatggtacaatattcttcatgttataaactctttctctactgtacagaaatatatcttataactatatgtcactttacagtatttaaaaatagtttcacataatctcctttgatatatgaaagcacaaaatattagaaatgttctagactaatcaagcgatataacatctatttgccatgaaatgcaagttagtattttatcaatagccaatatttagtatccttgcactccacagtacaacaataaagattatatatttgtaaagattcagtaatatttttagctatttggtcatgcttcactgcattttttataacagcttctcaatgaatttctgcaagcatatcgtagtttttaaaattacaaaacataggagtcaaacccagagcactgtttcatatataagacacacataaatacatatctatagatcttatttaaaaaactaatatacaaagcattaatagaaaaaaattctagacactcaatgtttatctccaaaaggaatgatatccttttacttgttctccactgaatgattatctaagttatttagggattaaatgtaagaaacatactattatatatgaatatgcatttaaaaacaccatagtgggaaaaggccactatttaagatggatgccaggaagtgtttctcttgagactaaatattctcgaatttaatgttacaatctaatcaaaatccctaagtaggaagaatattctaaaagttaagttgctaaatgaaatgtttttactcataagggctctaatatacaatttctaagtaattcaaattacattcattgattttagtatctggtaactttattaatatcataatatctggtcacaatcttttactattatgcatttagaaagttgtctgaatactttatcatgtatataaaattggtaagttattttgaattaaattatttgtgttctacaattcagcctaatttgacaatcgcttctcatcctctaaaccctgtagaactatttactgagctctacggagacacagctacaagcaccacatgctggacccctgaatatggagggccaactacactagaaacacacacgctagctgagaaagatggtggcttaagggtaagcatggaaagaggcaaggaggtgaggacagcaggactgatagataagctggggaggccagagctccacaaggacatccatttcacttatcagaatctaaaaataaacacgttgagatactagaatcaaagaatccaaattagtttctgaacacatttgaaaagatcaaactcttacagttaaaaaaaaaattaatcagccagacatggtggctcatgcctgtaatcccagcactttgggaggccgaggcgggtggatcatgaggtcaggagtttgagaccagcctgaccaacatggtgaaaccccgtctctactaaaaatacaaaaattagccaggcgtggtggcacacgcctgtaatcccagctactcaggaggctgaggcaggagaatcgtttgagtccaggaggcagaggttgcagtgagccgagatcatgccactgcactccagcctgggcaacagagactccgtctcaaaaaataataataaaataaaataaagtaaaataaagccataaatcaggtaaaagtgtagcaatccaatgaaattatcctcttgatttccttcatgtagactataatgtctcaaaagaatgtattttgtataccaaatactacatggtaatttctagatactctgaaaatattctcaaagtaattattatatacaaaatttgaaaattcacatcctaaaagcattacagaatacattcatttattgggtcttatcttaaatctccttattagatattcaattcattgtcatccaaaa

SEQ ID NO: 1764 - DNA, 5562 bp, Homo sapiens; identical to SEQ ID NO: 1763

SEQ ID NO: 1765 - DNA, 5562 bp, Homo sapiens; identical to SEQ ID NO: 1763

SEQ ID NO: 1766 - DNA, 5562 bp, Homo sapiens; identical to SEQ ID NO: 1763

SEQ ID NO: 1767 - DNA, 5562 bp, Homo sapiens; identical to SEQ ID NO: 1763

SEQ ID NO: 1768 - DNA, 5562 bp, Homo sapiens; identical to SEQ ID NO: 1763

SEQ ID NO: 1769 - DNA, 5562 bp, Homo sapiens; identical to SEQ ID NO: 1763

SEQ ID NO: 1770 - DNA, 27927 bp, Homo sapiens
attttataacattctccgcttcacctgtttctgactaaaatggtttgggatggtgtcactgagaaacctgatatcccttaaagctgggaaaacaatacattctcctagactggagtgtgtgagtaaatgagatgaactttaaatttcttctggaacctaaagctgtatctagaattatgctgttgcagatacaaaactgtttatgtcctgaaagaaattatgattgtgtcatggtactaaagaagctggtgtgaaagataccagccagtggcctgtttgggtattttatttatttagtatcaagtgcctaaatattgcaaaatatccttatctgcttctgcatctatatctgtatctgttgccaacctaaaatgtcttacagagaaagcatcgtctgagtggcttgggttgcagtttgaaagacaattagcagtttctttggagccaagaagatttcaaagaaaataatggctcctaatactcacatgtggtctcccacacatattttttcctttatcagctaagtacacgatcactgccagtgaaaatgctctttgctgccaagagattgagaagttttgaaatgcaaatgaacgagcttaagcacatattacacgtagaaatggtggaaattcgctttcctgggtcttggaatagttcctccttggggaaaaatctagcttggacattagcttgatgtattcaaaatggagtgttggcgttgggcaggttcgaaaacatcattatgttgtaaccccaacaccagactcgacaggaactgtatatggctttggagaatgaagttcaatatatgaattatccatagagaccagtaggcctattgcaaatccctgcggtggagtgctaggagccagaggtgctgaattctcctgcagttctataaatgaactaagccacacttactgactctgttactgaaaaccagttgcctaaacattttgtgtctgtttcattatttgtaaagtgagaaatgtacttactgaacagggtcatcacaggagacaaagatgattgtgaaagagccttgtaaagggtacatctgaaccccaaattatcaataagtgctcattggctgtgcctcacaagagctcagagatcactgagtctagttcaatgcacttaaattacgacatggaaatggaggcaccaagaggtgagtatcctatccagagtcacacagctctacagagatatggaagcaatatcataaaattcaatcatgtcatatttcatttccatgaaaataaactaaaaaaaaacttggaagatgagaactttggataatttgagtctgaagtacttcatactactttaagttacctcctattgggggcattataaatgggtaagcagagaacatcatggaaagacatggagcttagtatatgcaaatgttgagttactcagtgtaatgtgtgaaaaaggagtttcataagtttcggtcagggaagaaggcagggtcaaaatttctgcttgagagtttgggagcttggggagactttaaacagggagcaacacagcacattagattcctttggttacactaaggacaatggttttgaaggggaccaggatgaagaaaaggaaggtagaacgaccattcctcaatgatgaggaatccattgctgtaatctatgcgagaggttatacagacctgcgtggcatcattcattgtctgaatggagaagatgagatgaactatttagaaagtaaacatttagaaagtaaacattagcatttatgggactaatttgatgtaggtgataagggtataggacaccaggaagattttcagatttctagatgggagggggatttatagaagtgcgttaaagtggaatatgggaggaaaaagagacttagaaaaacaggtgtgaagttttgaaatgaagtttgtgatattctagtacaatacccaagtgaagctgcttgccacttggaagttgcatatgagtctggaacagggcaagaagtctcaaatggaaagaaaaatctggaaatcactaatatatccatgggttgttgaaaccaggagagagggtgggaatgccctttgagaatacaggatgatggactctgaaagcactggtacttgttagactcttgttcttcttcaagtaagtgtgggagacactgcaaggagaggttagtgggacaaactggtgcagccttttaaggggatttgttatactcacaaaagaagcccagtgtgagggatacttttttttttttaaaaaaatgaagggttgggaacctgatcccaggtttaataaatctgggaaagtggccaaggtccctgaattttaaagactttaaagagtctccgagaatgtgtcccaggtcactgaattttaaagaagccctccaggtgagaaccaatgctctgagagttgcaaaccagggttttgtttgtcagtgcaacattttagctggctctaggtacagagccttcagatgtgggtataaggggagattttcaaaaagttccacatactgagtgatctttttctaaaactgagaggcctcccagactcatcacaagccagaaaagtagccgttgctatttgttttccatcaaatgctgagagctgccactctcattcttagctcatttgaagcaacagggatttcctcttgagagcaggagacagaattcattacgacaaagcatggttttagagtaaagtgtgaagtgtgtagccatgtctataaaagggataaagagccaggacaccatgattttgctgtggggttagcattgcttactcgcttagtgatctgggccaatcactgaatctctctgagccttaatttcctcatctgtagaaggggaaaatagtacttatctcattattttgtggtgtagactaaatgagatcagatatcggaggtgcttatcctctggaaagcacctaataataagattagctacaattaatacgtgtgttaagaaatgtgggacccacaggctctgaatctcccggtgagtagttggaggagatggccaaaggctctgaaatcctttcaggtccacggattcctaggggagggtatgatctgggcaaagatgattacattattttctttcttacacttattttcctagaagatatttctctaggaagatgagagcctttgtaattttcaacccttagaaatcaattattcctgagttatttttgcatttatgaaaagtgccaaattaatttcgactgaattttcttttctgtgatcaatgaggaggtcagctggtagacatgacgagattctaacaacaccgggtattgcccctcggagttttaattgccttaattctctgtaattcatttctgagaactagcatcttttcatacagtcttaaaaatctcagcttcttaatatatgcatgaatggcaatacgctaatatgcaattcaagtagcagggtttacattttataattctgcatggaaaaaaggcttgaaatctggaagccctggtcccaaatgttcttcattcccacaacacacaaagagacaaaacctcagaacagaggtggaatcatgatatccttctctcattcattatttacaatatatctgcctcagtacctagatttccttgcacaccttaggaagtcatggggagatagatttgaactagagtctagaggtaagtgatgccatattccattacctgagtcactatctccccaataccttcccctccctcttttttcccccaaaagagcacatctttggaaattgagaatattcagtgaacaggactcataaatcaaatcattatcattaataatcaaagtgagacattgtgagaaatagcaaattaatcacaactggcaggtgaagctacttccagcctctgctttctgcatactaaagggagcagaattttccccagtgggtttttatttttcttaagtttattttcttagtgaacactgcactctttggttgactgggaattatgtccaaacccaggtttccctactactaatatgactaattctgtttaataaaatttgattttcagaaccatttttgttccataaataagatatattatgatttggtgtactttattagtataccattgcatatttgaaattgaagacatttttctagaggaggaaaataactaatggtatcacaaatttggattagatgtaattatttattttccgtgtcttgggtcatacttatgtgacagcctgtcatcttagtttaaatgcctttttggtaaaaatgggagacaagcctaaatataatattttctactgttatgatagttttcaaagcatgattaataataattcatgaattttgagaacgtcttatttctccagaaaagaaataaatacttcttttccatcatgtttaccttctcagcctccctgtgaagtaagaactactttcttaaatcgagagacagtgagtcaaaaacagttaaatttttaccatttcacacagcaattctgggtttaaatttaaaatagactcgaatttcctgacccagcattagacaatgttgtcaaaattttcacttcttagtgacttttgaaatgacatgcaaatttttaaaaacagaggaaaataagtactaatatctggattgtatttttatttctataatgtattaaaatgtgctaagtgattaaaaatacatgagctatttcagaaggtacagaaatgtttcgaactccatatttaaaggaaaggcaaacaaaatgtgggggattagaaggaaacaaaaataaaatgcaaagtgtatttaatattgagaaacaaagtgtttcagtaaggcctatgtgcttacgagagtctgtgcttttgctcagcataacttcactaagaaatgggagaagaggggactgaggctgtcactgtcctttacccagaatcatttttcccttctctgactgttaccaattacccaaagctcaattcaataatcctcatcagtactctaggagtttaactagaaagcaacattaaggtttaaatattgcagttttgtgaatgtaggattgtgaaaatctttctagcagattcccggattattcaggagtgtcagggtctatttctttcatattacttatatatgggtttttctttcctttgaaagcatctctgtttggtaaaaagcaaaattaaagtgaccgtatgttgcatattgtattgaagatggacgaggaaagtggtttaaaaatagataaatgcattttctttcttttaacattacacatactggttactctttcctgtctattttctagacattttttcagtttatgtttgcaagatgatttgtcattctccttgaatttctttctctactaatcttctgcagggacagttagtcacctgacgtgatgagatggttcctgggtctgatgagtttttcgctggtggacgtagccctgctcttgaacacacggatgtccttcaagcctgaagggatgaaatcccatctccctaatgagggagacaataggtttctcagaaaatgggatagtttcttttctttttttttcttttctttgttttctttctttcttttcttttcttttttttttttttttttgagatagagtcactctctgtcactcaggctggagtgcgtggcacaatctaggctccctgcagcctcggcctcccaggttccagcgattctcctgcctcagcctcctgagtagctgggattacaggcacgcacaccatagttttctatttgaatgatttgttatgttggttatctgtgacaaagtcatttgccccttttgggagggaatacataactataataattcaattctgaacttgaagaaaacagaaagcaaagtggcataaaattgccctttttgttgtaatttttttttaaatatttgagacaacgtatttgaaggcacgatgttcccctttcttctgagttggggatattccgtaagtgagtgatgaataatacactatgttccataacgtctctgtgtttaattgtccagagcaccatgtgtatactcacttgaacctggagaattgttcatgtgattggaaacccaaagaaaaccacttcctggctgttgatacaggggccaaaaagttgtaatacctaaagatcacataagtaggtttcttgattgttgtatatttattttgtatcattcctgacttgtaaataaggaaataagtcattaagaaattactaaattaggttgcaaaccatgggcaggaaagaagtcaaacagaatgcctgacacagtcaatcagctaagtctaattttccttccccatttctttttctttttttcctctcctgttgcttttcttcttctttccctttcaggcatctcctccagttttattttctgtaactcacagagtgctgcagaataatgttagggctttgcagtttattccttgcgatttaactgcataaatataaaaagtgcctgagcaataatgcacgttgggttattcaataacacaaggaatgtaaagcgatttcatatctccttgaatcaggaacattaattaatcatatgatgagaatgcaacgttttatttaccagggcaagaggctgccaagatctttctgagtttaataattgcacactctgtggagggaggaaaaattaatttagttattaaattggagggtgctttttttctatcatggtgatgctggaaagtagccaggccataatgttaatgttacgagagttgagatgtggatgactttcactaaaagctttctccacctttactaaaataaaaaaagaaaaaagaatagtgttgggaatggtgcacaaaatttgtttttcgtgagtgtagataataaaacaaagtttctatcttgcccttcaagaacaaatggattgcaatggactaggtgcatgcaaaaatagccccctcccaaggtgcgaatgttgccggaaggaagtgccttgtgccataggccaagtgaagtagttccatggaagcagagcaagtcatcatcaaagtgtaaggttgcaggagaatgaaggtgtcagcgaggaggcagtgtgacaaagggaaacaggaaagaaggtgattaattctgcctaagttcgacacgatcccatgagacgaccctgccatccagagaagcacaatcttcagccttcaagacactttggactttgactattgagtttctaaatttaaaaactaaattgagtgtccttagaaccaatttatcttgaggaggatatcattttttgaggagttaaaagggcaattattgtttctaggtcatttgttaaaaattggcacacaatatattttaatgctatttaggtgcatatctatcatggattattaactttgatcatgtttgttgtctttgctccctagaggtacataagctctgaaggaaatatcaaatcccatccaacattttcactgaagagatcataactttcaatccaaattctataattcaattgcaatattaaatttgaatacatgaaatttatgcaatcattatacatatcgtttctaatagttggactgatagtttgacatagggctaataatgctcccctgttgtaacaagaatttccgggtgcttatatattatgagactactctgcaggcttcatttgttctattcctctttttccacgtggcaacagaggctgaaacatatagaggaaaagaagtacatcggcaaataaaatatgcttataggagagaaaaaacaaatgtctcctatgggatcttgatgaggtaatgtatgttaagttattcagaaaaaagcaaataatatgcaaatgtgaaaagttattacacgtcatgccaactcttagctcccagcccaagcttccaactggagcaagttccccaggctcttaatttccatgagggaaactcagcaaatttaaataatattaatgatatattaatgtagtaatgtgataacaaggcacttagtaataatgaaatggatatatgctattaagaaacttgatttcatatacacttgtcaatatttacattacaggatcaattcaattcaacagatatttattgagttgcatcagacactgtgcttgacgttgtgacttaactataaaagtaggtggtccctgtatttgtggagattacagtctgttgaaggtagacagataatgaaggttgtaattaggtaataacgacgtgatgtgataacatggttttctcatttaacagattcactcatgaatcacaacataattattgagccctaacaaaaatgccagttctcctaacaggctctatagagatatagcattgaatgtaaaagtcagggtctctgtaaaagtcagggtctctgatctcggagaactagatgttcaagggagtcacagcagtgcaatatatgttagagtttcaggaagccatttacaaatattaggcaagtaaatgttatgttccaatttttattttatgtgcctccctctctaaaagaaaatataagagacacagagtaagaacctaagttatcaccttgattcagtaacaagagattgtattagagttccctagagaaaaagaaacaataatataaagatgtacatatacgtctatatacctgttataagaattggctcatacaacaaaggaggccgagaagtcctatgatttaccatctgcaagctatagaaccaagaaagctagtggtattttttagtaggagtccaaaggcctcagaaccaggagcactgatgtccaacgacaggagaaggaagacaaaaatggcgggaagaagaaacaaatgcaaaatatagaaaacaggtacaagcatgatataaatccaactgtattaataattactttaaatgtgaatggtctaaatatgccaattacaagacagagattgccagagtggaaaaaaataaaaatctactggatttaaatgaaaagactcagttgaacataaagggaagaagaatgatgtatcattggctagatacaaatagatgtatctagtcaaaagcaagctggagggccgggtgcagtggctcagccctgttatcccagcactttgcagggcagaggcgggcggatcacaaggtcagagattgagaccatcctggttaacatggtgaaatcctgtctctactaaaaatacaagaaattagctgggcgtggtgccacacacctgtaatcccagctacttgggaggctgaggtaggagaatcgcttgaacccagaagatggaggttgcagtgagcagaaattgtgccactgcactccagcctggatgacacagcaagattccgtctcaaaaaagaaaaaaaaatcaagctggaatagcaatattaatttcagaaaacacacatctcagaacaaagaagatgagcagggataaagagggagattaaacaataataaaagactaaataaaaaacaaaaataaaaaataaaataataataaaagaatacaatggaactaaactagaaattaataacagaaaaattgttggaaatctctaaatatacagaaaatttaaaacatgcttatatataacccaagtatcaaagaagtagtatcaagagaaattgaaaaataattttgaactaaagaaaaatgaaaacagaacttatgaaaatttttgggatgcagcaacagtagtgcttagagggaaatttatggcttcaaatatttacataagaaaagaagaaagatttaaaaaaaatcaatcattttagcctccacccaagagaactagagaaagaagagcaatttaggcttaatgcaagcaggggaaaagatataacaaaattagagctgaaatcaatgaaattggaaccataaatttcacaaatgtaatagaaaaataatctcagaaaccagaaattgttttttgagaaggtttgtcaaaaaaccttgatgaatctctagctgggctaaccaagaaaatagattaatttttctcataaacatggatgcacaagttctcaatgaaatattaacaaattgaatccagcaatatgtaaaaggaattataaactatgaccaagtggcatttatttcagttatacaagattggtttcacacttgaaaatcaaccaatataatctactgtatcaacatgctaaagaagaaaaattatatgattatatcaattactgctgaaaaagcttttgacgaaatccacattcatgataaaactttcagcaaaatacaaatagagtaaaattttctcagcttgaaaaaggaatctacagtaacctacagttaacattatacttaatggagagatacattttctctaagatagagaaaaaggcaatattgtcctctctaactgctcctaaacaacattgtactggaagtctaagttaatacagtaagacaagaaaaaacaattaaaaatgtataaaatggaaaggaagaaacaattatttttattcagatgacataattatctatatacaaaagaatcccaaataatctacaaaatattcctagaactaatgagcaaagtggcaggataaaagattaacatacatagccaaccaattttctatatatcagcaatgagtgattgaaatgaaaaaatttaaaatacaccacttatgacagcagcaaaaatggaatattttgttataaatctgagaatatatgtacagaatgtacatataggaaactataaaacactgatgaaggaagtaaagcatatatatagaaatgttccatattcatgaatcagaacagtcattattgttaagatgtcaattcttcccagtttaatttatacattcaatacaattccaataaaaatcctagcaaactattttttgatatcaactaacaagttgactctcattttatattgaaaggcagaagaccaagaatagccaatgtaatcttaaaaaataaaaataaagttggaggactcacactacccaatttaaaatttaaagactcactatgaaggtacattaataaaggcaatgtggtgttagtgaaaggatggacacatggatcaacaggacaagacaaagaactgataaatagaccaacacatgcatagccaagtgatatttgacaaaggagtgaaagcaatctgtcactagagaaaggataatattttcagcaaatggagctggaacaattaaatgcccatatataaataaaaaatccggacagaaactacattttccaaaaatttgaatcaaaatgggtcataaacttaagtgtaaaatgcaaaactataacattcccagaagaaaacaggagaaaatctgtgtgatctggagtttggcaatttatttttagatacaatacaaaaagcacacctcatgaaaacaattgatacatttgactttattaaagttaaaatcttctgcattgcaaaaaaactaagagaatgaaaatccaagtcataaactgggaaaaaaatgtttgcaaaatttatatctgataaagaacttgtatccaaaatatacaaagaactctttaaatccaacaataagaagacaacccaatttaaaaataagcaaagatcttaataaacatctcaccagataagatatgcagatggaaaataaacatgaaatgatgctcaacatcattagccattagataattgcatattatcacaacaatgagacaccattgcattcctattatggtggccagccctgtcatccttttccagttgaaaataccaattgctggcaggaatgcagagcaacaagaagtttattttgttgctggtagaaatgcaagagtacagccacataggaagagagtttggcagtttttaacaaagctaaacattgccataaatacaactctgtaatcccgctcctaggtatttacccaactgacgtgaaaactgatgtccacaacatgcatgcgaaagtttataacactgtctttcataattgccaaaaattggaagcaaccaagatgtcctttaatatgtgaatagataaacaaactgaagtacaactacacaatagagtactatcattgataagaggtaatgagctacgaagacatgcagaaacatgagtgaatagtaaatgcatattgctaagtagaagaagccagtcttaaaaagctgtatgattccctttatagaatattctggaaaaggggaaactataaagacaataaatacatcaatggttgttggagctttggaggaggtgagttaaataggtggtgagcagaagatattttagggtgggaaactatttttttggtagtgtcataaacaatatatgacagtatgtatttgtcaaaactcacaaaactttataacaaaaagagttagccttaatgtttgccaattaaaaaattatctaagtgactggtggatctcaggataaaatgcggaatgttgcaaaagactccaagtgtattagaaatgtataaaacaaccataccgcatggagagggagaaggtgggatctacataatgttgcaaatatgtggagtctggaatactaatggcaaaaggaactgtgcagaagaactgcactctggttggtaaaggtttttcacaatgggttatggatccacaattctgaaagcagcatacgtgcatagtgcttttgaacaattaggtacttaaatggtgagtggtgaaagtcaactttctcactgctggagtgggaggctacaagtaaggaagggaagagactacaatgatccatgtggtgataaattaaagttgtgggcattagtttgaatatatgtttagcttaatatagatacagaaggttacatacagaaaaatttacatgagttacatgtatatacataggttagcaaacacacatacatttccttgctgtctcagcttagaccctcagagggcctaggagccatgattccccagtaccccagtagtaacaagcatacctagtgcctagatcttggtttcaaattatattctcaaataaaagaaactagagctcagtgaagaaatgacttgagtctaggattggaacatgatatacacaagatgaacctagaacatcttgtagtgacagataagaaaatgctcacaaaaaaagaaaagaaaaagagaaagaaccaccatattgaagacgtttcaaaaggacactagagctaattgaaggaatccccaatggtcaaagctggaacaatttgaataacaaaataaactagtgatggatatgacccagagtataaaatgaaaatccattaatctatactgatataagtaattaattgacaaataaatcggagagaatacaaaaatctgtgcagaagagtttctgtggatgatttgccctagataactctgtattccttaagtgtgggctgcacacagtgacttcttccaaagagtgaagtgggaaagggaaaaagaagaggagttttaagtagagaaacctgatgacactacttcagccatgtaatcatctttcacaactacagtgacaggtcatgttcataatatattcccttgaggtgatttgatgagagtggcattttccctctgtggtcttcttcccaaaatcataacttgaatttaattttgaaaaaaaagatcagatgaatctcaattaagggactttgtttttaaaatacattaaaaaatttttttttaattttttacttgtcccaagaaaaaaaattgagaaactttctacaaaacacttggccaatacttctcaaattgtctaggtcatcaaaaataagaaaagcttgagaaactgtaatacccagaggggcttatggagaaataatgaccaaatattataaggtatctcagatgggatcacgaaagagaaaacgagaacattagataaaaactaagaaactgaaatcaactatggctttttattaaaggtatgctattgatatactaggtcattaaaggtgataaatacattacattattgtaagataatgataacagaaacttggtgtgtggtatataggaactctgtactatataagttttctgtaaatgtaaaattaccttaaaataaaaaagtgtattcaatatttaaaaagaaaattagaattttctctttggtaaatacacaccttacaaatctttacaccagataatggttttggttttgactctctaccttcataaaaaaagttctcaattgtaatattgagaagaattaatgtattaatgcattagacccgaggaatagattaggatcttttttttttttttttggtaccacaattggtaatgatcatattacgtctaacaaaatacatgattacattagtccattcagtattcttttcttatatatatatatatatgctgggtgttggacttggtggttgtcctgcaagggttcacagtcttgttgaagatatacatattaatccaacaatttaccttcaatttattgtggacttaaggtaatgggctgggtgtggtggctcacacccgtaatcccagcacctgggaggccaaggcgggtggatcgtgaggtcaggagatggagaccatcttgactaacacggtcaaaccccatctctactaaaaatacaaaaaattagctggacttggtggcacgtgcctgtagtcccagctactcaggaggctgaggcaaaagaatcacttgaacccgggaggtggaggttgcagtgagccaagatagcgccacagaaaaaaaaaaaaaaaaagataatgaaacccactggtaccttcaaagactttatatgaaaaataaaccctaataagtaattattgcacatggtgattggtgttagggcaaaaccatgataggagataaacttgtgttgggtcaaagaaggtctccccaagtagataattgattgagggaaactttcaaggactagccaactgtagccattttcttcctgtaggcaggaagatgtaatagtgttgcagggcaggtgagcctcaaaattggggcttatcccgagagggcttttggttttgttcaagaaagaattaaagagtgagctatgttggcagaacaaaacagctttattaagacaggagtattacatctctgtgactgtttctgcagaacagggctaccccacaggcagtgtgtccagagtagcagctcaggggcagttccgcagtaatatttatacctacttttaatcatatgcaaattaagggactgattatacagaaatttctagacaatgggtggcaactttttggtaattgacttggaagggggcggcaacttctgagtgttgccatggcaatggtaaacagtcctggcactggcaagcaagtcttatggagaggtacgttcgcctcttccctgtttcaactagtcttcaatctggtccagagttgaatccaacctctggagttgagtcctgcctcctatttcaatagcagatacaaaagcatagcgagaaagcagagagaacaggacatgtttggaaactatgccatgatgcttagagaatgaatgaaggagagggtactgagaaggaagggagaaggacacaactagagatgcaggatgcagccagggtcaggtcctgctaattcctgagtaccatggcagttatcaatccttgtccacagtaattaataataaaaattcaaggcattgatgtaatttggcatcaaagagctaattattggctctcatcattatgtattagagtcatagctgatcagaagttccagggagaagcataaagtcatcaaaagcagtcagctgaatctggcaaaatgaaagtgattgttgcaatatttttggattcagttcagagtttaaatcttttacatctgtgcctccaaccgattcattttagaattggttctgagaataaattgactggcttgtagaatttccatagttcaaggacttgttgctaaagtggaaacaagtcaagtttgaagaatgacctattgcatctggtgtgttgatgacttcctctaactgcaaataatgtagggaaaaaaagagcaactgaacgtttcctgtctgcagaaaagtatctggaagtaacgcattcatcatttcctttggatttcaatagatttgcatttgcactatctttgttgcacatagactgaaacacctgatatttttgcgttcaaccacacattattatttgttggtgggttatttattgtcattttatagactagaaaagtaaatactagaattaaattctaaagccctggatttagaatgtaagaccaacaaagaattgtgcctaccacacattcctaaggtcatttctctattgctttttcactttcaatgcaagttcagagcagcgtttttttataaaggcattaattgctatatgagggttcaaattcaatgttgtgctaccctaacttaatgcttatttgattcagtttatttcaatttgtttgctgttttccacactctgctggcagagccatttagaagctaagatttgttgttgccgttgttgttgttgagacggaatctcattctgtcgtccaggctggagtgaagtggggcaatcttggcttactgcaaccttcgcctttgggattcaagtgattcacttgcctcagcctcccaagtagctgggattacatgtgtgcaccagggcgcccagctaatttctgtatttttagtatagaaggggttttaccatattggccaggctggtctcgaactcctgacctctggtgatccacccgcctaggcctcccaaagtgctgccgtgagccactgtgcctggactggaggctaagttttataggagaaattcaccttgactcttagtaactgtttccactggcagtacatttcttaaggttcttttcttctgagatctgccctttttgtccctgataaatgacccttaaatagggagagactccactggagctgtcggttgaactctgctccatctgcagggtgcacccaggcactaatcacacactactttatccctggagtgtcacagtatcagcaactctgtattcatctgtgaataaaaatagtttttctttatgtttcagaggataaacattgaggcagctttgggatagagtcattacatacatctttttactcaataggtgtatattttgtgcctaccaagcaagtgcaggaaactaaatgcaagagtcttttccttgagatacttccttccttctcctataacctcaacacagaaagttaaaaagtccactgggtgggaattaaagagatatttagctgctgaaagtgcttttggcatctacaaatcattctggttttgtggtgtctgttgcctatcctgtttacgtgaacattgatgaaagaacaaaactaagtcagtctttcttcatctttcttctcgaattctttagagtaggcaaccattatctgctaaaatagctttttagtcatactcatgtctgtgtagtgaaaatatttcccccctaaatgaaatagagttccctcctaaatttgcgtagagtcacaaccagctcttatttcttgctcatgtctaggttactgggcagctgtcttttcatcaataattcaggactcaggcattggtgagctgaaggagaaaaatcatggagatttagaaaagtctttgtggggctagaagcacttctgctcatattctactagttggaagtgggtcagaactcatttgtctagccacaagagctacgggagaggctgtacaatgtagtccagtttgtgcctaagaaaaagagcaacaggaattgatctctgctgtgcctcttgcttttctatcagcagttgggtgggagtgaagtgaacatcaggttccaggaatctcctgagcacccactgcacctcagcacttctgactgcctgtggtgttgcctcctgtgggggcagcaagattacacctcacaaagggtttatgctttcctggaaatattcactttcattgaagtgaacccactatcttctatgggctaaaaagctagatggaggcacagacagtgcatccaagcccaactgatagaaccttccactcttctattcatggcacagaatagccatgcgttgtttatcattgtctgcataactccagatgaggagaatgaaggaaggagagcagtgtggaagtattcactctacatgagacattttctcggtgctacacatacatcatttcatttaactctcacaaccatgttggacttaagcactatccttgctttttaaacgacacaactgcaactgatccttagcagatttaaataagtcactcaaggttatgcaggtagtgaatagaaaaggcaagattttaatctagatttttctgattttttaagctgtttctttaatcgctttgtcaccatcttatcatactgcctcttcactgagattccatgagtgacaacatttgacatctgtccttcacatagtagacacttgacgtatctctatggagaaatgtctgatgtgggtgacttctttgagtatacattgctcttggtcaaatttgagaactattttactaattgtgtttaacacgggggagccatcctatacacaccagtattctttctcttttggtcattgtcttctttcacagtcattatttctaaaatctgctcagaaattttcattttttttttcaagtaatggtttgggctgacttattctcattcattagtcatttcttcatttatttaacaattatactttttaagaacctactgtgggtaagcattctgcttggtgctgggaataagagagaagatataaagataattgtgacttgattattcatccatgagggaatctctggagttttgatttggagaaaagatcatcaaatacttaaagcagaaagttatatgcccttataatgcaaccacagtcacaaaagtgttggttttgcatcttgtgaatattgcaagataatgaattgcctaggaatgcatattttttaaacttttattgtaagttcaggggtacatgcgtaggttacataggtaaacttaatgtcatgggggtttgtcgtacaggttattttgtcacccacgtgttaaggctagtatccattaatatttttcttgatccttttcctcctcccaccctccacgccccaccattttccccagcatgtgttgttcccctgtatgcgtccatgtgttctcatcatttagttcccatgtataagtgagaacatggtatttggttttctgaaattttgggcattggcgtgaaagtctgatttattttatgcttaaggcgttaagtgttttcactgctttttcttcacctcctcacttttatttttggatttactctttgttcacattaaaccactatatttacatctcagacatttgaaatcttaacaacacaaattcagtaatatcagaggacattttggtattgccaatcacttcttcagaagatctctttacctatgaactccagccaagatttcctgtcatcagaactctcaacacatttctctctgtatacgctgcatctaaagaggctgcactgcaaagctgactaaacaaaagtttatggcactcgttccaactttaccactgactagttgtgtgaacttcggacggttgacctctttcggcctcaatttccgaggcaattaataaaatcagaaattccattcatcgttctggattgttccacttaggaattttgactagtttttttctgtgttttataaaaatttaaacacatagcaataaacatggaaactcacccaaacctaagatgttacgcatattgactatttttaatgggagaattctacagcaaaatcttcatgatgcagagaattaggaaaccacatcaaatacgtgttttggtgaagtcttcagatgcattattcaacctctttggctcaattttcatcatgtgaaataaagagagtaaactggaggttatctgaatcttcagaattcagtgctttgagatattatatcaacttaggttgttgaaattgatgtgacagtttaacaactcctatccaaatgggtcacgtgtttctatttaaaaagatataaaccttcttccataaaaatcttttttttgagaacacatgaacatagggaggggaggaacacacactggggcctgtcaggggtgggaatcgggggaggagagcctcaggataaatagctaacgcatgctgggcttcacacctaggtgatgtgttggtaggtgcggcaaaccaccatgacacatgtttacctacgtaacaaacctacacgtcctgcacatgtaacccagaacttaaagttaaatcaaattaaaatttaacagtagaaacaaagtctttttttaaaaattgagaaaatcagttgagaatttagcaggaatatggaatgaaatgtaaatgtttttgctgttttctcaattaattctcatgattttcctgaattatatctagatagataacaaaagcatacagatatcagtatatttaagtaactttaactatgaaaattcaaagtgaacaaacataattatggaaataattttctcacttaaaagagcattttcttggagttagttgttacccatgttttttcttattttgtcagagaattttgggaagtagcaaaatgtaaaactacaactgaaacatgactatcattgtctaaaaatcagggtaagtcccatccagtgtgttgtagatatttttttcattgattttaatctaaacacattaattctcttttaaaattaagcattttcccacaaactcaaaggtcaccagagaatttgttcaagacttaaaaaaaagttctatttgtgttttagattcaggcagaacatgtataggtttgttacctgggtatattgtgtgatgctgaggtttggagtatgattgatcctatcatcaaggtagaccataatattcaacaggtagttttatagccctttccttttccctccctccccctctgttagtcctcagtggccattgttcccatctctacatctgtgtgtacccaatgtttagctcccacgtataagtgagaatattggtatttggttttctgttcctgcattaatttgcttaggataatggcctctggctgcatccatgttactgcaaaacatgatttcactcttttgtagggttgtgtcatattccatggtgtatatataccacaccacattttctttattcagtccaccactgagagtcacctaggttgattccatgactttgctattgtgactagtgcggcaatgaacatatgcatgaatgtatctttttggtagaatgatttatatttctttgggtacacaccccgtaatgagatggctaggtcaaacggtagctctgattttagttctttgagaaatctccaaactgcttttcacagtgggctgagctaatttacatttctaacaacagtgtataagtgttcccttttctccgcagcctcgccagtatctgttatttttttactttttaccaacagccattctgactgatgtgacatgatgtctcactgtggtttcgatttgcatttctctgatgatcagtgatgtgagcttctttatttacgtttgttggctgcttgtatgtctttttttgggaagtatctgtgacttcttttgcattaataatctgtataggttaagtaagagcaatcttcaatagttaactgaatatcatattaatgatctgcttcattttgagtaaactagtgcttctattccagaaagtggtataaaaaaaacctggtgaatataatataatataataaatataatactttctgtatataatgtgcccgactgaaaaatttatgattatattttccaagtaaattactagatttgcacagctaggtttaaaagagaaaaaggtcagcaaaaaaggtggggtgggttatggtaatttccatacaccacaccccaaactggcaaaggtatatcacaattaatcatcttatgacgttagaagagtgtctgtttccacccgagttacacattggcagagatatgcatgcattgaattctgctacactttaaacaaaggatacaaattgctaaggaaaggacagtctcagccagcaatatcaattctcagaaccagaagagaaagtaagatcttttcacatgctttccgttctttccgttgcattttgcattcttcttatccattctatttcctttcccacccctcctaggcctctatcgattaaggttgtactgttccactgctttccaccagggtccagtggctacatccctctccttgtcaaaatctgctttaaagaaagcctctgataatctttcccccactccccggcccttgggtagagcaataatttaaagtattgccatacccagaagagttgcattttaacaggaatcaaatgccttggggtaagaaatgaaactcttcttatataatttcaggcatcagtaagcagatgggacatttatctgaggggttttcctagtctctggaactctgtgggacttctccaatcccatctatgtagaaagttattccagacattgctaatgttaccatcatctgcatcatgttttatactctaacacgtcgctaacttcagaaaactcagcttccctgtataccagccttatgctggacaatgtgcatcaagttcccatatgaaactcttctacaactgccttccccagatttatttagacatttcaatgctgacccatttttattgttttactgtatctacccttaaatagaagaatcagtgacaggcaggagagaaacataaacttgggaaggagaagaaaaggaaaaaactggaataacctataaagaatacaacaaaacaatgtagagtacagagaacattatctttcaagctgatttacaggtaccattcagttcatttaggctatatcacttacggtagtggattctttgaatcagataatagtctcaatctgtcacttccctgttccttgcatagataatacctctgagtcatactccctagagcatagttaattgataaaagggtgcttttaggacacaccaaagtccaaaaacaaaaaaatagcaaatcaacatcaaggcagctaactagaaaggaaaaggagaatcgtaactggttgcatgatttgattgctaatctcatcattgggaacaccttcatgatgatgtaaccatattacatagttctactatgtattggcagagtcaatatgattgtaattgctgaaatgaatgtatgctgcttcagttcacttaattagacagacatcctttggctgactatagtttatttgctgtgaccaccactgctctaagtgaaaaatcttatttctgggttaaattctagactatatcctacctggcctttacttcctttgagtctctccactatagtaggctctacacaacagttaccactttaatcttccgagaagtgatggccattgtgtcatattcctttcccccaaatattttatagttatctgatttctaaaagataaagacaaaatcctttagtttatcactcagtactttgtagtctaaatctacctacttttcaacctaatttctcatgaatctcctgcattaatcctccactttattctgggtttttacccatttgtctcccaattcccctagaattgagttaaggtggagtctcactctgtcacccaggctggagtacaatggcatggcatggtctcggcttactgcaacctccacctcccaggttcaagcaattctcctgcctcatcctacagagtagctgggactacaggcatgtgccaccacgcccggctaatttttgtatttttagtagagacggggtttcactatgttggccaggctggtctcgaactcctgacctcatgatccacccgccttggcctcccaaagtgctgggattacaggtgtgagccaccgcgcccagcctgattctgctgctttctagttatatgaccttgcataagttacttgacatctttgtactcagtttactcatctgtaaaataaaatagctatatcttgtatctcctagaatttttatgaagattataattttaaacttgatcaatattcagattaatactttgctattatgaatcattttaaatttgttattaaataacaaaataaagcagatagctattatttcactgaattctaagtaccacgagagtgacttaccgcatatattttgctatatctcctgaattcagaagagttcatggcactttcaagacaataaatgcttgttgaataataatagtaattattatgcatcttattttgggctctaattattattactcttctgacagaggcatgcataaatgttacaagtgtggccagagtgatactctacctaaattgtctacatttacaagccttgttttttgagtatattgtatgagaaagttaaaaagtcaatgcttctcattacactaaattcacttttctgcctcacggacatttggtaaaccatggcacctacatatttacacctatagacgtctgtaaattgtttaagttacccaacaatgaatagataattttaaaataataataccaggttcatgtgtttacttacttgtgaccaattaattaaaattttatatcttgtcatcttataacaaatgatcactgatcctatgaaacagtttcaaaatggggctttgaataaagactatttatgacgagtccagagtgtgaactttacagagagtaatgcttatgtggagtcttttatttgtggtaagaaatgatttaattttttaaaaaattatccttgaatccccactgctcgaaattacttctgtttatgtacagagagttgagctagtggaggaaaaggcatataaattaatggggtcctttcctccacttgagtacaacaaagcttcaagatcgaggatgtgataggaaccacggccaaataacgcttacaaactttaacaatcaaacgaatccctcttagcaaggggagaaaatataaaacatgaactgctgcttgacacagaacctgggctaggaggtgaacaggctgtaaagacttgttccattgattcagttacttggttttacttttagaattcaagaaataagggtatttatctcaagaaaaagggctctggtctccatcccacttcatattttattttaaatggagaagttcatattaagcaaatgctttggaaaacaggtaaatatggtcaagcccctaagagtaactctatgtgtttttctcaccaatatgtcctcagttctagagcagtttttgacacataattggggaattggtaataatttgttgaatgtttcaagtctttcttatgaagatatcctagactttagatagtcaacaaataaataaattgattgaccaattatttacagtttgcttcattgtcttagcatcctatatcgatatttttaattctcagaacccttttaagaattgagatgaaagtgtgttgatgaccttctatccctaaatattccagtgtgtattattaaaaataagagcactctccaatatcaccactacatgaattaggaaatttaacattgctaatgttaaatatataacacattgtctaatccacagtctatattcaaagtctttaattgtcctaataattctttgttttttgagacaagagtctcactctgtcacctaggctggagtgacaccccgtctgccatggcacgactgtggctcactgcagcctcaaactcctgggctcaagccatcctcccaccccaaccttccaagtagctggaactacaggcatacaccagcacacctggctaatttttgcagtttttggagacatgaggtttcactatgttccccaggctggtctggaactcctgggctcaagcgatccacccatcttggcctctcaaagtgctaagattataggcgtgaaccaacatgcctggacaataatatttttaataagatccagtccagaatcacacattgcatttagtttcatgagattttagtttcatgtagtcttgaacaatttctcagtctttgtctttctgggccttggcgtttttggagattgttcaattatttttgtataaggcactccgatttcagtttgtctgatgtttcttcatgatatgattcaaattatgcagtttttgggaagaggacaggaataccacaaatgtgatgtggtgtccttctcggtatgttatttcaggaggcacttgaatttggtttgctattactgatgactttagttgtagttgcttgataaatgtgctgtccactcggtttctcaaccatagtctctattttcctctttgtatgtatttgtgagaagacactcagagactgtgaggggagactgtgagactaatgtgtgtttctgaggggatgctctaagactgtgcaaatatcctcttcttcaccaaactttgaactactggttttagcatattcattgatgattttctaactctatcactgtatcccagattattgattataagcagagttttaaagagatattttcaagatattttcaactatgtataatgaaaaatttaaaaagccatattagagataagtggatgcatagattagagccacagagattagaaaaatgaacatcattttaactctgggggactttttttttttccagcaatgagattctttctctttagccacggcaccaaactctgaaccggctgagcctggttagcccttgattcattgtataagttgacccccctaaaacaagaaaaacgatgaagatgaacaacctgaactggactcctgccaagtccacaaaccgattttgcaagtgagatgactcatcgccagaagaattgtagacctattgaccttagcatttatttattttttatattttgagacagggtcttgctctgtcacccaggtggagtgcagagatgcaataatagctcacctcagcctcccgagctcaagtgatcctcccacctcagtctcccctgtagctgggaaccacaggtgccaccactacaccctgcttattatctttttaaatttttttttgtacagatagagtctcactatattgcctaggctgacagagtatttttttccttaattattctttattctcaaatgcagtgaacagtcacagtagcccaccatagggggttcattttcagacattacagtaactaggggaattttattaaggagccagcagctaaaccattattgttattattcttcttctttaaaccaaactacagacttattcagatttcatcagtcttcccatcagtgctgtctttctggtccatgatccaatgtaggattccacatcacagttagtttttatcactctatgtcctctcccactctgtgatggttcctcagtatctctttgtcttccaggacctgacacttttgaagagtattggacagctattttgaagaatgtcctgcaattctgcctaatgtgtttcaatgaataaatgttacacgtgcattgttggccaagagtaccacagaaatgataagcccttcttagtgtatcaaatcaggtagtgtgggatgtcaatatgtcttattactggtgattttaatcttgatcacttggctgagatggcatcttccaggtgtttccatttttaaaattactatttttcctttagcaatgaatgggtatcttgagggtgataattttgcactaggcacatataatctttctcctcaaagttttacccatgaattttggctttcattggcacatcttgcctgcaacaattattactgtggtatcctattggtgaattcatatttccatcttctttctacatttattcattgggagagctgttatttcccattcattcattcattcattcatccatttctttatgtcatagactcatagaggcttattgtattctcttggtaaaaataatctattaatttttttatattatactttaagttttagggtacatgtgcacaaca

SEQ ID NO: 1771 - DNA, 27927 bp, Homo sapiens; identical to SEQ ID NO: 1770

SEQ ID NO: 1772 - DNA, 2920 bp, Homo sapiens
gaccccccaaccaacacctggccaccctgcttggtgctgtccagctcctaaggagggcccagcatggaacactggggtgtgcgcgggggcagggtggcgctgctgtcttccaggtgccaggtcccctctatggccacatttggagcagcttgggagaccagctagccttggtccctcccaccacccaacccaggggaaggatccaggaaccaggaagaggagccagtggccctgaagttcaggcatgatgatcagcttggaactgtgatcctggcccctgggaggcaggggaggaaacgactgacccactccgtccctgccgcctactcacaccccccagcccccagaacagggcccctggacaaggaggctgcacttgggacagcaggcagcagaaagcaccacagaaggaaaggctgtactaccgtcttcgtcctctctccagtcctcctcttctgaggttcagggagtggccgcagcggaggggaaaagcgagacaggttagtctgggagcagagagcccgcggcaggagcagccacccagcgcagtggttttaagagtgtgggctttggagttaggccggcattccaattcccaagccactactttccagcaacaggggcaactctcagttacttccctgagcctcaggtgcctcatcagtaaaatgggaatcattctactcacttctcagccgtggtgaggactgaatgacctagcgtgcatagagcgcccagcaggtgcctggcacaagaggagcatgcgatctgtggtaactgcaatgcctctagacgacagagccttggcctccttcttactaagacagaggcccctaaagagcagagagtgggggacaattctcttccatcaaatttcctgccctcaacgagcctgcccatgttcctgctctgaatgaggctcttgggtatcctgcaaactatgtccagtttccaggagtcacactttagaaagcctcattggagagcctggccccaggggagatttgcccggcctgttgggaggatgctgccccatctaagaagggtccagcattataaatctaaggaaagaggctgcatctacaacagttgttctacgtacaaatatctgcccaaaaaaacagttccagcaagtggaacaattcctctcctggaagaaggacacctggcattatctatcctgcaggcttagtggacacccatctagacgttgctctctcttgatcatttgcagccagatcctcaactgtgtgggaggcaagtctcgtctattcatggcaagcaaggcagatgctacacggctcaggccccagcacagtggagaatgactctgctaactcacagccaaattctactgtgtgtggcaggcagattggtcccaaatccagagatctatgtctcaaactccaccaccctaaacctgttataaggaagtggaaaatcctccaaaacaaaggaagggatatcatatcaagagtctgttcagggaacacagcagaatttggagccagttagattttttattcaaaaatatatttctgatagcttctgaagtatctggtgttccttaaaaaccaaaaaagacgcctgtggcctctttcagtttctcctgtgaatttctcttctgtctcctctttggccagacagccctggaacagccctaaatgtgcaggagggtccccattttccctaggagccatggggagcaagggcggggccacctgggctccccccttggaccttcatagagacccttctcctaatatctacatgccacatgctgaagtgatacctgagccactaaaaggcagggtccacctgcctggggtgcagggggaggactggagtgaagcctctgagtcatttccatgtgccaagctctcaggaagaagggaaggtgagggcgttctttcagggagatgtgggacccacagctgaggagggcgatgggttaaccgatcagcataggagcagcaagaggggcctctgcaagctcagaatcatgacaaatcttcatgccgagataagacgtctcagatcactgagcaatttcatactcacaatcgcatttgagaaattactaaatggaatcttttggggcatatcatggcattgtggttatggtttttaagtagtgcttatctcttagagatacggtgtagcgaaatcttgaagcgtgaactgacatggtgcctgggaacaattttggatgtctgctccaaaataactggtggaaggtggagtatagaggaaagaagactggccctaagatgatgattgttgaagctggtaatgggtaccttgggcagggggggccattattattattattgctacctttatgtgcatttaaaatttcccatgataaaagggagaagaagcaaaaaaaattgggaaaagtgatcagtgtgtttgaagcaaatggcagacagaagagacaggtttaaatcgtttgcctcaagacccgagcaacccaggtaggactgattcccattttagaaggcactgttgttggaggatcttgctcagctgagagtgaggagcagggacagatgagctgctttcccagggctcccaggatttccacattgctgagcctgcccctttctggctctccacctgcctgaggcacataccttcaacagctgcttctgctcagaagagaagtccaggcagcaagagaagagagaagagccaagactggccaaggacactgatgaccctggagctgaacctctgtgcttcccgaagtctctcggcctgtgctctgcctgggatctacaacccaggggtacaggagtggaaaggaaatggctatatctctcctcggggtgcccaaaacacacacagctacttctacccagaatccgagggacagctgggaggctcctggaccaggtgtcagggcagcggcgggaga

SEQ ID NO: 1773 - DNA, 2920 bp, Homo sapiens; identical to SEQ ID NO: 1772

SEQ ID NO: 1774 - DNA, 2901 bp, Homo sapiens
ttgttctcaagactcctaaataaagcatttcccctgtgtgggcgacccctgggtcccatgtggggtcagtgtttgggtctctctgagaggatcaggaaggctgctcttccaggaagggctgcagggaccctgggaaccggaccagtccagctcacaagtatgaagagaatgtcgggagaggaagtggtggctatgagtcagcatgagtcatctcgttccaatgagaatgaaggctgaggtgtgcgccttttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgacaagcaaagtggatcagcaaaggctgcagtcaccagcatcttttccaaccttaatgaactgtatcctcaaaagaacactatcagactggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggaaaggagaaagagactacctactgcatttctgtcactcgctgaaaaggacactctgtcagaaaatcttctagcaaacttcaaagggcaaaatcaccccttgttactgataaagcccagagagcttcagcagctaacattccctggacagggcacagcaaggatttgaacctaggtcagtctggccagaacacccacaagctttccttaactcagtgtgctatctccccacgactaggtcactactgctttataatcacctttgtagccaccagtggattttgctcatcagtatttttcaggcaattgatactttagatattcagctgcaagacgtatgcagttttcattgacatcttttggagaaactgacaaacctggacttgacttaatgcctttggaaccttccaagatgttatataactctagatagaaggctgggcctccatgatgtcaggaatgttgcattcttatttccccatagataaacccatttgtccacaaagtcaaggagtcaggcagaggcccttgccatggggctttttaggataaagcaacaagcctggactttgctctacaacagggttttgcatagggagtggtatgaccagatccctcaagaaagaaagcttagagaccaggccagagtccactgcagtagcccagtcaagagaggatggtgacttggacttgtagtagagccagttagaatgaaagaaattgacacattcagaaatggttttagagatagagtcaaactggacctgataaagaactagagaagcggagtgaggataaagagaagagccatgactgactcggaagattttgtcttgaaaaacttgagaactcaagacagagtgaaataaaatcacatgtgggaaaaatctcctgctttgttttggactactttgaagtgaaatgcctgttaagcctaagtggggtaggtcatggcgtacatgactgtgggctcaggatggatacaggcattcaggagttgtgagcaaatagaacttaaagccatgagagaagaagggatcaccaagagagacagtgtggcatagagaagaaaaggggtggaagacgatccctgggcagaaaagtccttagagcagaggcaacaggcatgaccaagaagactaagaaagaacattcagtacagcaggaggagagcaaaaaatgtgtggtattctagaagcaaagagaataaagggcttcaggaaggagcagtcaagtgtgtcaaataagataaagacagacaagtcccctggattgggtaggaataaaataacaacagactgccatacaaatggttctatctacaccatctaaaagaatatagtttattctccatacatttaagaaacacctgccatatgccaggtatcctttcaagcactgaaatgcagattcataaaacatggtctctgctctcaaggagctcacagtggtaaggaggaaacaggcaatagcgagtgttctcattgcattcgtgaccccattgatcttgcaacagccccatgcatcagttattgccattataccattttaccgataaggaaactgtggcagggaggggtcaagcaccttgggtatttgacagcaaaaccaaggcttggtggtatcataaaacttccaagtagtaattcacaaaggtgactgggaaatggaagtgaccagaaatctttgcactatgaggacaagttcatgaccctgatacattcttgtccaggtagtatagctccagaccaaatgtctgcggccacccacccaaaaacttgttggataaaaatgactacacctatagtcaaatgatttttgacaaaggtgccaaacagttagataggaaaaagaaagttattttcaataaatgttgctggagcaaccagatatccatatggaaaaaaaatcttgaccacctacctcacaccaaacactaatattaacttgagatggatcataaacctaagtctgaaaactaatagtaaagttcttgagaagagaacatgggagaatgtcttcatgatgttcaggtaggcaaagatattttaagacacaaaaaagcaataagcataaaatttgtaaagaggtgactggggctttatcaaaattaaaatttatgtgtattaaaagacatcatgaataaagggaaaagggcagccacagactgggagaaactctttactatacatatacctaactgagg

SEQ ID NO: 1775 - DNA, 2901 bp, Homo sapiens; identical to SEQ ID NO: 1774

SEQ ID NO: 1776 - DNA, 2901 bp, Homo sapiens; identical to SEQ ID NO: 1774

SEQ ID NO: 1777 - DNA, 11167 bp, Homo sapiens
aatgtatctcccggatgtccagaatatgccatctgcaaaactgaactcgtcctctttcccccgaatgtatctcccggatgtccagaatacgccatcggcaaaactgaactcgtcctgtttcccccgaatgtatctcccggatgtccagaatacgccatctgcaaaacagaacttgtcctctttcccccaaatgtgtgtccactgcttgaaccaggaaactggatatcatcttaaatcctccctttcccaccaccaccaaatccaagctggggagcccctcttctttactgcctctgaaaaccgcactgtccccccacaccccatggatcctgcttgaacccaggcactcatcacttcttcgctggggtgccaggagcagggaggatctctgccctccctggtgcaggtgcaaccaccagatccacaagtgcagacctgggcctctgctccaccaagccggcaggagccaaggacaagcaggaaccccaccccttctgagttggcagggtgggagctccctgggtgcagctgcagccaccttcccaggtacaagacctaggtgtctctgcaacctacacccttaggggccagggaaggccccccgaccccggtacccataagcccaggggtgtcttctccagttgcctggcttctcactgctccgggcacaggctcccatatcagagcagggttggagccaaggccgggtgctatcacagtttggcatggtctgcacacacttggatcagtgctggcaagccagtgccctgctgccccagccccctccagaatttgggtaccaatgagagtaggaggggaagcagaggggagctctgaggattgctcagtgctggcctgcaggtgcctcttggtgccagcagccagggggacagggacagcagaaggcaggcaggctcctgggtggaagtgggtgggttgccagtaagaccccaccttcaggccaaggagggcctgaaggctgggagccaggctgccagaccagcagaatggagtggggacttgtggtgccttttctggactgcccatggccctccatgaactgatcaacagggacttcttccctctaaggtccaaaaaagccccaggctcagccagagcagggcagaggacagatgacagaggacagatggcctgctgcagtgaggaactactctctcttctgagagcttcagagacctgcagagacatagggactaccagctgcagagagaagtaactttctcgagggcctcctttctggtgagagcagcagatgtcaggatgatgaccaatagcagagaggagctaccctctccagggcctcctctctgcttgagagctgagcactcaatgggaagatctgcttacagagaagatgatctgcctacagagaggagctatgcactaagggtttcctctgagctgttctaacacttagtaaagctttctttgtcttgttcacccttcacttgtttgcatacctcattcttctagaggcaagacaggaactaaggcaaagatgccaccagccacagaggtttctggccagaaaatcaataccccaaagatcctgtaacagtgcaagaaggcaggcaggctcctgggtggaagtgggtgggttgccagtaagaccccaccttcaggccaaggagggcctgaaggctgggagccaggctgccagaccagcagaatggagtggggacttgtggtgccttttctggactgcccatggccctccatgaactgatcaacagggacttcttccctctaaggtccaaaaaagccccaggctcagccagagcagggcagaggacagatgacggaggacagatggcctgctgcagtgaggaactactctctcttctgagagcttcagagacctgcagagacatagggactaccagctgcagagagaagtaactttctcgagggcctcctttctggtgagagcagcagatgtcaggatgatgaccaatagcagagaggagctaccctctccagggcctcctctctgcttgagagctgagcactcaatgggaagatctgcttacagagaagatgatctgcctacagagaggagctatgcactaagggtttcctctgagctgttctaacacttagtaaagctttctttgtcttgttcacccttcacttgtttgcatacctcattcttctagaggcaagacaggaactaaggcaaagatgccaccagccacagaggtttctggccagaaaatcaataccccaaagatcctgtaacagtgcaagaaggagaaaagtgttctatagttttatatctcagtcttttagtgagcctgtgtctctaaactgtgaacttcaaacagagcttctcgacccccccaacactccccttaggcaggacaagatggctagaatgaactgaagttgagtatttctcttcccctatgtagaaggctaaggcatgctggagcatgctatttcctttcttccaggttggttaggctctgataaaatcccaatagtttaggctctgataaaatagtttctcctgaggccaggcctttttgactagaagagaatgatctgacttacttcaaatagttcctcctccctctcctcaccagaagaacaagatcttttttttttttttctgatattcactgtgagaacctagttgaactcctgaaaccagaactcacaaaagtgggaggccctcctttgaatgggtccccctggactgtttaactctcatacttatttactgtgaatgcccagcaattcatcaattacagttcaggtttttctaccccatactggttcccacaaaggtttctgctcaagggtttctgctgcagtaatttgtgattctaagtattttcttgtcagtctttccaatttaaggggcagtaaacctcacttctctgatggatctaagagttgttaattaatcagtttgttcagccttttatttgttgttaggatgtagtgacaacttccaagctccttacgtactggattgcaaaccagaagtcaaactattccttagaaatgaaggggaagtaaagtcattttcagatgacaggatactaaaagaatatgtcaccagaagacttgcccttaaggaatgactaaagcaagtgctcagaacagaaaggaaataataacaaaagacttcaggacctcaggaagaaagaaagaaaagtggatatgaccataaaatgtaatcaattatttaaacaaaagtaataacaatgtagcgtgatgttaacatgtatgtaagtaaaatgaatgacaacaataatataaaggtcagaaggggagaaatggaagtatcctgttgtaagtttcttatgctatacgcgaactggtataatatcatttgaaggtaggctataataagttaaagatgtgttctgttaatcctaagaaatatgaaaataacacaataacaaagagttacagcaaataagacaacaaaagagataaagttggatcataaaaataatcaatttgaaaaaagtcagggaaaaacagaaaaaagagcaaaaacatatgggataaattgagaaaaacagtgagatgacaggaattaaacctaactatatgaataattacattaaatgtaaatggcctaaacaacaccagtaaaaggcaatttgtcaaattagattttttaaaatgctaatccaactatgtgctttttaccaacacaaaaaggcactttaaatgtaaagacataactatgttaaagaaaaaggatgggaaaaagatacaatgtaaagactaacaaagaatctagagtggctatattaatataaaagtggatttcaagcaaagaatattatcaagcataaagaagaacatttaaaaatgttaaagggatcaacttgtcaagagaccataataatcctaaatgtttatgcacctaataacagagctccaaagtacataaaacagaaatcaataaaactataaggagaaattaacaaatacagatataaattagatattttaatacctctctctcaataattgatagaatgagtaaagaaaaagatcaccaaggatatagatgacttgaacaacactactaataaaatatacctacttggcatttatagaacacgtcatgcagaaatagcagaatacacattgtttacaagggcacgtgaaacatttttcaagatatattctatattctgagccataaacaatgcataatacatttaaaaggattcaagtcaaacaaagtatgttttcggagcaatctgtaattaaaatagaattctttagcagaaatctatctggaaaattcccaaaggtttggaaacaaagtaatgtgtttgtcaataaccaggggtaaaataagaaatcaaaaggaaaattagaaaatatcttgaaaaataatcaaatgagaacacaatatatcaacaatagtggaatgccacttcagcaatatgtagaaggaaatatacagcactggatttctactttagaaaaaagaaaacatctcaagccaatgacctcatcttccactttaaaaattagaaaagaagagcaaattaagccaaagtaagcattaaaagggaaataataaagatcagaatgaaaaatcaataaaatagcagacagaaaaaaatagaaaaaatcaataaaaccaaaagctagttctttgaatagatcaataaaatttaaaaacctctaggtgtattgatttaaaaaattacttaagacacaaattcatcaatattaggatttataaaggtgggatcactcagattctacagatattaaaaggataataaggaagtattgtaaacttttatgcctataaattttaaaacttagataaaatggataaattcctggcaaggcacaatctaccagagcccactcaaaaagaaagaaagaacccagacaatcctctatttacggaataaattgaatgtttagtttaaaatgtatgcatgaagaaaattcccggttgacatggcttcactagtgaactctaccaaacattaagagaaggaaaaataacaatccttacaaacgttttctgaaaattgaagagatgagaataattccaaattattttatgagcctattattgctctgattttaaagtgaaacaaagaaaactatagatgaataactaactctcatgaacataaatgcaacatttctaaagaaatttagcaaatctaatccaacaatatgtaaaaaggataaaacatggtgaacaagaagggtttatcccgggaatacattgattgggttttgatgttcaaaacccaatcaatgtaaatcactattaactacaaaataaaagcaatatgatcatctaaatagatgtagaaaaaaaatctgaaaaaaacccaacacccattcctgattaaaaactattagaaaactaggaatagaaaagcattttctcaaccaattgaacaattgaagggtagctatgaaaaacctacagctaatatcatatttcatgataaaagatggagttttcttactctaaattcaagaatcagggaaaagtgtctgctctcaccactctatttaacagtgctggaaatattagccagcaaaacagataaagaaaaataaataaatggcatagactggaaagattcatagttggcacaattatgtatatataaaatcctcaggaatgtacactttacatactagaatttaaaagtaagtttagcaactgtgttagttcgttttcatgctgctgataaagacatacctgagactggacaatttacaaaagaaaggtttattggacctatagttccacatgtctggggaggcctcacaatcatggcggcaggcaaggaggggcaagtcacatcttatgtggatggcaacaggcaaagagagagcttgtgcagggaaactcctgtttttaaaaccaccagatctcatgacacccattcactgtcaggagaacagcatgggaaagacccacccccatgattcaattgtctcccacaaggcccctcccataccacatgggaattatgggagctacaagatgagatttgggtggggacacagagccaaaccacatcagcaacatgtcagaacacagaaaaaatgtaaaatatcactgtatttctatgtactagtagtgaactgtcagatgttaaaattcaattgcttagaatggcatcaaaaatatgaaatactggccaggcgttatggctcttgcctgtactcccattgctttggaaggctgaggcgggtggatacctttgaggccaggagttcaagaccatcctgagcaacagggcaaaaccttgtctctactaaaaatacaaaaaattagctgggcatggtggcctgtacctataatcccagctacttgggaggctgagacacaacaatcacttgaacctgggatgcagaggttgcagggagctgagattgaaccactgtactccagcctggggaacaaactgagactctgtctcaaaaaaaaagaaagaaatacttatgggtaaatctgacaaaataagtgtaagacctgtacactaaaaactacaaaacattgctgaaataaattaaagaagacctaaataatcggagagatatactttgtttaaaggtcagaagtctcagtattgctaaaatgagaactcttcccaatgcagtgctaatcaaatttctagcaggctttttgtagaaattgaaaagcagatttgaaattcatatggaagtgcgaacaaaaccaaaagagccaatataactttaaaaaagagaaaagatgaagttctaaaactatctgctttcaagatttattataaagctacaagtgatcaaaatattctagtactagcagcaagatagaggaaaagatcaatgaaccaaatagaaagtccagaaatagacacactcaaaaatatggacaactgattttggacaatattgcaaaagcaattcaatgaagaaaggatagccttttcaacaaacagtactggaagagttagattcctgtatgcagaaacagacaaaaacaatgaacttggatgcaaacgtgcattatataaaaagaagtgattcaaatggattgcagatctcaatgtaaaatctaaaactataaacctttagaagaaaacataaaagaaaatcttcatgaccttgggttaggcagagtttttaggtatgacaccaaacacacagtccataaaaaataaattgataaattagactttatcaaaatttaaaattttcattctttgaaagatactctgaagagattgaaaaaataagccacagattgggagaaaatgtttgccaagaatacacatctgataatgcacttatatccagaatatatgaagaattcttaaaactcaataataagaaaatagccccattaaaaataaaataggcaaaggatttcaacagacatttccccaaagaagatatatggatggtaataagcacatgagaagatgtcagcatcattagggaagttcaaattaaaaccaccatgtgataccactacatgtattttagaattgctaaaattaagaagactgaccatatggggtgaggatatggaggaaatgaaattctcatacaatgctattggtaatgtaaaatcaaactaccactttggaaaacagattaaagtttcgtgaaaagttaaacatgcacctaccacatgtcccagcctctcagttctaccagaaaagaaagcagatatccatacagagatttgtacaccaatgttcatggtacatttattggtaaatagccccaaactggagacaactcaaaagttcatcaacagatgaatggataaacaaattgtgatatatccatacaatggactattactcagtaaaaaagaaaaaaaagaaaataatagtaatggataatcacaacatgcataaatctcaaaaataattatattaagtaaaacaaaccagtcaaaaaagaccatatactctttattccattttaataaaactatagaaaatgaaaatctttggtgatataaaacaaactagtagtgaggaagagaggcttgggagggaaattataaattacatgaagcaacttttgggagtgatagaaatatttactatattgattgttatgatggtttcatggatatatacatatgcaaaaacatatctacacttcaaatatgtggaatttttgtaggttatttatacagcaataagcctgctcaaaaaagtaaatcgagcaatggagggtaccaagattttacttgcatatgactgttctctatctagcctgcaaacaggtgcacacaaaatctgcaactttaactggagcttgccaggcaacacctctgcaacattatgcaaatcactgtgagaaagagacaataattatgtcaaaaaccaccaaaatatgtttgtttccacacactttttttaaaattcccagatctgggctgtctacagtatgtgcctgccagttaacctaacttggggcttttcactttggtttaaagaatctgaaattgagctctgctcaagttaagtgcatgtggtgattcatgtgcatggaaagtaccttgggctgaccacaaactagagttccctacaactacatcaatgtcaaaactaaccactgtctcctagcttgtttgtttaaaaaaaaaaatcccatggtcttcaatttggtcatttaaaaataatctacaaggtatactgtttttctgttcttgttatttcctaacttttaaggtttctatttttccaccctgtagatcttgttctcactagagaataatttctacattatgcccaggttcttctgagctatgaaggggcccagatttaagggctatttttgacaccctaaatgtgctgagacaagtcattaaggtggtcctgccaggacacagccatctaaagcagcaatctgcttcttgccagaaaatctcgtgcctctgcagagccttttccagaatgaaccacaccatgctgaggaaaggagaaagagactacctactgcatttctgtcactcgctgaaaaggacactctgtcagaaaatcttctagcaaacttcaaagggcaaaatcaccccttgttactgataaagcccagagagcttcagcagctaacattccctggacagggcacagcaaggatttgaacctaggtcagtctggccagaacacccacaagctttccttaactcagtgtgctatctccccacgactaggtcactactgctttataatcacctttgtagccaccagtggattttgctcatcagtatttttcaggcaattgatactttagatattcagctgcaagacgtatgcagttttcattgacatcttttggagaaactgacaaacctggacttgacttaatgcctttggaaccttccaagatgttatataactctagatagaaggctgggcctccatgatgtcaggaatgttgcattcttatttccccatagataaacccatttgtccacaaagtcaaggagtcaggcagaggcccttgccatggggctttttaggataaagcaacaagcctggactttgctctacaacagggttttgcatagggagtggtatgaccagatccctcaagaaagaaagcttagagaccaggccagagtccactgcagtagcccagtcaagagaggatggtgacttggacttgtagtagagccagttagaatgaaagaaattgacacattcagaaatggttttagagatagagtcaaactggacctgataaagaactagagaagcggagtgaggataaagagaagagccatgactgactcggaagattttgtcttgaaaaacttgagaactcaagacagagtgaaataaaatcacatgtgggaaaaatctcctgctttgttttggactactttgaagtgaaatgcctgttaagcctaagtggggtaggtcatggcgtacatgactgtgggctcaggatggatacaggcattcaggagttgtgagcaaatagaacttaaagccatgagagaagaagggatcaccaagagagacagtgtggcatagagaagaaaaggggtggaagacgatccctgggcagaaaagtccttagagcagaggcaacaggcatgaccaagaagactaagaaagaacattcagtacagcaggaggagagcaaaaaatgtgtggtattctagaagcaaagagaataaagggcttcaggaaggagcagtcaagtgtgtcaaataagataaagacagacaagtcccctggattgggtaggaataaaataacaacagactgccatacaaatggttctatctacaccatctaaaagaatatagtttattctccatacatttaagaaacacctgccatatgccaggtatcctttcaagcactgaaatgcagattcataaaacatggtctctgctctcaaggagctcacagtggtaaggaggaaacaggcaatagcgagtgttctcattgcattcgtgaccccattgatcttgcaacagccccatgcatcagttattgccattataccattttaccgataaggaaactgtggcagggaggggtcaagcaccttgggtatttgacagcaaaaccaaggcttggtggtatcataaaacttccaagtagtaattcacaaaggtgactgggaaatggaagtgaccagaaatctttgcactatgaggacaagttcatgaccctgatacattcttgtccaggtagtatagctccagaccaaatgtctgcggccacccacccaaaaacttgttggataaaaatgactacacctatagtcaaatgatttttgacaaaggtgccaaacagttagataggaaaaagaaagttattttcaataaatgttgctggagcaaccagatatccatatggaaaaaaaatcttgaccacctacctcacaccaaacactaatattaacttgagatggatcataaacctaagtctgaaaactaatagtaaagttcttgagaagagaacatgggagaatgtcttcatgatgttcaggtaggcaaagatattttaagacacaaaaaagcaataagcataaaatttgtaaagaggtgactggggctttatcaaaattaaaatttatgtgtattaaaagacatcatgaataaagggaaaagggcagccacagactgggagaaactctttactatacatatacctaactgagg

SEQ ID NO: 1778 - DNA, 11167 bp, Homo sapiens; identical to SEQ ID NO: 1777

SEQ ID NO: 1779 - DNA, 3095 bp, Homo sapiens
ctcctaaataaagcatttcccctgtgtgggcgacccctgggtcccatgtggggtcagtgtttgggtctctctgagaggatcaggaaggctgctcttccaggaagggctgcagggaccctgggaaccggaccagtccagctcacaagtatgaagagaatgtcgggagaggaagtggtggctatgagtcagcatgagtcatctcgttccaatgagaatgaaggctgaggtgtgcgccttttttttttttccttcttagtcgtgtgtacatcattgggaatggagggaaataaatgactggatggtcgctgctttttaagtttcaaattgacattccagacaagcggtgcctgagcccgtgcctgtcttcagatcttcacagcacagttcctgggaaggtggagccaccagcctctccctgacaagcaaagtggatcagcaaaggctgcagtcaccagcatcttttccaaccttaatgaactgtatcctcaaaagaacactatcagactggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggcaggccagaaagcagacccagggaggatagcacatgtcttcggctacactggtgaaggcatcgtgcctgctccacagcacatttttattcaagtcttggacgagcctgaggatgtctacaagtggaagaaaagaagccactggagcagaaggtggggaggataaaatttggagcaagattctcaaggaagcaacaagatcctaaggaaaggagaaagagactacctactgcatttctgtcactcgctgaaaaggacactctgtcagaaaatcttctagcaaacttcaaagggcaaaatcaccccttgttactgataaagcccagagagcttcagcagctaacattccctggacagggcacagcaaggatttgaacctaggtcagtctggccagaacacccacaagctttccttaactcagtgtgctatctccccacgactaggtcactactgctttataatcacctttgtagccaccagtggattttgctcatcagtatttttcaggcaattgatactttagatattcagctgcaagacgtatgcagttttcattgacatcttttggagaaactgacaaacctggacttgacttaatgcctttggaaccttccaagatgttatataactctagatagaaggctgggcctccatgatgtcaggaatgttgcattcttatttccccatagataaacccatttgtccacaaagtcaaggagtcaggcagaggcccttgccatggggctttttaggataaagcaacaagcctggactttgctctacaacagggttttgcatagggagtggtatgaccagatccctcaagaaagaaagcttagagaccaggccagagtccactgcagtagcccagtcaagagaggatggtgacttggacttgtagtagagccagttagaatgaaagaaattgacacattcagaaatggttttagagatagagtcaaactggacctgataaagaactagagaagcggagtgaggataaagagaagagccatgactgactcggaagattttgtcttgaaaaacttgagaactcaagacagagtgaaataaaatcacatgtgggaaaaatctcctgctttgttttggactactttgaagtgaaatgcctgttaagcctaagtggggtaggtcatggcgtacatgactgtgggctcaggatggatacaggcattcaggagttgtgagcaaatagaacttaaagccatgagagaagaagggatcaccaagagagacagtgtggcatagagaagaaaaggggtggaagacgatccctgggcagaaaagtccttagagcagaggcaacaggcatgaccaagaagactaagaaagaacattcagtacagcaggaggagagcaaaaaatgtgtggtattctagaagcaaagagaataaagggcttcaggaaggagcagtcaagtgtgtcaaataagataaagacagacaagtcccctggattgggtaggaataaaataacaacagactgccatacaaatggttctatctacaccatctaaaagaatatagtttattctccatacatttaagaaacacctgccatatgccaggtatcctttcaagcactgaaatgcagattcataaaacatggtctctgctctcaaggagctcacagtggtaaggaggaaacaggcaatagcgagtgttctcattgcattcgtgaccccattgatcttgcaacagccccatgcatcagttattgccattataccattttaccgataaggaaactgtggcagggaggggtcaagcaccttgggtatttgacagcaaaaccaaggcttggtggtatcataaaacttccaagtagtaattcacaaaggtgactgggaaatggaagtgaccagaaatctttgcactatgaggacaagttcatgaccctgatacattcttgtccaggtagtatagctccagaccaaatgtctgcggccacccacccaaaaacttgttggataaaaatgactacacctatagtcaaatgatttttgacaaaggtgccaaacagttagataggaaaaagaaagttattttcaataaatgttgctggagcaaccagatatccatatggaaaaaaaatcttgaccacctacctcacaccaaacactaatattaacttgagatggatcataaacctaagtctgaaaactaatagtaaagttcttgagaagagaacatgggagaatgtcttcatgatgttcaggtaggcaaagatattttaagacacaaaaaagcaataagcataaaatttgtaaagaggtgactggggctttatcaaaattaaaatttatgtgtattaaaagacatcatgaataaagggaaaagggcagccacagactgggagaaactctttactatacatatacctaactgagg

SEQ ID NO: 1780 - DNA, 3095 bp, Homo sapiens; identical to SEQ ID NO: 1779

SEQ ID NO: 1781 - DNA, 3095 bp, Homo sapiens; identical to SEQ ID NO: 1779

SEQ ID NO: 1782 - DNA, 4054 bp, Homo sapiens
cggctctgcagaagcacgctgggcccaggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctcccgcgcccgagaagcccagcctcgccggcggccaagttcaccgcgaggccccgcgctgcctgcgctgcgctcccggacccgcaccgaccgcagcgcgcgccgccggtgcttctcccaccccagcctggaagctgcctccctccgcctatgcctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtgtctctccctcctaagccccggaggggagaacttccaaagacagaaaaccacaggcttcctggcacagagctttccctttatcagctaaagcagaatcttttctggccttaacctggccccttcctctaactgcaggcagagaggcagacagaaaagcacttgctgaaacacaaagttttgttctgtcctcaacgaactgtctagagctgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgtcatttctaaaacccattatcactgtatgagagattcctttgcgctgcatcctcgacagtgcttcctaaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggcaggccagaaagcagacccagggaggatagcacatgtcttcggctacactggtgaaggcatcgtgcctgctccacagcacatttttattcaagtcttggacgagcctgaggatgtctacaagtggaagaaaagaagccactggagcagaaggtggggaggataaaatttggagcaagattctcaaggaagcaacaagatcctaagatcttgttctcactagagaataatttctacattatgcccaggttcttctgagctatgaaggggcccagatttaagggctatttttgacaccctaaatgtgctgagacaagtcattaaggtggtcctgccaggacacagccatctaaagcagcaatctgcttcttgccagaaaatctcgtgcctctgcagagccttttccagaatgaaccacaccatgctgaggaaaggagaaagagactacctactgcatttctgtcactcgctgaaaaggacactctgtcagaaaatcttctagcaaacttcaaagggcaaaatcaccccttgttactgataaagcccagagagcttcagcagctaacattccctggacagggcacagcaaggatttgaacctaggtcagtctggccagaacacccacaagctttccttaactcagtgtgctatctccccacgactaggtcactactgctttataatcacctttgtagccaccagtggattttgctcatcagtatttttcaggcaattgatactttagatattcagctgcaagacgtatgcagttttcattgacatcttttggagaaactgacaaacctggacttgacttaatgcctttggaaccttccaagatgttatataactctagatagaaggctgggcctccatgatgtcaggaatgttgcattcttatttccccatagataaacccatttgtccacaaagtcaaggagtcaggcagaggcccttgccatggggctttttaggataaagcaacaagcctggactttgctctacaacagggttttgcatagggagtggtatgaccagatccctcaagaaagaaagcttagagaccaggccagagtccactgcagtagcccagtcaagagaggatggtgacttggacttgtagtagagccagttagaatgaaagaaattgacacattcagaaatggttttagagatagagtcaaactggacctgataaagaactagagaagcggagtgaggataaagagaagagccatgactgactcggaagattttgtcttgaaaaacttgagaactcaagacagagtgaaataaaatcacatgtgggaaaaatctcctgctttgttttggactactttgaagtgaaatgcctgttaagcctaagtggggtaggtcatggcgtacatgactgtgggctcaggatggatacaggcattcaggagttgtgagcaaatagaacttaaagccatgagagaagaagggatcaccaagagagacagtgtggcatagagaagaaaaggggtggaagacgatccctgggcagaaaagtccttagagcagaggcaacaggcatgaccaagaagactaagaaagaacattcagtacagcaggaggagagcaaaaaatgtgtggtattctagaagcaaagagaataaagggcttcaggaaggagcagtcaagtgtgtcaaataagataaagacagacaagtcccctggattgggtaggaataaaataacaacagactgccatacaaatggttctatctacaccatctaaaagaatatagtttattctccatacatttaagaaacacctgccatatgccaggtatcctttcaagcactgaaatgcagattcataaaacatggtctctgctctcaaggagctcacagtggtaaggaggaaacaggcaatagcgagtgttctcattgcattcgtgaccccattgatcttgcaacagccccatgcatcagttattgccattataccattttaccgataaggaaactgtggcagggaggggtcaagcaccttgggtatttgacagcaaaaccaaggcttggtggtatcataaaacttccaagtagtaattcacaaaggtgactgggaaatggaagtgaccagaaatctttgcactatgaggacaagttcatgaccctgatacattcttgtccaggtagtatagctccagaccaaatgtctgcggccacccacccaaaaacttgttggataaaaatgactacacctatagtcaaatgatttttgacaaaggtgccaaacagttagataggaaaaagaaagttattttcaataaatgttgctggagcaaccagatatccatatggaaaaaaaatcttgaccacctacctcacaccaaacactaatattaacttgagatggatcataaacctaagtctgaaaactaatagtaaagttcttgagaagagaacatgggagaatgtcttcatgatgttcaggtaggcaaagatattttaagacacaaaaaagcaataagcataaaatttgtaaagaggtgactggggctttatcaaaattaaaatttatgtgtattaaaagacatcatgaataaagggaaaagggcagccacagactgggagaaactctttactatacatatacctaactgagg

SEQ ID NO: 1783 - DNA, 4054 bp, Homo sapiens; identical to SEQ ID NO: 1782

SEQ ID NO: 1784 - DNA, 4054 bp, Homo sapiens; identical to SEQ ID NO: 1782

SEQ ID NO: 1785 - DNA, 3676 bp, Homo sapiens
acaagcaaagtggatcagcaaaggctgcagtcaccagcatcttttccaaccttaatgaactgtatcctcaaaagaacactatcagactggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggtttctatttttccaccctgtagatcttgttctcactagagaataatttctacattatgcccaggttcttctgagctatgaaggggcccagatttaagggctatttttgacaccctaaatgtgctgagacaagtcattaaggtggtcctgccaggacacagccatctaaagcagcaatctgcttcttgccagaaaatctcgtgcctctgcagagccttttccagaatgaaccacaccatgctgaggaaaggagaaagagactacctactgcatttctgtcactcgctgaaaaggacactctgtcagaaaatcttctagcaaacttcaaagggcaaaatcaccccttgttactgataaagcccagagagcttcagcagctaacattccctggacagggcacagcaaggatttgaacctaggtcagtctggccagaacacccacaagctttccttaactcagtgtgctatctccccacgactaggtcactactgctttataatcacctttgtagccaccagtggattttgctcatcagtatttttcaggcaattgatactttagatattcagctgcaagacgtatgcagttttcattgacatcttttggagaaactgacaaacctggacttgacttaatgcctttggaaccttccaagatgttatataactctagatagaaggctgggcctccatgatgtcaggaatgttgcattcttatttccccatagataaacccatttgtccacaaagtcaaggagtcaggcagaggcccttgccatggggctttttaggataaagcaacaagcctggactttgctctacaacagggttttgcatagggagtggtatgaccagatccctcaagaaagaaagcttagagaccaggccagagtccactgcagtagcccagtcaagagaggatggtgacttggacttgtagtagagccagttagaatgaaagaaattgacacattcagaaatggttttagagatagagtcaaactggacctgataaagaactagagaagcggagtgaggataaagagaagagccatgactgactcggaagattttgtcttgaaaaacttgagaactcaagacagagtgaaataaaatcacatgtgggaaaaatctcctgctttgttttggactactttgaagtgaaatgcctgttaagcctaagtggggtaggtcatggcgtacatgactgtgggctcaggatggatacaggcattcaggagttgtgagcaaatagaacttaaagccatgagagaagaagggatcaccaagagagacagtgtggcatagagaagaaaaggggtggaagacgatccctgggcagaaaagtccttagagcagaggcaacaggcatgaccaagaagactaagaaagaacattcagtacagcaggaggagagcaaaaaatgtgtggtattctagaagcaaagagaataaagggcttcaggaaggagcagtcaagtgtgtcaaataagataaagacagacaagtcccctggattgggtaggaataaaataacaacagactgccatacaaatggttctatctacaccatctaaaagaatatagtttattctccatacatttaagaaacacctgccatatgccaggtatcctttcaagcactgaaatgcagattcataaaacatggtctctgctctcaaggagctcacagtggtaaggaggaaacaggcaatagcgagtgttctcattgcattcgtgaccccattgatcttgcaacagccccatgcatcagttattgccattataccattttaccgataaggaaactgtggcagggaggggtcaagcaccttgggtatttgacagcaaaaccaaggcttggtggtatcataaaacttccaagtagtaattcacaaaggtgactgggaaatggaagtgaccagaaatctttgcactatgaggacaagttcatgaccctgatacattcttgtccaggtagtatagctccagaccaaatgtctgcggccacccacccaaaaacttgttggataaaaatgactacacctatagtcaaatgatttttgacaaaggtgccaaacagttagataggaaaaagaaagttattttcaataaatgttgctggagcaaccagatatccatatggaaaaaaaatcttgaccacctacctcacaccaaacactaatattaacttgagatggatcataaacctaagtctgaaaactaatagtaaagttcttgagaagagaacatgggagaatgtcttcatgatgttcagctcaccaagctcctgtatctactggaaaatggaagtccagccttaccaacttgtgaaccttgtctgaagggagccagggcctgccaatggaaccacctccaggagctgcaactgctgttgtcattaataccattgtgtctattttttgagagagataaacttttcatggtgttacattttggaaaaaaaaaaaaaagactaggtgaacagtcaggtaggaaagcagcataacagtcccttaaattctgatcatgtaggacattcttctttgccctgggcctgggaaaatgcagcatgttccagagcaaaagtcctaatgaggggaactaaaccagtgggacccaaaccaatgtcctggctcactgaggacccgttagaaccaaatctctgggtgtggacaggctcccatacttttcaaaaattcccctgatgactaatgaacaaccagaggtaagaaccagtggcccagaggaataaccagcccagctgttgtacgagctcgctaagctggctcaggtcaatgttgaattctctgctaggcagctcctcataagaactggcagagatggttcttacacaacaacaggtgacaactccagactctgccggaagttccaggatctgggttcccggacaatgcatgacactcagtccagcattgcaggtggaagagcgacggtgaaaagaccaaagtcaattaaaatgtgttaaccaaaacaggaaacatgagtgaggtgattgagagtgtgtttaacttagatgtgtgattttatcaatactttcattgttcaaaaactcttattttttaaagatattttcaaaacaaatccaaactttacttttcattccaaattcgtgttccgtctatacttgcatttggggaaagattgaaacaaaacacaaatactttgtagcaatgttggagtgtcatgttctttgcagagggacaggaaaaaaaaaggatttttttttcttatcaagagatactgtttcctcaaggagaaagggcatcagtccaaggcactggtttgctcaaaaagattagtaaagaacaagcatattttgtctgtggtgacaacatgatctccccccccccactagtaaactcacagcatcagtacgcaggcagtgtg

SEQ ID NO: 1786 - DNA, 4586 bp, Homo sapiens
cggctctgcagaagcacgctgggcccaggggcttctagactgacagctccatttatcaactacctattggttttaaaaattggagtgtcttttccgcgttgactgattttggctctaagagatgtcgctggtcatttcagagtgactgaacctcccctctaacagatcccgggaattgttttcaggaaaggtaaaaggcagccttttctgtcacaacacaacgctgagccggcagcctggctctgtcaggatctggggctcccgcgcccgagaagcccagcctcgccggcggccaagttcaccgcgaggccccgcgctgcctgcgctgcgctcccggacccgcaccgaccgcagcgcgcgccgccggtgcttctcccaccccagcctggaagctgcctccctccgcctatgcctgcaggataagaagcccgaggaggcggagcatggaactcgacagttaaaacatttaagagagaaaacctagtgtcttgctggcctgaaatcgagtacgcagcccggggtgatcagggtctcccggcccggatgtgtgagacttgcttcccctgggcaataggcgatacgatgctttaggaggaaggtgtctctccctcctaagccccggaggggagaacttccaaagacagaaaaccacaggcttcctggcacagagctttccctttatcagctaaagcagaatcttttctggccttaacctggccccttcctctaactgcaggcagagaggcagacagaaaagcacttgctgaaacacaaagttttgttctgtcctcaacgaactgtctagagctgattgctgatagtcgtggtgcattatgccttcctggttttcatttaattgggcaccacgctgcctttcaagacgccttaaaggaaccaacaaccaaatccaagagagctggacagaccattgaacacacagtaggctgtgtctcgtggctttcgttgtctggtgcctcaaagaaaacaccagaaagattgtttctaagctagagccaccccagattgcttaaagtgcaaagctcactgctgttgggggtacccttgtgagacactggaaagctggttttaccgtggccctatgaagaggaagactgaaatttagacagtaatacctttactaggattggaaaagatttggttaatgacagccctgtcatttctaaaacccattatcactgtatgagagattcctttgcgctgcatcctcgacagtgcttcctaaggctctgccgacttccagttctggaacaagatggttaaactcatttttccctgctctgctcctctaaatacaactaagtaccttggaaactattcagcagacaatgataaagggctctgaaagctagaagaaaaggtgtacttgcaagaaacctcaggacttgagtaacagcaacatggaaaggagaaagagactacctactgcatttctgtcactcgctgaaaaggacactctgtcagaaaatcttctagcaaacttcaaagggcaaaatcaccccttgttactgataaagcccagagagcttcagcagctaacattccctggacagggcacagcaaggatttgaacctaggtcagtctggccagaacacccacaagctttccttaactcagtgtgctatctccccacgactaggtcactactgctttataatcacctttgtagccaccagtggattttgctcatcagtatttttcaggcaattgatactttagatattcagctgcaagacgtatgcagttttcattgacatcttttggagaaactgacaaacctggacttgacttaatgcctttggaaccttccaagatgttatataactctagatagaaggctgggcctccatgatgtcaggaatgttgcattcttatttccccatagataaacccatttgtccacaaagtcaaggagtcaggcagaggcccttgccatggggctttttaggataaagcaacaagcctggactttgctctacaacagggttttgcatagggagtggtatgaccagatccctcaagaaagaaagcttagagaccaggccagagtccactgcagtagcccagtcaagagaggatggtgacttggacttgtagtagagccagttagaatgaaagaaattgacacattcagaaatggttttagagatagagtcaaactggacctgataaagaactagagaagcggagtgaggataaagagaagagccatgactgactcggaagattttgtcttgaaaaacttgagaactcaagacagagtgaaataaaatcacatgtgggaaaaatctcctgctttgttttggactactttgaagtgaaatgcctgttaagcctaagtggggtaggtcatggcgtacatgactgtgggctcaggatggatacaggcattcaggagttgtgagcaaatagaacttaaagccatgagagaagaagggatcaccaagagagacagtgtggcatagagaagaaaaggggtggaagacgatccctgggcagaaaagtccttagagcagaggcaacaggcatgaccaagaagactaagaaagaacattcagtacagcaggaggagagcaaaaaatgtgtggtattctagaagcaaagagaataaagggcttcaggaaggagcagtcaagtgtgtcaaataagataaagacagacaagtcccctggattgggtaggaataaaataacaacagactgccatacaaatggttctatctacaccatctaaaagaatatagtttattctccatacatttaagaaacacctgccatatgccaggtatcctttcaagcactgaaatgcagattcataaaacatggtctctgctctcaaggagctcacagtggtaaggaggaaacaggcaatagcgagtgttctcattgcattcgtgaccccattgatcttgcaacagccccatgcatcagttattgccattataccattttaccgataaggaaactgtggcagggaggggtcaagcaccttgggtatttgacagcaaaaccaaggcttggtggtatcataaaacttccaagtagtaattcacaaaggtgactgggaaatggaagtgaccagaaatctttgcactatgaggacaagttcatgaccctgatacattcttgtccaggtagtatagctccagaccaaatgtctgcggccacccacccaaaaacttgttggataaaaatgactacacctatagtcaaatgatttttgacaaaggtgccaaacagttagataggaaaaagaaagttattttcaataaatgttgctggagcaaccagatatccatatggaaaaaaaatcttgaccacctacctcacaccaaacactaatattaacttgagatggatcataaacctaagtctgaaaactaatagtaaagttcttgagaagagaacatgggagaatgtcttcatgatgttcagctcaccaagctcctgtatctactggaaaatggaagtccagccttaccaacttgtgaaccttgtctgaagggagccagggcctgccaatggaaccacctccaggagctgcaactgctgttgtcattaataccattgtgtctattttttgagagagataaacttttcatggtgttacattttggaaaaaaaaaaaaaagactaggtgaacagtcaggtaggaaagcagcataacagtcccttaaattctgatcatgtaggacattcttctttgccctgggcctgggaaaatgcagcatgttccagagcaaaagtcctaatgaggggaactaaaccagtgggacccaaaccaatgtcctggctcactgaggacccgttagaaccaaatctctgggtgtggacaggctcccatacttttcaaaaattcccctgatgactaatgaacaaccagaggtaagaaccagtggcccagaggaataaccagcccagctgttgtacgagctcgctaagctggctcaggtcaatgttgaattctctgctaggcagctcctcataagaactggcagagatggttcttacacaacaacaggtgacaactccagactctgccggaagttccaggatctgggttcccggacaatgcatgacactcagtccagcattgcaggtggaagagcgacggtgaaaagaccaaagtcaattaaaatgtgttaaccaaaacaggaaacatgagtgaggtgattgagagtgtgtttaacttagatgtgtgattttatcaatactttcattgttcaaaaactcttattttttaaagatattttcaaaacaaatccaaactttacttttcattccaaattcgtgttccgtctatacttgcatttggggaaagattgaaacaaaacacaaatactttgtagcaatgttggagtgtcatgttctttgcagagggacaggaaaaaaaaaggatttttttttcttatcaagagatactgtttcctcaaggagaaagggcatcagtccaaggcactggtttgctcaaaaagattagtaaagaacaagcatattttgtctgtggtgacaacatgatctccccccccccactagtaaactcacagcatcagtacgcaggcagtgtg

SEQ ID NO: 1787 - DNA, 1423 bp, Homo sapiens
gagagggagtctcctttccttggaggagtcagggaaaactctgctccagcagcttctggtgggaggctggatattatccaggcctgcgcgcagtcatccggaggcctaaacccctccctgtggtgctgtgcttcaatggtcactctccttgtccactttcatgttcctcccatactcctggttcctctttgaagttcgtagtagatagcggtagcagaaatggtgacagtcttaaagtctttgatctttcttataagtgcatagaagaaaacactgacctatgctgccttctctctgtgtgctttggctacctaagaaggaagggccacctgtcctgtgatcatgtgacttgcttcaccttgtcaatcacttagaagattcaccctccttaccctgcccccttgtcttatatgcaataaatatcagtgtgtccagccgttcagggccactaccagtctatgcgtcttaatggtagtggtccccgggtccagctcttttctcttaatcgttttgtcttgtgtctttatttattacaatctctcatctctgcacaccaggagaacacccgccaagctccgtagggctggaccctatatttctgtaatatggaaatattaatagtggcaagcccacatagctgccacgaggacttcatacaataatgaaggtatgcgtttttggacatccttttattggagagctgaaagagaaggctaccatctttggacgcccttttactggagagctgaaagagaaggctactgagaagatatttttaaagttctcaccaggatccaatggccctaaggagacaagtacatttgcttggaaaactggtcacctaattcccaaaaggacagagctaacattatatgtctcagcatccagtccatcctagatggatttcgattctatctagggaatctcatcaaacaaccagggaggatcaaccaccagagaaaagaagagactgggagtcatcaccatgtccccaacagaattttcatctatccttctgaggacagctccaagtgattacctagaggactttgcttcataataagtcaaccttcattcctgtgcagccccacctctcaccttcccaaaatgtctgcctcccatcttctgggtccattcattctctcaaatgatttgctgcccctcaaaagaattttccacgttcctcatctctcccctcccctgggaaaaagcatatataagcttctataccaccctgggttattgggtaatcattctccagcaattctcccatcctgtgcacatcaaataaattctgtatgcgttttcttttattaatgtgctttttgtctgttgattttcagtgagtctttagagggcaaaggggaaattttctccctgcaagagtcttattatccgagtgtctctgcaagcagcacgtggg

SEQ ID NO: 1788 - DNA, 984 bp, Homo sapiens
aaaaatcggaattggcagatactctctcggttactccctggttgcagttaatgagcagcctgttcgcctgcagcctttagacagggaacaaggggcacagcttttcccactttattggttactgactgggaaagaaggattccactagcactgcttggctatcaaagctgggcaatgtgatcctctaagccacatgtttaggaattgacaaacaattgtggaggttggcaattccaaaatctgaggagtaggtaaactggaagactagagaccctgggaagagttgatgttacagcttgaatctgaaggcagtctgctggaagaatcccctctttcttgtagaagccccttgactgggcaaacttcaaacaagtgactgagctcccttagctgccactgattggaccaggatggacaacaaatgtaggaggagttcatctggatctagcctgagccagtcagatatcccctttgaatccatgcctatagaaatacaaaaaaatggaagccagaggatgatggatccttgaagtaataagtcaggtagatcttgaaaatttttgactcaatccatattgatgaacacaagaataattctggtctacaaagagaggcaagagaaagacttggggtgtattaagaaaaacagctctgtggaagtttgagtgactcattgcagagaggaattgatgaagtcaacagctgctggaaaaacttctttttccttaatagctgtatcaacatgtggttgctattattcaagtaagaaaaatatgtatatcaaacatccatggtagtccttgctaaaattttcattagagagactcatgttttgacattaaaaaaagttcaaatgggtaccttagaggatgttttgttggagaacaaaatcatggagaaataaagtctaaaaagaaaaataaatggcaagcatgttgttaataatgctgtaatttatttcagagtgggttgggtgattttctt

SEQ ID NO: 1789 - DNA, 2299 bp, Homo sapiens
cccgcccaccagcccgggtccacccgcgaggcgcggggcacaggcttggcagatgcacacgaggaagaggaagggatcctcgcaagctttgaaaggcgccgtcaagtcaaataaataaatgccctacaacaccaacccaggactgagatctgcatgctggaatgacggtggtggtggtggctttcagtattccccaggttttgtccggagcaccggcacgccctctcttgaagtccgctctccgcacagcctctttttaacttgattagtggttagacgggaagatccggagctgtccagtgtcttgggtaatgcacggcatcgcctgatgtctgacgctagaacaccacgtaaagtcaagcagagggaagtgaatgcgccctaggcccctgcaggccaccaagaagagctagagggagttggtgcaatcctagagatgccggcaggtgcaccaatctgtggcacacgtacgctctccaatggaagacaactcaagaccacaccaagtttgtattaaaaaagtactgttgtgttactttttaccaacctccaatcattatacaaaatgttaaaaaatacacaaacacacacacacactcacagccatagaggttatcgcaaaagatcaacccagaatctttcagaatatgacagatgcactgagaaggcagataaattgattcaatatacaaaaggcctctttcctatggaatttcattagattaaataaggtgttccctcctcacagcctcatccttatgagcaatcatataaataatctatttaaagtccttgaactataacttgtataatttttagttttccccctttgaaggggcctaagagaaaggtttgagaaaccagctcttgaggggggcaggggtgaggggtaagaggtcctgtgcctttcattcatcctgggagcttctcaggattgcagcatttccacctgagtgttcattcttgtacattttctcatctttctcctgggttcctaggatcttggagattacctagtccaatccttttacttcagaaacaaaaaacctgaggctcagaaaggctaagtcaaatgcctagggtcacacagggaaactgtgggagttggatccctgagtcccagtccttaaactggttgctacatgacattctagaacctctccccaccaactccctttttaaagacagggtctggttctgtcacccaggctgaagtgcagtgacatgatcttggctcactgcaacctccgcttcctgggctcaagccattctcccacctcagcctcccaagtagctgggacaacaggcacatgccactacgcccagttaatttttctaattttgttttgtagagacagatttgccatgttgcccaggctggtctcgaattactggcctcaagcgatacgcctgtttaggcatcccaaagtgctggggttaccggcaggagcaattgctccgggccagacttcccttcccccgcccacacccccccaacccggcctagatccacaggcactgtaatcacagctgacacactcgactcggaatcagcatagagagcactctgaaaattgtcaaatagggtccctgaaacttgtataccatacttctcctgaagatcttgaagcatctttgtgtttgctttttttttttttaacttaaaatatggcattcaggttttatccctctccccgacgccatgtttcctttctgtattagtcacacacgtgatcctaaagtctgtcttccccactttaactggggagggctggacaaggtggaattccaattgcaggagacaggatgtgacatgggtgaggtgcccaaggctcaccgactgaaacttcgatggctcttccctgtttccttgtgcagggccccccttctctccactgctcacctggctctcctcctcccttcctgcctgctttgcagctcttgctactattttccttttctttccctgctcccaccctggcccaatttatttcacagaaatatcacagggccagccaggcacagcggctcacccctgtaatcccagcactttacgaggctgaggagggcagatcacttgaggtcaggagtttgagaccagcctggccaacatggtaaaatcctgtctctactaaaaatacaaaaatttgctaggcatggtggcaggcgcctgtaatcccagctacttgcgagggaggctgaggcaggagaatcacttgaacctgggaggcggatgttgcagtgagccaagatcacaccattgcgctccagcttgggcgacagaacgagactctgtctc

SEQ ID NO: 1790 - DNA, 10026 bp, Homo sapiens
tgggctcataaaaatcccagaaattttatctatggcaattgattttttttatcctaattcaaagagcaatttatgaagaagatggtccctgcttatctggaatgttccctgaaacttccaaaccttttaccaaagtcgccaaaccaatagcacatgtgttacaattatttgggggcattttcttttcctgacgtttctttcagctttgacaaggtagggcctcccacaacgtcagagtgaggttcaggtgcgagtgtgttttgctcagccttaccgcagctctgtcggcctggatgggcgtggggtcccaaataacaccctctaggccatggcttcctttctttcctggccccttccctcaggttgtgagtctttagcccacctagcagactcagggtgtgccaccagttccctggaggagcagatcattgaaaatacagcaaagttaaaattaaacgcaacaaggccaggtgcattgccttctgttccatggggactatttgtcctaagactttgactgagcaccatggaccctcctgctctgtcaaatgcctcttcctgctggctccaggtttacactactgatatggctctgtgtccccacccaaatctcatcttgtagctcccacagttcccacatgttgtgggagggatccaatgggagataattgaatcatgggggcgggtctttcctgtgctgttcttgtgatagtggataagtctcacgagatctgatgggttttttttttggtttgtttttttttttttttttttgagacggagtcttgctgttgcccaggctggaatgcagtggcgcgatctaggctcactgcaggctccgccccccggggttcacgcgatatctgatgcttttaaaaataagagtttgcctgcacaagctctctctttgcctgctgccatccacgtgactttctcctccgtgccttctgtcatgattgtgaggtctccccagccacatggaactggtaatactgcaccttcaattgacttatgaagaaactagctcagattggaacaacagccaggacagtcaccaccaaggggacttgccccactggagaagagaccggagtgggagagaaactgttacagccaatcacttccttccaggaaaaaaaaagacgcaaataacaacacaaaaaaacgtgatctaatagacaatccagatataaagaacacaaacccttttccctacaatttaaccaaatgctaaaatgcaccaggaaacacaggatactacagagataaagatttggccagcagattatcaaccccaggaaaagaaatccatttctgtagcatgctatgctgttggaggcacacgtcacacttcttaattcaaggacagaaaagcacaaactaaaatgcacactggagtatgactcccccttctctatctgctaaagcgcttcgcatgtgactttcaatctctaagctgggaatcaatcaggcagcccagcctcctatattttctagttgtattgctttgagcatcaaatttaacctctgtgcacctcaatttcttcagctggagacaaagaaagtggctgcactgtggcagagtgtttgcaaatgttaatcatggttatggtagcattctaccttgtcttacagatggttgcctaaaaaggtaggaaactgttcacgaaaaagtctcaaccggtcctagagtgatcagaatgacagcgctgaaataaggagggcagtacctcttattccagagaagtggggagcagagaggaagatggagtggaaaggggcgaggcaaggccctcctgaaatacctcaacccaaatcttcaagaaatccccaagtcctcacagtgctttttgtggatttttgtggaaaccggtaaaaggggctgatttgctgaccccagtgggtagaaaacagagactgtcaagagaacagaagagaaggcagaaaggggatggggaagtggggttcgccatgttcacgagctcctggagccacagggccccccaggaacaacagagctgagactgggtggccttgtttctggcccaattccctgggaccaccaccctggaaggacacttgagccctactcaaggacccaccacaacatctcagcattgtcggtccttaaatgccaaggtttgtgctcaccatttccatccttaagattctcacagggaagaacccacacaacagctttgtccctgcgactctgggtgagtttctgacactggcctgggctcccgttttgcccgtcaccaacttctcacagtataactatccaagagaagtagcatttgatgtcagggaatcaaaagggctaaggctcgggaggccaaggcaggtgaatcacttgtaatcaggagttcgagaccaccctgaccaacatagtgaaaccccatctctactaacaatacaaaaaattaaccaggtgtggtggcaggtgcctgtaatcccagctactcaggaggctgaggtaggaggatcacttgaacccaggaggcagaggttgtggtacgccaagatcatgacactgcactccagcctgggtgacagagtgagactccatctcaaaaaaaaaaaaaaaaaaggcctaaggcttactcagggtcatctatggtttgccaagcagagttcaatccaatcaacaaaaccctcactgcccacttttccaaaacctgatatagtcagtcactagtagctgccatttgctgttttgccttctattaaaaaaaaaaaaaaaaaaaaaaccatccaattcccagaagtcaaaggcaattccttcccttttctgtgtctgtgagacggctctctgtgggattccttcctgctgcacctcatccttcctggaagggactctcagaaaatgtgcctcctccttacaggaaaggaattcctcccgaggaactgtggacatgaggcagctttgtggaatttcccttccacagacttcagcctattttctgggcaaacttagcagaaatgaccaaaatccactcgagagagacagcaacaaggagaggggaagagatcctattttggcttcttcaaatggaccaattttctctttaaaatatttattttaaggaaaaacaaggactacattatattttaaagggggagaaggaagaggattttgagttgctaagagaacagagccatctcttttcttttaatactggatgctaagaacttgcacagggttttcccaaaagccagatagttcaggtaatttgcatgtggctgtaaaagagaaagttcaggccaggcactgtggcaacatggtgaaaccccatctctactaaaaatacaaaaattagctgggtgtggtggtgcaagcctgtaatcccagctacttgggaggctgaggcaggggaatcacttgaatctgggaggtggacgttgcagtgagccaagatcacaccactgcactcctgggcgacagagactctctcaaaaaaaaaaaaaaaaaaaaaaaaagagagagagaaagttgagagcataagtctgagtgattctgcctgaaagaacagaacagcttacactggacaggcttttgcccaagacacacctcatctggcattgagaaacgaacaccaacaataatgagtgacagaatgttaagaacaataattatacagacttggacctcccagactgcttgtctgtagtaattcagaaggaagcaaagtattctgaagtgtttatgaagattggttccacatctgaagaattttagtaatcttacccaaactcaacccaagaaatatgaggaaaagagggagtagttctataataagcaggtggaatagagggtcaaactccttggcgagttcagtctaacagaggacacattactgccctacaaagcagctctggaaaatgacaaccagtggcactaactccaggcaatatctttgtgaggcttgtgggctgtaatatagtctgctcaggctgccataaaaaaaaaatcacaatcaggccaggcactatggctcacacctgtaatcccagcactttgggaggccaaggagggcagatcacctgaggttaggagttcgagaccaggctggccaacatggcaaaaccccgtctctactaaaaatacaaaaattacccggatgtggtagcacgcaccggtagtcccagctactcgtcaggctgaggcaggagaattgcttgaacctgggaggggtggaggttgcagtgggctgagatcacaccactgtactccagcctggacaacagagccactgcactccagcctgggcaacagagagagactccatcttaaaaaaaaaaaaaaaaaatccccgtcttcaaatacaatcacattctgaagtactagagatcaggactccaacatgcgaactttggggggacataattcagcccgtaatatgggtgataaaggagcaggtccagacttagagaaacaaggactccctgggtcaagctctggaagtgaaaggcttcttcaaagacaggaaagtcccactgaaggtggctttggaagtgcacccttgcagcacagcaaccttcttgatttgctcaagagcaggggttctgacaggtctcaaagcactttgtttaatgaaacagaatcgaaaataccagtgtgtcacatgtttcctaagacaggacactgtttcttgaaacttttactaaagtatgtttttcttttatttttttattttttattttttttgagaaggagtcttgctctgtcgcccaggctggagtgcagtggcacaatctcgactcactgcaacctctgcctcccgggttcaaacaattctcctgcctcagcctcctgagtagctgggattacaggtgcacgccatcatgcctggctaatttttgtatttttagtagagacagggtttcaccatgttgaccagtctgctctcaaactcctgaccttgtgatctgcccaccttggcctcccaaagtgctgggattacaggtgtgagccaccgtgtccagcctaaagtatgttaaatatgttatgtgtgagagagagaaagagaatatatctcttggtcattacatatgtaaaacttgtagaacgtgatcaaaatgtttaaaaactggccaggcacagtggctcaagcctgtatcccagcactttgggatcccaaggcaggtggatcacaaggtcaggaatcaagaccatcctggtcaacacagtgaaaccccatctctactaaaaatacaaaaaattagcctggcgcggtggcacgcacctgtagtcccagctacttgggaggctggggcaggagaatcgcttgaacctgggaggcggaggctgcagtgagctgagatagcgccactgcactcctgcctgggcaacagagcaagactccaactcaaaaaaaaaaaaaaaagtttaaaaactggtcctgtggcagtgggtctcaaacatcagcatgcatcagaatcacttggaggactgattaaaacacaggctgctgctgatgctgctaatcctagagccaccttgaagtttttctgtggttttttttttttttttttttttttttttgagacagggtcttgctgtctcccaggctggagtgcagtggtgcaatgatacctcactgcagccttgaactcctgggctcaagcaatgcccccatctcagcctcccaagcaactaggactgtagctagctcctaactcattccctccattcctgccctcccctaactttatattgcagccagaaggatattttttctgaagagcatctcatgctgagtggcagcagaatgcagagattaagagagggggccaggcacagtggctcacacctctaatcccagcactttgggaggccgaggtgggtggatcacccgaggtcaggagttcaagaccagcctagccaacatggagaaaccccgtctctatgggcgtggtggtgcatacctgtaatcccagctactagggaggctgaggcaggagaatcacttgaacccaggaggcagaggttgccgtgagccgagatctcgtcattgcactccagcctgggcaacaagagcgaaactccgtctcaaaaaaaaaaaaagagtggcgccaggtgcagtggctcacgcctgtaatcccagcactttgggaggccgaggcaggcaaatcatctgaggtcgggagttcgagaccagcctgaccaacatagagaaaccccgtctctactaaaaatacaaaaaaattagccgagcgtggtggcatgtgtcgtatgcctgtaatcccagctactggggaggctgaggcaggagaattacttgaacctgggaggcaggttttttgttttttgttttggttttgtttgagattttggttgttgttttttggggtttttttgagacagggtctcactgtgttgtccaggctggagtgcaggggtgcgatcatgtgtcactgcagccacaacctcctgggctcaggtgatcctcccacctcagccttcctgagtaactgttactacaggtgtgcaccaccatgactggctaatttttgtattttttgtagagacaagagtttcaccatgttgcacaggctgttcacaaactcctaggctcaagctatccacctgcctcagcctcccaaagtgctgggattataggcatgagccaccttgcccagccaactgagccactttgtgccaggactaggtcaggtacttgggacatatacaggcaaggacactgcccacagggaactgacagtgtctagcagctacacagatgacacggccttttcggcagacacccctgtcccctgtgcttggcaaacagcagagactcaaaaatgtatatggtttgactcccactggaacataagccccttagggcagggaccagggtcactgtattcccagcacctataatcaagaggtacatgacgctgcagctgagagcagggactctgtgctaagttacctacctggtttgaacctaggctctgccactcaaaggctgtgtgaccgtgggaaataatagtacccaccccaaaggtttgttattagtatttaataatatttattggtaaggtacttagaatagcccccctgcctacaggaagcagtacataattataatgtctaaatatacagtagttccaggccaggcatggtggctcatgtctgtattcctagcagaatgagaggccgaggaaggagaatcatttgagtccaggagtttgagaccagcctggataacatagtgagatctcgtctctacaaaaaataaacaaaagtaagccagacatggtggcacatgcctgcaatcccagctactcaaaaggctgtgattagagaatcacttgagcccaggaggtagaggctgcaatgagctgagatcacaccactgtactccagcctgggcaacagagtgagactccgtctcttaaataaataaataaataggggccaggcgtggtagcttacacctgtaatcccagcacattgggaggctgaggcgggaggatcacttgaggacaggagttcaagaccaacctgaccaacatggtgaaaccccatctctactaaaacacaacaatcagctgggcatggtggcgggtgcctgtaatcccagctattttgggggctgaggcaggagaatcacttgaacccaggaggcagaggttgcagtgagccaagatcacactactacactccagcctgggcaacagagcgggactccatctcaaataaataaataaatagcagttccatatcctctgaataatggactagaagttggttaatggatgggttttcagggagaattttagcagccgagctgagaggtaggtactctagccagggtatataacatgagctaagggaacaggacagcaaatataaggtgtgatcaggggaaaggcatcatatattgactgtccaggaacaatggatatctgagaatgtaggaaagctaagttaggaccaggaaaaggagagtattaaatgccaaagaagatgccaccaaaggttctggaacagaaagcagcagagctatgccttgtaaagataaagcctgcagtgtattgactgggttggaatctggaatcattgcgtgcctccagtcaagacgtggcaactgaccaactaccttttatcactgaccagactcttccctacgtgcagataactgaggacgcaagccttagttactgggtgtggtggtgctattaacggaaaaagggaagtcagccagcaaaggctgactggggcaatttcagccttgttgctctgctgtgaaactgctttccagaaaaacttttttttttttttgagacggagtctcactctgtcacccaggctggagtgcagtggcacaatttcggctcactgcaacctccgcctcccaggttcaagcgattctcctgtctcagcctccccagaagctgggattacaggcgcccaccaccacactcagctaatttttgtatttttagtaaagtcagggttccactatgttggccaggctgatctccaactcctgacctcaggtgatccgcctgcctcggcctcccaaagtgctgagattacaggcatgagccacagtgcccagcccaggaaaacttcttaaagatgtaataataacgcaccttattattttccaagtacttccatagatagtggcccacttctgagtatgaattaaatttccctttgtggcctttgtttttttaatagatcttcatttctggggggacttacaaacaggtgacttctccattcaccagagatgggacattatacactgacctacttccatattcactttccctgcttgattggaggtgagggagaaaaattagtgtataaggccgggcgcggaggctcacgcctgtaatcccaggactttagaaggctgaggcaggtggatcacctgaggtcaggagttcgagaccagcctggccaacatggtgaaaccccttgtctactaaaaatacaaaaattagccaggtgtggtggcacacgcctgtaatcccagttactcaggaggctgaggcaggagaattgcttgaaccccgaggcagaggttgcagtgagctgagtccatgccattgcactctagcctgggcaacaagagtgaaactctgtctcaaaaaaaaaaaaaaaagaaaagaaaagaaaaataagtgtatagaactttattgtttcattgaccgggcacgatggctcacgcctgtaactctagcactttgggaggccaaggtgggcagattggctgagctcagcagtttgaaaccagcctgggcaacatggtgaaacctatctctaataaaatacaaaaaattagcccggtatggtagcacatgcctatagtttcagctacctgggaggctgaggcatgagaatcacttgaacccagaaggttgcagtgagccaagattgtgccactgcactccagcctgggcaacagagcaaaactctgtctccaaaaaaagagaactggccagggatggtggctcacgcctctaatcccagcactttgggaggctaaggtgggcagatcacgaggtcaggagttcaagaccagcctggccaacatggtgaaaccccgtctctactaaaaatacaaaaattagctgggcatggtggcaggcacctgtaatcccagctactcaggaggctgagacagcagaatcgtttgaatctgggaggtagaagttgcagtgagccaagatcacgccattgcactccagcctgggtggaagggcatgacttcgtctcaaaaaaaaaaaaactttttccttaaaatacacctcttggagccagtcccagatacttgggaggatcaggaaggaggacctcttgaggccataaatttgaggatgtagtgtgcctgtgaatagccactacactctagcctgggcaacacagaaagacctcataaataaataaataggccagatgaggtggctcacacctgtaatctcagcactttgggaggccaaggctggcagatcacgaagttaggagatcaagaccatcctggctaacacagtgaaaccccg

SEQ ID NO: 1791 - DNA, 10026 bp, Homo sapiens; identical to SEQ ID NO: 1790

SEQ ID NO: 1792 - DNA, 1161 bp, Homo sapiens
cacgaaggtttgatgtaaagactatttcatcccctagacggttccccagggcatgttcactgacatcaaggtgcagaacttactttaagtagcactacgtatgagggctgtacatctcacaaacaaaacagaaagacaataactttagtaaaaagatggataccattcaagcccaaggaaaaccaatgcttcttttcatctatggactcaagtctcagaaagcagagaagtgagtgtaccaagtgcaacaaacgtttgagcattgttctgctgccaatattgaagacagccactgctttgaagtgtggggaggagggaattcttggtatgataggacatgaaagctgagagaaaacccttctacctaggaactccggagtttcaactaccagagactgaaggcaggagagaaaaactaagacaaatgacttcaaagcctttctgaaatgccacagagggtcaggattacaatctgcctattctgattcttctactatgggaaaaaatctttttcagaattgatgtaaagcctctgttaatacttttcctgttaacaacctaactattcaactgctgaataaaaaccattaggacaactaaagaaactgagagattttggcaagaaatagtcattccaatatcaatgactacggaggaaatgcaattacttttctttgcttaagttttccagggcctttctctgttgcccaggctggagtgcagtgaggcaatcttggctcaccacaatctctccctcctggattcaagcaattctcctgcctcagcctcccgagtagctgggattacaggcatgcaccactacacccggataatttttgtatttttagtagagatggggttttaccatgttggccaggctggtcttgaactcctgacctcgtgatcagcctgcctcggcctcctaaagtgctgggattacatgcatgagccactgtgccctgccaacttgttaaatttttaatcattctgctcaccttttgcaaccttactgacttttgtgtctaccttatctagcagtggctgaaatttccttctatgattatagatttgtctgttatttcttatagatttctcaatattgcttgtattattattttaagttaataccattaggcataaaaattcaaaattgttatcgct

SEQ ID NO: 1793 - DNA, 1161 bp, Homo sapiens; identical to SEQ ID NO: 1792

SEQ ID NO: 1794 - DNA, 1161 bp, Homo sapiens; identical to SEQ ID NO: 1792

SEQ ID NO: 1795 - DNA, 1161 bp, Homo sapiens; identical to SEQ ID NO: 1792

SEQ ID NO: 1796 - DNA, 1282 bp, Homo sapiens
gaccccagttattccagctgttaaatggagtggatcaaaaggctgattaaatgtaacggattccaaagaatggctggcacatagatggataccattcaagcccaaggaaaaccaatgcttcttttcatctatggactcaagtctcagaaagcagagaagtgagtgtaccaagtgcaacaaacgtttgagcattgttctgctgccaatattgaagacagccactgctttgaagtgtggggaggagagctagagcatatttgcctgccacagttagttttgtgtttccatggaatttgagcaaaactgatgcacttgtctcccaggattaatccatacaagtcacctctaaaattatcttttcccattcgttgactgagcaaaatggacttcaaggacctaaaggaggttaaataccacaagatggaggagcttgagtctctgaatcattgtgtgtgaagtcatctgccaattacataaattgaattcttggaactccggagtttcaactaccagagactgaaggcaggagagaaaaactaagacaaatgacttcaaagcctttctgaaatgccacagagggtcaggattacaatctgcctattctgattcttctactatgggaaaaaatctttttcagaattgatgtaaagcctctgttaatacttttcctgttaacaacctaactattcaactgctgaataaaaaccattaggacaactaaagaaactgagagattttggcaagaaatagtcattccaatatcaatgactacggaggaaatgcaattacttttctttgcttaagttttccagggcctttctctgttgcccaggctggagtgcagtgaggcaatcttggctcaccacaatctctccctcctggattcaagcaattctcctgcctcagcctcccgagtagctgggattacaggcatgcaccactacacccggataatttttgtatttttagtagagatggggttttaccatgttggccaggctggtcttgaactcctgacctcgtgatcagcctgcctcggcctcctaaagtgctgggattacatgcatgagccactgtgccctgccaacttgttaaatttttaatcattctgctcaccttttgcaaccttactgacttttgtgtctaccttatctagcagtggctgaaatttccttctatgattatagatttgtctgttatttcttatagatttctcaatattgcttgtattattattttaagttaataccattaggcataaaaattcaaaattgttatcgct

SEQ ID NO: 1797 - DNA, 2993 bp, Homo sapiens
gaggacaacgtgatcactgtattcagctccatcaagaatggtccaggttcttctagatgatctgcacaaatggttcctctcctccttcctggtgtctgccattagcattggaataaagttcctgctgaaaatccacatctcccctgggtccggtgttctggaagggagagagacaatgtcacacttcaaggaggcagctctctagacaggaaggttattcacatcccatgtcaagtctagagttcagagcaattgagaaatgcaattttatctgctgcctttcattctataccctgcttctgaaccatcgtgttcaactgtgaaactcacactttggtgaccatgactccaaaactcacttaatacacccaaggtcagccccagtgatctgcttcatagcaaggactttgggtgggtctgcccagggagtagggcaccctcagagaatgtggctttggacttcatcacagctgaggccttttgtgtcacttaagatctaaacttgtaaccatgctagatgtgtttctaatgtgacaacatcacgaaccacaagtccagaagcctaatccttaatcctacctcctcatgatgaagtctcatgctctgtgctcaacgtggttagctgcacaagatgtaaaccaaagcttcactgaaccctcgacccaaatcggtaactcaagtgcgtcaatcataatgaacctccccaaactcagtatttatgattatttttgaggcagggtctcactctgtcgcccagactggagtgcagtggcaggatcagggctccgtgcagccccgaccttccaggctccagcaatcctcccgcctcggcctcctgagtagttgggagtagagatgcgtcccacattgcctggctaatttttgtatttttgtggagaggggatctcgccacgttgcccaggcttgaagccggatcaagcaattgggttcttcggatttccgaaatagaccccaatattctgcctttaccccggaggatgcagatgtaccttctctcaggccgatgacctcaggcctccacggtccctggagctctaggaaaggcgagcgcgatctcgcgcccacacccagtgctctgggtcataagcctggatctggaaaaacaaacgccctttgagaagacggggactcgccaggatacccctctctcccctcatccagcctccagcccacccaattcctccccacctcctccacctccccaggccccactcacctcctccaactcctctggggaaacccaagccctgcagctcatggaacagaagaagtggaaccgacgtttctggaacaggactatctgagagcggttcttcctggccctcgggttcatgcaacggcgtaactggaaccgacgcttacggaccaagggaagtggaagatgttttgtttggagtcctcgtcgtcctcctccatgtcattggccaggtagctgaggacaggaatcaggttgctgctcaggggcaccaccaggagagacctccggctgaggtcagcttcccagagaggaagagtaaagaggacaaataggtgaaagaataaatgaaaggctggaatcccacttcccccgctgtcccagggcattggatattgacggataggaggcagcaaaccactcacagagccaggaagaaatgaaggcgttggtattgccaggaggggaagccggctcggctgaaatacgctatgaccatagcaaggagatactgatggagagaaaggaacacagagagggagaggtcacatcttggaagaggaagattgtggagagggggaatgagggtctggggaggggctgcccatcagagaagggacctcagtgttggggtgactgtactcatttggaaattgcgggatggaggggtattcgaaggtcggatgcaaatccgagaagccagaggaagggttttgggtgatgctcccaggatggtgggctccgatgggatctttggagggggtgtgtctaggttggctggtgtcaggagggtcttttgtgtgccaggcagagaactgtcccgaagagctgagagtagaggggccaggagcttcagggctgcggccagactgtggcccagagctcagatcccaaaggacccataggagaggcaggggccactcattcactctgcaagagaccagcagaatcctgagggagatgctgacaaatcataaaaagaccaagaatagccgggagtggcggctcaagcctgtgatcccagtactttttgagaggtggagacaggaggatcatgtgagcccaacagttcgagaacaacctgggcaacatagtgagaccctgtttccacaaacatttcaaaaattagttgagcatggtggcatgtgcctagtcccagctcctcaggaggctgaggaaagaagattgcttgagcccaggaattagaggctgcaatgagctatgatcatgccactgcactccatcctggggagcagagctagattctgtctcacaaaaaaaaaatttgtgggtgccaagactcaagaccatgggagctggtcgggcacagtggctgacgtctataatctcagcactttgggaggccaaggtgggtggattgcctgaggtcaggtgttcaggaccaacctggccaacatggcaaaaccccgtttctactaaaaacacaaaaattagccaggcgtggtggttcatgtctgtaatcccagctgcttggaggctgaggcaggagaatcgcttgaacccaggaggcatcggctgcagtgagtgaagatcgagacactgccctccagcctgggcaacagagcaagactctgtctcacacacacaaaaaaaaaaaaaaaaaaaagactgtaggagcatctggtgggaggtggtggagggagaactgtgggtttggaagctgcgccctccccccagccatgcgttggaacaggaacagttacatggagaacaaccttaccttgtccgacaccctcagatctttgtcccaggccag

SEQ ID NO: 1798 - DNA, 975 bp, Homo sapiens
ccgcccgccgccagcggctggggcccggccgcagggagctgctcatggcgcgcagcttcccggatccgattctggcgcggcctgagctccacggcaggtggcccggccctgcagggaccccagcacctccgggggcctcgcgggaattgaggacgagcctctggcgttgggtgaacctgggcgtttggtcggcaacggcgcctgcctgtgggaggggcacccgagcagggaccgcctcgagtgcactggggcccagctagggcactctcgcgggacaatgggtgtcacggcagccagcgaccgtttgtcattcacagctgcctgaaaggaggaccgcagtattcccacgcaggaagcttggaccaaaagcaggaatgcttaagggcgcatatgacttgccatggtaaaaaacaggatgccaacccaggcctgatgacatccacctcactaaaagctaaggactaggactttctgctttaaacaaggacccacatgtgggtgttttctgtgggagagggagagaggacattcgaagggcagaagtctgacctttgcaagcacacgtgaaccacaccaatgagaaatgaatggacgagccagatgccaatttataaatttcctactgcacaccttgaatgtgaaaggtactcccagagtaatttctctcgtgttctggttaccttttattgtcagggcgcctggggacggccttaggtgtcttaggacatttgacgagttccactttgatgggagatgtttaatctgggcctccacatggagatttctctccaccttgttagtgtctagaagacttccacctccaatagcaggattatgatcttttgaaaagcctgtgtaaatttgagtcttttcttttataactccttatcagtcaccgacagcttttcccataattgctattataattggatcacacatttgttatgtttttggatgaaatacactatacccctg

SEQ ID NO: 1799 - DNA, 12107 bp, Homo sapiens
cgcgagcgagataccccggtccccgcctccgcctccgccctagagccacggaggggaggcggccggcggcccgggcctctgagctccgaatcctgcgccttcccgccgccaacgggctgggggccacgaggggcgcggggagggaacgggagtttgcaaggacgcctggagatccactgcttcctcctctcggcttcagtctgcaggcagctcttccccaccagagcgcgtggctcccccggccgggctcgcctctcccggcgcccgcctcatttgaaaacacggcctttcccacgcccttaccgccggttctgcccgcactgcgctccgctcctcgctcctctgctcgcccttcgctttcggcgtcccacaccatctccttccctcgtcggcggcttcctcttctgctcccaccctggtctcccgcctgccttccagcaccatctctttcggatgtcattcctcgcagtgaagttctttattgaaactgccccttgctgtcagcaccccaaatctactgagggtccatcagcagtacagactggccggctttatgtgctaggtcggctcttaagaaatatactttaagcctaacggcctcaaaaaaaaaattgtattatcaaacatagagtgtgaaaataacactgaaataattttaaactaaaaggctaggccgggtgcggtgtttcacgcatgtaattccagaactttggaagaccgaggcaggtggatcacttgaggtcaggaattcgagattagcctggccaatatggtgaaaccccttctctactaaaaatacaaaaattagttgagcgtggtcccagctactcaggaggttgaggcaggagaatcgtttgaacccgggaggtggaggatgcagtgagccgggattgcgccactgcactccagcctgggagactgtctcaaaaaaaaaaaaaaaaaaaagaaagaaagaaagaaagaaaagaaaaacaaacagaaaaaaaaggctcagcgactgttagaaatcgttatttattcatttttttcaaaaatacatggcctctcatgtcagatttagcagatgtaggacgtttgcccatcttatttggcaaaaatgcttcttaaggatttgatagcggcccaaattcatcagtgtttaagtttttctaaaactaatttgaaaacttaaaaaaaaagaagaaacattatatgaataactaggaagctgtttcgacagtcactgttaaagagcttttaaaatgggctccacatgttaatgtatgaaaagcgtcaggcctctgagcccaagtcaagccatcgcatcccctgtgacttgcacgtatacacccagatggcctgaagtaactgaagaatcacaaaagaagtgaatatgccctgccccaccttaactgatgacattccaccacaaaagatgtgtaaatggccggtccttgccttaagtgatgacattaccttgtgaaagtccttttcctggctcatcctggctcaaaaagcaccccccactgagcaccttgggacccccactcctgcccgccagagaacaaaccccctttgactgtaattttcctttacctacccaaatcctataaaacagccccacccttatctccctttgctgactctcttttcggactcagcccacctgcacccaggtgaaataaacagccatgttgctcacacaaagcctgtttggtggtctcttcacacagaagcgcatgaaatttggtgccatgactcggatcgggggacctcccttaggagatcaatcccctgtcctcctgttctttgctccgtgagaaagatccacctactacctcaggtcctcagaccgaccagcccaagaaacatctcaccaatttcaaatccggtaagcggcctctttttactctcttctccaacctccctcactatccctcaacctctttctcctttcaatcttggcaccacacttcaatctctcccttctcttaatttcaattcctttcattttctggtagagacaaaggagacaagttttatccgtggacccaaaactccagcgccggtcacggactgggaaggcagccttcccttagtgtttaatcattgcagggacacctctctgattatacactaacgtttcaagggtgtcagaccacgtagggacgcctaccttggtccttcacccttagcggcaagtcccgcttttctgggagaggggcaagtacccctccaccccttctccttcactcttagcggcaagtcccacttttctagaggaggggcaagtaccccaacctcgtatctctgcgccccaatcccttatttccacgtcccgacctcttatctctgcgccccaatcccttatttctgtaccccgaccccttatttccatgccccgaccccttatttctgcaccccatcccttatttccgtgccccgacctcttatctctgcgccccaaccccttttcccacttttctggaaggtaagaacccccgaaccccttccctccgtttctctactctctcttttctctaggcttggttccttcactatgggcaaccttccaccctccattcgtccttctactcccttggcctgtgttctcaaaaacttaaaacctcttaaactcacacctgacctaaaacctaaatgccttattttcttctgcaatgccgcttgaccccaatacaaactcgacaatagttccaaatagccagaaaatggcactttgaatttttccatcctgcaagatctaaataattcttgtcgtaaaataggcaaacggtctgaggtgcctgacgtccaggcattcttttacacgtcagtcccttcctagtctctgtgcccagtgcaactcgtcccaaatcttccttctttccctcccgcctgtcccctcagtaccaatcccaagcatcgctgagtctttctaatcttccttttctacagacccatctgacctctcccttcctccccaggctgctcctcgccaggccaagctaggtcccaattcttcctcagcctccgctcctccaccctataatctttttatcacctcccctcctcacacctggtcccgcttacggtttcgttccgtgactagccctccccctcctgcccagcaatttactcttaaaaaggtggctggagctaaaagcgtagtcaaggttaatgctcctttttctttatcccaaatcggatagcgtttaggctctttttcatcaaatataaaaatccagcccagttcaggactcgtttggcagcaaccctgagacactttacagccctagaccctaaaaagtcaaaaggccatcttattctcaatatacattttattacccaatctgctcccgacattaaataaaactccaaaaattaaattccggccctcaaaccccacaacaggatttaattaacctcgccttcaaggtgtacaataatagaaaaaagtggcacttccttgcctccactgtgagacaaaccccagccacatctccagcacacaagaacttccaaacgcctgaaccgcagcagccaggcgttcctccagaacctcctcccccaggagcttgctacacgtgccggaaatctggccactgggccaaggaatgcccgcagcctgggattcctcctaagccacgtcccatctgtgtgggaccccactgaaaatcggactattcaactcacctggcagccactcccagagctcctggaactctggcccgaggctctctgactgactccttcccagatcttctcggcttagcggctgaagactgacactgcccgatcgccttggaagccccctagaccatcatggatgccgagctgccagtaactctcacagtggaaggattgtgaagagcagtcttcagtctgagacccatccctaggtaagtgttgtgtattaccagtgcacagaggagactggttttcacatcagcattgtatataaccacagtgcattcttattctcagttcagtctctatattgtcacaagtgtttattgagtacctaatatgtgcaggcacatatcactgggaatacagtggtgaacaagacaaagttcctgctcccatggagttgacattctagatggagacatagtctgtatagacagaaaccactcactgtgtcctcatcgggtggccctatgactgcatatggtttcttcccaccaaagttcatgctgcaatttgacccccaacatgatgatgtgcggaggtgggagctagtgggaggtgttttggtcatgggaatggatcctccatgatgtcttggtactgtactcctggcaatgagttcttgctctggagagactggattagttctcacgagtctgtatttcttcccataagagtgagttgtcgtaatgacatgatgccccttgggttttgactctttgcacttatttgcttccactttgaccttccttgccatgttaggacaatacacaagagctctcaccagaagccagaactgtgcccttgaacttcccagtctgcagaattgtgagctaaataaacctgtcttccttatcaattacccagtctgaggtattgtcatagcaatacaaaatggacttggacagatggtgataaatactatgaagaaaaacaaaaataaagtagttgttgcaggctaaataatgacctcaccaaagaaattcacatcctaatccctgaaacccatgaataatatgtgataaaaaaaaaaatggggtagactttatgggattcagctaagattcttgagatggccagactctcctggatgatctgggtgggcccccaatgcaatcacttgtgtctcaggaaagggaggctgagagagacacagcacaggtagaggagagggccatgtgaagagggagcagaaagagatgtgaacattcttgtgttgaagactgcatgatgtggccacaagccaagaaatgccaggtgcttccaaaatctggagaaggcaaggagggtccacaagtctggagggagtgtggccctggagactccttgatttcagcccagtgcctttgatttcagacttcctacctcaagaactgaaagaaatttctgtttgtttaagtcatcaagtttgtggtgatttgctacaataggcccaggagactgataaggcaggcatgggattagcaagtagggtggggctgggtggctcttttagatgctgtggtcaaggaagtccttgctgctctaacctaaagtctgagagtgatgggagagttagcaacatccatctatctgtagcaagaacaagaaaagtaggaggggaaggccggataaggtctgcctctcactgctccatccaacgtatgggaaacttacaggttgttagagtagcatgggacaaggacctgggaatgggagcctgtgttctagcccaggctccatcacaaacagtcagttactccacttcgagcaccagcttctgcatctgtggaatgggtttgtcttccctgaccccattacttggcagagatcataggcaccaccgcaggcctgctgggagcatgcctgggatgtgccatgtgctggttgcttctggtctaggacctacacccacctccttgacatgctactgccatctgtgcctcacacggccctcacccatgtctgtcaacattccctaagcccactgtgctgcctgaacaggtaagacctctctgtggggaccggcgttgtccactgtggcttctgactctcaccaccctccatgcagccacaggcacccccaactccacctaagcttcccgaggggctgtgtcctcaccctggttcctcgcccttcccaggatccagctgctctcgagtcccctgcgcgcccctcctccatccacacaccctcttccctctccccagcctccactcactcactccacagaatcaggctgagcgcctccctcatagcaacaggaggaaataggaagtgaaacaaacaggacttctgtgcccaggtggccggcagccatggggaggctggagggggatggagggggacacacatgggatcccctgtggcctccgtggtgcatcgtcacactctgagaagtgagacaggaggtccacagggaaggccacgttcagaagggagcaccggggcatcaggcagacccggccttcagttggggaggctgcctggggaagtgaagctgcagcagggaccaggcgccgagtaggcatttgtgaggccctaggaggacggagccgggccccttggggctcaagggaccccgcctagtgatggggctcaaaatgaggggagcagagggcaggaaagacctggagggggcagagcccggtaagaaggctggaccggagcatccattgtttgactctgaagagataatgcaggctgcagtgaggacactggatggaagggggtttggggacatttcagctaaaacatctactcggctgttcgcagcccacatttgggaaatgagaggacaaggatgagtctgagtcctagactgagaatgaacagggtgactggtcatgccagccttggaaactgggacatctgggaagaccccatgaagcttgggagtgacatcgtcttacaacgtggagcatcttcaagatgactttgagggtctccatggagaggaggagaggcagttggatttatgggtctggcagctcacagaaccttgagctggtgatcaaatttggagggcttgggctcaaaaggatcaactgttaggaactgctattgctccaaagccctcctgccccagcccacacagcttcactgggaggcagaaccagctggcggcagctccgacccctgcagtccaggaccctggtctctgctgtccacctcagtgagaaatgaccaattctttacagagttgcatgggacaacattgcctccccatccagcctggcctcgggcagccttctaccccccttgtcctctcaaggtgagggactcttctccacacctctgcaggactgcatgagccaccaccagcacagtgatgcctgtggcatgcgggccttctgccccctctcaatggcaagtctaataaagccaagttcagggaccacaaccatgatgtgtacagagtggtcaccattgctgaactcccttaaccacctggaaggcaggcgtcccggcccaggcttaattgcattctctaatgaatgaagacaggattctgggttttgttgctgttgttgtttttgagacatagtcttgctctgttgcccaggctagagtgcagtggtgtgatctctgctcactgcaacatctgcctcctgggttcaaactattctcctgcctcagcctcccaagtagctgggattataggcgcccaccaccacacccggctaatttttggtatttttagtagagatggggtttcaccttgttggccaggctcgtctcgaactcctgacctcaggtgatccactcaccttggcctcccaaagtactgggattacaggcgtgagccaccctgcccagccatgttgtttttttagagacagcatctcactttgtcacctaggctggagtcccgtggtgcaatcatagcccagcacgataccttgctaatttttaaatattttgtagagacagggccctactatgttgcccagactggtcttgagtgcctggcctcaggcaatcctcccaccttggcctcccaagtgttggaattacaggtgtgagccaccacacccagcctatttacttatatgcatttaaaaacttacagcatggtttactgctcccattctcaccatgtgatgtgcctgcttcccctttgccttccttcatgattggaggctttctgaggcctcccaagaagcagacaccactatgcttcctatacagcctgcagaactgtgagtcaattaaatatcttttcttataaattacccagactcaagtatttcttcacagcaatgcaagaatggcctaatacagggctatttctctctgttttttttttttgagtcaagttagacttttagttcacttaacctagaacttttatgctaacgcagatgaagtaagaattctgtaggtttcttatctgtttcacttctaggaccaccatgatcaactaacaaatgccgtaggtttgtggaatcacagttttgactgctgctttgcctctgctgttccttatagtaactgtgcccgtcttgcctttggtggttgagtgcatccacttggcctctgtcaccctggaatccagtgactcctattgcacatagttttcccaattcagttaccacatctcttatgtaagttctggcctatatagaaaagctatcacagagctcttcaagaatgctggggatctctgcacatgttttttcttctttttttactttagagacagagtcttgctctgctgccccggctggagtgcagtggtgcaatcatagctcactgtaatttggaactcctgggctcaagccatcctcccacattagcctcccaagtagctgggactactggcacatgccatcacacccagctacttttttttagagatggggtctcactatgctgcccaggctggtctcaaagtcctgacctcaagcagtcctcccaccttggcctccaaaagcactgggattacaggcatgagcctccacacctggctaccaatttatttctcacagtcatgaaaggtgtgtcttttggactctttcagggtgggagagtaggtcttagttgacacatctattctaacattccagtctccgtaagcctttttatacttttttttaatttttaacttttgtgggtacatggtaggtgtatatgtttatggggtacatgagatattttgattcaggcatgcaatgtgtaatagtcacataagggtaaatgaggtatccacaacctcaagcatttattctttgtattacaaacactccagttatactcttttagttattttatcttattattttattagtattattattattattttgagacagagttttactcttgttcctcaggctgtagtacaatggcacgatctcggctcactgcaacctctgcctcctgggttcaagtgattctccggcctcagcctcctgagtagttgggattacaggtgcccaccatcatgcctggctaatttttttgtatttttagtagagatagggtttcaccatgttggccaggctggtcttgcactcctgacctcaggagatcaatctgtctcaccctctcaaagtgctgggattacaggtgtgagccaccgtgcctggcctcttttagttattttaaaatatacaagttatcattgattgtagtcaccctgttgtgctatcaaatactagatcttattcattctacctaactgtagttttgtacccagtaaccatccctacttccccttcccaacactaccctctcaacctctgtaatcatcattctactctctatcttcgtgaattcaattgttttaagttttagtgctcataagtaagtgagaacatgggaagtttgttttctgtgcctggtttatttcacttaacataatgaccccccagactccagccatgttgttgcaaatgacagaatctcatgtttttgtggctgaactgtactccattgtgtatatgtaccacattttctttatccattcatctgttgatggacacaggttacttccaaatcttgcctattgtgaacagtgctgcaataaacatggagtgcggatatctctttaatatactgacttccttcattttgggtatatctctagcagcaggactgctgaatcatatgatacctctattgttagttttttgaggaacctccaattgtattaatttacatgcccatcaacagcatacaaacattcccttttctccacatcatcaccagaatttgctgttgccttttggataagtcattttaacttgagtgagatgatatctcattgtggttttgatgtgcacttctctgatgatcagtgctggtgagtaccttttcctatacctgattgccattgatatgtcttgttttaagaaatgtctattcagatgtattgttcattttttattctgattattagattttttcccatagagttgcttgagctccttatctagtctggttattaactgcttatctgatcagtagtttgcaaatattttatcccattctgtgggttatctcttcactttgttgattgtttcctttgctgtgcagaagctttttagctagatgtgatcccatttttccatgtttgttttggtcgcctgtgcttgttggtacctaagcttttgaatcccttcctctacatttgatcaaggcagatctgtcatttctaacttgctcactgtgccccgtctttcagcccttgtcctgtgggtttcctgcttttgttcttttatcaacattttaggggtttggggaggaacagagatgaacatatatgctccatccaccatgtttaaaagagacatctgtctgtgccagttgtagtccccaaaggcaagatatgaagtcacttctgagaaggctgatctgcaggggtgcacagaccagacttgggggattcttctctttctctctctccttatctcacacccgtcattacaaatcctatcagttctgctttcagaacatgaccagactctgggcacttttcgtctccattgctcccaccctagcccaggccacctggattcgtctctcaccaggatttctgcagttgcctctgataccaccttcttgctttgccttcactgatctattctcagcacatcaaccagagagatttctcttaaaaatcagatcatgtgacggctcaactgaaaccctccaatggcttcaaatttcactcaaaaatgtatttcaggtccttaccatgagctatagggtcaacacaatccacacccactacttcccaacactggcttcctgcttttctcagcctcagccatcccagcctcctttgtgcttcttacatgcactaagcacatgccaaccccaggatctttgcacttgctactgtttccccagacgttcccatggccatttaatcacttgcttcagtgttcagctgaaatgtcatcttctcagagaggcctcccctgcttgtgtatccacttgtggccttagcacactcatcatggttcttgatttctaagcaccctcttttgacctcagccctactacaacaaacaattagttctgtttgttggttttctcacttctactttggacccaggaagacttccaggccagcacctctcaaactgaaatgtgtatataaaccagaaagacttagaacagcacttctcacagtataatgtgcaaattgcttggggctctcattagtttcagattctgattccacaggctggggacatggcctgcaattctacctctttgacatgtgcccaggaggtgcagatgctgctgaccccggctgttacaggctgatttgtgtcccccaacatttatatgttggagtccggccacccagtacctcaaaaggtggctgtatttggagatagggactttgaagaagaagtaattaagttaaaatgggatcattaggataggccccgatgcaatacaataggtgtccctatacgaacaggaaatttagacacagagtcacacatagggaagaccatgtgaagacacctcagaagaagccaaaccttccaacaccttagtctcagatttccagcctccaaaattgtgagaaaattaatttctgtcgtttcactcagactgcggtactttgttatgtcaaacctagcaaaccaatactaattttggtactgagaagtgtggtgctgctgtaacaaatacctgaaaatgtggaagtcacttttgaactgggcaatgggcagaggaaagaagagttttgaggcacctgatagaaaagactagattgtcttgataagattattggtagaaatatggacattaaggggcattctggtgagagatcataaagaaaaaaggagagttgggctgggcgcagtggctcacgcctataatcccagcactttgggaggctgaagtgggtggatcacaaggttaggagttcgagaccagcctgaacaacatggtgaaaccccgtctctactaaaaatttaaaaattagcca

SEQ ID NO: 1800 - DNA, 12103 bp, Homo sapiens
cgcgagcgagataccccggtccccgcctccgcctccgccctagagccacggaggggaggcggccggcggcccgggcctctgagctccgaatcctgcgccttcccgccgccaacgggctgggggccacgaggggcgcggggagggaacgggagtttgcaaggacgcctggagatccactgcttcctcctctcggcttcagtctgcaggcagctcttccccaccagagcgcgtggctcccccggccgggctcgcctctcccggcgcccgcctcatttgaaaacacggcctttcccacgcccttaccgccggttctgcccgcactgcgctccgctcctcgctcctctgctcgcccttcgctttcggcgtcccacaccatctccttccctcgtcggcggcttcctcttctgctcccaccctggtctcccgcctgccttccagcaccatctctttcggatgtcattcctcgcagtgaagttctttattgaaactgccccttgctgtcagcaccccaaatctactgagggtccatcagcagtacagactggccggctttatgtgctaggtcggctcttaagaaatatactttaagcctaacggcctcaaaaaaaaaattgtattatcaaacatagagtgtgaaaataacactgaaataattttaaactaaaaggctaggccgggtgcggtgtttcacgcatgtaattccagaactttggaagaccgaggcaggtggatcacttgaggtcaggaattcgagattagcctggccaatatggtgaaaccccttctctactaaaaatacaaaaattagttgagcgtggtcccagctactcaggaggttgaggcaggagaatcgtttgaacccgggaggtggaggatgcagtgagccgggattgcgccactgcactccagcctgggagactgtctcaaaaaaaaaaaaaaaaaaaagaaagaaagaaagaaagaaaagaaaaacaaacagaaaaaaaaggctcagcgactgttagaaatcgttatttattcatttttttcaaaaatacatggcctctcatgtcagatttagcagatgtaggacgtttgcccatcttatttggcaaaaatgcttcttaaggatttgatagcggcccaaattcatcagtgtttaagtttttctaaaactaatttgaaaacttaaaaaaaaagaagaaacattatatgaataactaggaagctgtttcgacagtcactgttaaagagcttttaaaatgggctccacatgttaatgtatgaaaagcgtcaggcctctgagcccaagtcaagccatcgcatcccctgtgacttgcacgtatacacccagatggcctgaagtaactgaagaatcacaaaagaagtgaatatgccctgccccaccttaactgatgacattccaccacaaaagatgtgtaaatggccggtccttgccttaagtgatgacattaccttgtgaaagtccttttcctggctcatcctggctcaaaaagcaccccccactgagcaccttgggacccccactcctgcccgccagagaacaaaccccctttgactgtaattttcctttacctacccaaatcctataaaacagccccacccttatctccctttgctgactctcttttcggactcagcccacctgcacccaggtgaaataaacagccatgttgctcacacaaagcctgtttggtggtctcttcacacagaagcgcatgaaatttggtgccatgactcggatcgggggacctcccttaggagatcaatcccctgtcctcctgttctttgctccgtgagaaagatccacctactacctcaggtcctcagaccgaccagcccaagaaacatctcaccaatttcaaatccggtaagcggcctctttttactctcttctccaacctccctcactatccctcaacctctttctcctttcaatcttggcaccacacttcaatctctcccttctcttaatttcaattcctttcattttctggtagagacaaaggagacaagttttatccgtggacccaaaactccagcgccggtcacggactgggaaggcagccttcccttagtgtttaatcattgcagggacacctctctgattatacactaacgtttcaagggtgtcagaccacgtagggacgcctaccttggtccttcacccttagcggcaagtcccgcttttctgggagaggggcaagtacccctccaccccttctccttcactcttagcggcaagtcccacttttctagaggaggggcaagtaccccaacctcgtatctctgcgccccaatcccttatttccacgtcccgacctcttatctctgcgccccaatcccttatttctgtaccccgaccccttatttccatgccccgaccccttatttctgcaccccatcccttatttccgtgccccgacctcttatctctgcgccccaaccccttttcccacttttctggaaggtaagaacccccgaaccccttccctccgtttctctactctctcttttctctaggcttggttccttcactatgggcaaccttccaccctccattcgtccttctactcccttggcctgtgttctcaaaaacttaaaacctcttaaactcacacctgacctaaaacctaaatgccttattttcttctgcaatgccgcttgaccccaatacaaactcgacaatagttccaaatagccagaaaatggcactttgaatttttccatcctgcaagatctaaataattcttgtcgtaaaataggcaaacggtctgaggtgcctgacgtccaggcattcttttacacgtcagtcccttcctagtctctgtgcccagtgcaactcgtcccaaatcttccttctttccctcccgcctgtcccctcagtaccaatcccaagcatcgctgagtctttctaatcttccttttctacagacccatctgacctctcccttcctccccaggctgctcctcgccaggccaagctaggtcccaattcttcctcagcctccgctcctccaccctataatctttttatcacctcccctcctcacacctggtcccgcttacggtttcgttccgtgactagccctccccctcctgcccagcaatttactcttaaaaaggtggctggagctaaaagcgtagtcaaggttaatgctcctttttctttatcccaaatcggatagcgtttaggctctttttcatcaaatataaaaatccagcccagttcaggactcgtttggcagcaaccctgagacactttacagccctagaccctaaaaagtcaaaaggccatcttattctcaatatacattttattacccaatctgctcccgacattaaataaaactccaaaaattaaattccggccctcaaaccccacaacaggatttaattaacctcgccttcaaggtgtacaataatagaaaaaagtggcacttccttgcctccactgtgagacaaaccccagccacatctccagcacacaagaacttccaaacgcctgaaccgcagcagccaggcgttcctccagaacctcctcccccaggagcttgctacacgtgccggaaatctggccactgggccaaggaatgcccgcagcctgggattcctcctaagccacgtcccatctgtgtgggaccccactgaaaatcggactattcaactcacctggcagccactcccagagctcctggaactctggcccgaggctctctgactgactccttcccagatcttctcggcttagcggctgaagactgacactgcccgatcgccttggaagccccctagaccatcatggatgccgagctgccagtaactctcacagtggaaggattgtgaagagcagtcttcagtctgagacccatccctaggtgttgtgtattaccagtgcacagaggagactggttttcacatcagcattgtatataaccacagtgcattcttattctcagttcagtctctatattgtcacaagtgtttattgagtacctaatatgtgcaggcacatatcactgggaatacagtggtgaacaagacaaagttcctgctcccatggagttgacattctagatggagacatagtctgtatagacagaaaccactcactgtgtcctcatcgggtggccctatgactgcatatggtttcttcccaccaaagttcatgctgcaatttgacccccaacatgatgatgtgcggaggtgggagctagtgggaggtgttttggtcatgggaatggatcctccatgatgtcttggtactgtactcctggcaatgagttcttgctctggagagactggattagttctcacgagtctgtatttcttcccataagagtgagttgtcgtaatgacatgatgccccttgggttttgactctttgcacttatttgcttccactttgaccttccttgccatgttaggacaatacacaagagctctcaccagaagccagaactgtgcccttgaacttcccagtctgcagaattgtgagctaaataaacctgtcttccttatcaattacccagtctgaggtattgtcatagcaatacaaaatggacttggacagatggtgataaatactatgaagaaaaacaaaaataaagtagttgttgcaggctaaataatgacctcaccaaagaaattcacatcctaatccctgaaacccatgaataatatgtgataaaaaaaaaaatggggtagactttatgggattcagctaagattcttgagatggccagactctcctggatgatctgggtgggcccccaatgcaatcacttgtgtctcaggaaagggaggctgagagagacacagcacaggtagaggagagggccatgtgaagagggagcagaaagagatgtgaacattcttgtgttgaagactgcatgatgtggccacaagccaagaaatgccaggtgcttccaaaatctggagaaggcaaggagggtccacaagtctggagggagtgtggccctggagactccttgatttcagcccagtgcctttgatttcagacttcctacctcaagaactgaaagaaatttctgtttgtttaagtcatcaagtttgtggtgatttgctacaataggcccaggagactgataaggcaggcatgggattagcaagtagggtggggctgggtggctcttttagatgctgtggtcaaggaagtccttgctgctctaacctaaagtctgagagtgatgggagagttagcaacatccatctatctgtagcaagaacaagaaaagtaggaggggaaggccggataaggtctgcctctcactgctccatccaacgtatgggaaacttacaggttgttagagtagcatgggacaaggacctgggaatgggagcctgtgttctagcccaggctccatcacaaacagtcagttactccacttcgagcaccagcttctgcatctgtggaatgggtttgtcttccctgaccccattacttggcagagatcataggcaccaccgcaggcctgctgggagcatgcctgggatgtgccatgtgctggttgcttctggtctaggacctacacccacctccttgacatgctactgccatctgtgcctcacacggccctcacccatgtctgtcaacattccctaagcccactgtgctgcctgaacaggtaagacctctctgtggggaccggcgttgtccactgtggcttctgactctcaccaccctccatgcagccacaggcacccccaactccacctaagcttcccgaggggctgtgtcctcaccctggttcctcgcccttcccaggatccagctgctctcgagtcccctgcgcgcccctcctccatccacacaccctcttccctctccccagcctccactcactcactccacagaatcaggctgagcgcctccctcatagcaacaggaggaaataggaagtgaaacaaacaggacttctgtgcccaggtggccggcagccatggggaggctggagggggatggagggggacacacatgggatcccctgtggcctccgtggtgcatcgtcacactctgagaagtgagacaggaggtccacagggaaggccacgttcagaagggagcaccggggcatcaggcagacccggccttcagttggggaggctgcctggggaagtgaagctgcagcagggaccaggcgccgagtaggcatttgtgaggccctaggaggacggagccgggccccttggggctcaagggaccccgcctagtgatggggctcaaaatgaggggagcagagggcaggaaagacctggagggggcagagcccggtaagaaggctggaccggagcatccattgtttgactctgaagagataatgcaggctgcagtgaggacactggatggaagggggtttggggacatttcagctaaaacatctactcggctgttcgcagcccacatttgggaaatgagaggacaaggatgagtctgagtcctagactgagaatgaacagggtgactggtcatgccagccttggaaactgggacatctgggaagaccccatgaagcttgggagtgacatcgtcttacaacgtggagcatcttcaagatgactttgagggtctccatggagaggaggagaggcagttggatttatgggtctggcagctcacagaaccttgagctggtgatcaaatttggagggcttgggctcaaaaggatcaactgttaggaactgctattgctccaaagccctcctgccccagcccacacagcttcactgggaggcagaaccagctggcggcagctccgacccctgcagtccaggaccctggtctctgctgtccacctcagtgagaaatgaccaattctttacagagttgcatgggacaacattgcctccccatccagcctggcctcgggcagccttctaccccccttgtcctctcaaggtgagggactcttctccacacctctgcaggactgcatgagccaccaccagcacagtgatgcctgtggcatgcgggccttctgccccctctcaatggcaagtctaataaagccaagttcagggaccacaaccatgatgtgtacagagtggtcaccattgctgaactcccttaaccacctggaaggcaggcgtcccggcccaggcttaattgcattctctaatgaatgaagacaggattctgggttttgttgctgttgttgtttttgagacatagtcttgctctgttgcccaggctagagtgcagtggtgtgatctctgctcactgcaacatctgcctcctgggttcaaactattctcctgcctcagcctcccaagtagctgggattataggcgcccaccaccacacccggctaatttttggtatttttagtagagatggggtttcaccttgttggccaggctcgtctcgaactcctgacctcaggtgatccactcaccttggcctcccaaagtactgggattacaggcgtgagccaccctgcccagccatgttgtttttttagagacagcatctcactttgtcacctaggctggagtcccgtggtgcaatcatagcccagcacgataccttgctaatttttaaatattttgtagagacagggccctactatgttgcccagactggtcttgagtgcctggcctcaggcaatcctcccaccttggcctcccaagtgttggaattacaggtgtgagccaccacacccagcctatttacttatatgcatttaaaaacttacagcatggtttactgctcccattctcaccatgtgatgtgcctgcttcccctttgccttccttcatgattggaggctttctgaggcctcccaagaagcagacaccactatgcttcctatacagcctgcagaactgtgagtcaattaaatatcttttcttataaattacccagactcaagtatttcttcacagcaatgcaagaatggcctaatacagggctatttctctctgttttttttttttgagtcaagttagacttttagttcacttaacctagaacttttatgctaacgcagatgaagtaagaattctgtaggtttcttatctgtttcacttctaggaccaccatgatcaactaacaaatgccgtaggtttgtggaatcacagttttgactgctgctttgcctctgctgttccttatagtaactgtgcccgtcttgcctttggtggttgagtgcatccacttggcctctgtcaccctggaatccagtgactcctattgcacatagttttcccaattcagttaccacatctcttatgtaagttctggcctatatagaaaagctatcacagagctcttcaagaatgctggggatctctgcacatgttttttcttctttttttactttagagacagagtcttgctctgctgccccggctggagtgcagtggtgcaatcatagctcactgtaatttggaactcctgggctcaagccatcctcccacattagcctcccaagtagctgggactactggcacatgccatcacacccagctacttttttttagagatggggtctcactatgctgcccaggctggtctcaaagtcctgacctcaagcagtcctcccaccttggcctccaaaagcactgggattacaggcatgagcctccacacctggctaccaatttatttctcacagtcatgaaaggtgtgtcttttggactctttcagggtgggagagtaggtcttagttgacacatctattctaacattccagtctccgtaagcctttttatacttttttttaatttttaacttttgtgggtacatggtaggtgtatatgtttatggggtacatgagatattttgattcaggcatgcaatgtgtaatagtcacataagggtaaatgaggtatccacaacctcaagcatttattctttgtattacaaacactccagttatactcttttagttattttatcttattattttattagtattattattattattttgagacagagttttactcttgttcctcaggctgtagtacaatggcacgatctcggctcactgcaacctctgcctcctgggttcaagtgattctccggcctcagcctcctgagtagttgggattacaggtgcccaccatcatgcctggctaatttttttgtatttttagtagagatagggtttcaccatgttggccaggctggtcttgcactcctgacctcaggagatcaatctgtctcaccctctcaaagtgctgggattacaggtgtgagccaccgtgcctggcctcttttagttattttaaaatatacaagttatcattgattgtagtcaccctgttgtgctatcaaatactagatcttattcattctacctaactgtagttttgtacccagtaaccatccctacttccccttcccaacactaccctctcaacctctgtaatcatcattctactctctatcttcgtgaattcaattgttttaagttttagtgctcataagtaagtgagaacatgggaagtttgttttctgtgcctggtttatttcacttaacataatgaccccccagactccagccatgttgttgcaaatgacagaatctcatgtttttgtggctgaactgtactccattgtgtatatgtaccacattttctttatccattcatctgttgatggacacaggttacttccaaatcttgcctattgtgaacagtgctgcaataaacatggagtgcggatatctctttaatatactgacttccttcattttgggtatatctctagcagcaggactgctgaatcatatgatacctctattgttagttttttgaggaacctccaattgtattaatttacatgcccatcaacagcatacaaacattcccttttctccacatcatcaccagaatttgctgttgccttttggataagtcattttaacttgagtgagatgatatctcattgtggttttgatgtgcacttctctgatgatcagtgctggtgagtaccttttcctatacctgattgccattgatatgtcttgttttaagaaatgtctattcagatgtattgttcattttttattctgattattagattttttcccatagagttgcttgagctccttatctagtctggttattaactgcttatctgatcagtagtttgcaaatattttatcccattctgtgggttatctcttcactttgttgattgtttcctttgctgtgcagaagctttttagctagatgtgatcccatttttccatgtttgttttggtcgcctgtgcttgttggtacctaagcttttgaatcccttcctctacatttgatcaaggcagatctgtcatttctaacttgctcactgtgccccgtctttcagcccttgtcctgtgggtttcctgcttttgttcttttatcaacattttaggggtttggggaggaacagagatgaacatatatgctccatccaccatgtttaaaagagacatctgtctgtgccagttgtagtccccaaaggcaagatatgaagtcacttctgagaaggctgatctgcaggggtgcacagaccagacttgggggattcttctctttctctctctccttatctcacacccgtcattacaaatcctatcagttctgctttcagaacatgaccagactctgggcacttttcgtctccattgctcccaccctagcccaggccacctggattcgtctctcaccaggatttctgcagttgcctctgataccaccttcttgctttgccttcactgatctattctcagcacatcaaccagagagatttctcttaaaaatcagatcatgtgacggctcaactgaaaccctccaatggcttcaaatttcactcaaaaatgtatttcaggtccttaccatgagctatagggtcaacacaatccacacccactacttcccaacactggcttcctgcttttctcagcctcagccatcccagcctcctttgtgcttcttacatgcactaagcacatgccaaccccaggatctttgcacttgctactgtttccccagacgttcccatggccatttaatcacttgcttcagtgttcagctgaaatgtcatcttctcagagaggcctcccctgcttgtgtatccacttgtggccttagcacactcatcatggttcttgatttctaagcaccctcttttgacctcagccctactacaacaaacaattagttctgtttgttggttttctcacttctactttggacccaggaagacttccaggccagcacctctcaaactgaaatgtgtatataaaccagaaagacttagaacagcacttctcacagtataatgtgcaaattgcttggggctctcattagtttcagattctgattccacaggctggggacatggcctgcaattctacctctttgacatgtgcccaggaggtgcagatgctgctgaccccggctgttacaggctgatttgtgtcccccaacatttatatgttggagtccggccacccagtacctcaaaaggtggctgtatttggagatagggactttgaagaagaagtaattaagttaaaatgggatcattaggataggccccgatgcaatacaataggtgtccctatacgaacaggaaatttagacacagagtcacacatagggaagaccatgtgaagacacctcagaagaagccaaaccttccaacaccttagtctcagatttccagcctccaaaattgtgagaaaattaatttctgtcgtttcactcagactgcggtactttgttatgtcaaacctagcaaaccaatactaattttggtactgagaagtgtggtgctgctgtaacaaatacctgaaaatgtggaagtcacttttgaactgggcaatgggcagaggaaagaagagttttgaggcacctgatagaaaagactagattgtcttgataagattattggtagaaatatggacattaaggggcattctggtgagagatcataaagaaaaaaggagagttgggctgggcgcagtggctcacgcctataatcccagcactttgggaggctgaagtgggtggatcacaaggttaggagttcgagaccagcctgaacaacatggtgaaaccccgtctctactaaaaatttaaaaattagcca

SEQ ID NO: 1801 - DNA, 649 bp, Homo sapiens
ctcacacactgtcactttctcacacacccacacaatgcaccagctcacactcacacacatgcttacaccacaccattcactcacacatatccactcacatatgatcgcacctacccacacctcacacacacttgcacgcacacacctgcttacacacatctcacgttactcagccccacacgcacacacctgctcacacacatctcacattactcagctacacacacacgcccctgctcacacacttgtgctcacacacctcacaccattcactcacgcacacacccactcacacatgctcacgtctgctcacacacatgctcacctatccatacacacacttcctcacacacctcacaccaagtctcacacacacttatgcttacaaactcatgctcacacacatgctaacacttcacacatgctaacacctcacacattcacacccactcacatgctcacacctcacacatgctcacacctcatacctcacacacatgctcacatctcacacccactcacacacacctgcccacacatatctgcacacacacatgctcacacatatgctcacacatcacacatacctgctcacatacatgctcacacctcacagctgctcacttatcactcacacgctcacaccagc

SEQ ID NO: 1802 - DNA, 649 bp, Homo sapiens; identical to SEQ ID NO: 1801

SEQ ID NO: 1803 - DNA, 11801 bp, Homo sapiens
tccctcgcttttggagctccgacctcagcttcgcctgcgagctgggttgtgtaaaggctggtcattttggggcgcttaggggtgggtgccggggggcgcgctttccctcgtgaaggtcgctccaggagtcatgcgtacattcgttcattttgctctggacgcactgatgttcccggctcgccgccgtgccgcagtcacgaggctctccgaacgcctttcactgtgtttctgtttacattcgcgtctgcaagacccggcggcgcgaccgaggcccgaacagatggggtcttgctgtgttgcccaggctgggcttgaactcctggactcagacgatcctcccgcctcggcctcccaaagtgctggaattacagatggagatgggctgccatgttgtgagctgccccatggggaagaggctcacatgtgaggaactgagggaggcctccagaaaacagccagtgaagaactgagaccctcagtccaatagcctatgaggaactgaatcctgctgacaaccatatgaatgagcttggaagcagatccttccccagtgaagccttcatgtgagactgcagcccacttgacactttgatttgtagcttgtgacagaccccaagccagaagagtcaggtaagcagtgcctgcactcctgacccatggcaactggcatgataaatgttttttcccatgaagctatgttttagagtaatttgttttgcagcaatagataactaattcactaggtaaaggttatatccattgtaatctttcaacttttctgtagatttgcagttttatgtgctgacaggtgaacacactgctgttggcaccatggccactgcatactacgtgctgtcatgctaacatttgatgctgcagcagtaagttatttctcaattgattctgagtctctggttcactagcaggatcatgtgcccaagctccagcttccaaggtgtgaggccagaaagtacctgaccctctcagcttccacagtgggaattgtggccctgtctctcaaatagggaggtattcagacactgagtagatgaaaaaaaaaaaagaaaagaaaaaaaaaggtgggggggggcggttggtaagaaaagaaaaaggaaaagaggggggagaaagtgaaaagaagagaaacatctgctatactttgttctactcctctactcccaactgcccagaaagctcccctgcttaggagagaatcagatcagcagagttcctgatgacctagtttacttgcctggagactcattagggtagctcaactactgactcttcctgtctccgtttttaccctcctgccaataacaaccccctctgtctgtgtctctttaaagccccaagagagatgatctgatggtttggctggtcactgtttaatagagggtgttcttgttggtctggattttcactctaggctacgtcagaaggtctggattggccaatagcttggatgcccttggggccaagctccgtccaatctgtttatttgcctgcggggtggtaacaaacagagaaacttccacaaaggagcccctaagacccctaagtcatggacttgtacaggcattttgaggcttttataagggggcagtgttagaaacgcttgttccctggtgctgcaaagaagtagctctcgagttggagagaagtaaaagctcgaaccggcctgggaaggaccttacctagtgatcctaactactgaaactgcagtctggacagcagaaaaaggattgacccatcacacccgagtcaggaaagtgccaccccctccagagtcatgggccacggtcccaggggaaaaccctaccaaactaaagctaagaaaaatttaactctctttcatccatttgattatgacttctttcctcgctctattgctgaccacctagttattaatgtaaccaagtcaattttgcctcaaactattacatttgatgcttgccttgttataccctatggagacttgccaagtcagaggcaactctccacttcaggaaagtatctttatccttcctagcgctctgcagactaaaaatctgttaactgggataaattagtttgagaagagtttgacgaagattccagtataaactggaaatcttgtcctcctagagcagagcttctctgccaaagttggtccaatgctctataaaatattaaagagcaaggatcggctgccccaactagtacttgcagtttcttaaaaccatatattcattttactaaaggagttacccctccccattgtcagctagaccaatgtaactgaggacagatgaccatccctgctccccagagttcttctatggcataggagcagaagtctcaggatcctttgaaatgcacttcattgccttgtcacctcctgcacccccttctccctctcctaacttctctgctaaccaaacctcttgttatctacccaatgatgaaaccaaagtagttgtagaggttaaagatttaaaacaaactgtagcaactgaaacagagtatcaggacgcaaatgcttggctggaatggattaaatattctgttcgcacgcttaacaaaagcgactgttaactcttatgcgacaggcaggccagagacccagcttgtccgctttccagttgggtggtcctctcatggactgggcatgagctgtatggtagctctcttccacaaccccacagcctggggcgatgagtcatgcaagactctttctctgcggttcactgaggttaagagccctgtgggtcagcccccgagggccatgctgccaccagcccctgatgttaacttcacctcgtgcctttctctgcggggggtggggggggagttagcattccttgaagacttaacagggtgcagtgaaaccaagccttttcaagagcttaccaatcagtctgcccttgttcatctccaagcagatgtgtggtggtattgcaaggaactattgctgggtactctgctctgccaagtaattagagcagcacttgtgccctagtccaactggccatcccttttaccctagcattccgtcaacacgaagaaaaaaaaaaagagaaaagcgtaaaaaaaagaagtgcctcacatgggtcctttgactcccatgtttatataaatgctattagacctccacgaggagtaccagatgaatttaaagcccgagatcaaatagctgcagaatttaagtcaatattttgatgggtgacaattaataagaacatagattaggtaaattacatttattacaaccaacagcggtttattaactacattagagatgctgttaaaggaataggtgagcgattaggggctactagccagatggcttgggaaaatagaagagccttagacacggtattagcagaaagaggagtttgcgtcatgattaaaactcaaggttgtaccttcatcccaaacaccaccgcccctgatggacgtataacaaaggcattgcaaggtctaaccgctctgtctagtgagttagccaaaaacccaggggtaaatgatccctttacaaggtggctagaaaaatggtttggtaaatggaaaggaatcatagcctcgattcttacttctctcgcagccgtagtaggtgtactcattcttgttgggtgttgtgtcataccatgcatctgtgggctggtgtacaaactcatacaggcagcacttactaaaacctcccttaattctcctccaccttattcagagaagctttttcttttagagaatcaaacagaacagctaagccaagacatgttaaggaagtttgaagagaaagaactataaaaattcaagaagggggattgttaaatatagtagaccccaagtttctcttcaaagaatcagtatgtcagtatgttcagttctcttattctttgattctccattttaaagtttaacttcctggttctcttcacccctttgcttctagtttcagtaaacaactttctcgcgagtcctaatcagtagttcacatctgttcccctggtcacctgctccatcctgactcatcctggtcacctgctgtgacctaagtcacctttagttacctgttcctaaccgtccttcctgccacactactcaccctgccactctggctcatacctttgctctctttaaaatagccagttggaattagcttagactgtgcggtccaaccctagccaatagggaaacaacacagcagtaggggctacctgcctcaggaataagaactccttgcccttccctgtccaggtgtgctgttgccattactccattcgcgagttacactcttctatagaagtaaaaattgccttgctgagaaaattaaatttatgtttgagtgctgtttcttcgtggcactggggaacaagcatttctaacagcagtgtagaggaaagaacttggctgggaccttaccctcctgcctcactgatggaatgagacatctgcagaggaagctgatttggggtaaagacaatgagttgatttggggcatgaaagtgaaagtaagattcccagatggtgctgccttttgtctttttttaatttttattttttgagacggagtcttgctctgtcaccgaggctggagagcagtggcatgttctcggttcactgcaatctccacctacagggtttaagtgattctcctgcctcagcctcccgagtagctgagactacaggtgagcaccactacacccagctaattttttgtatttttagtagaggctgggtttcaccgtgttagccaggatggtctcaatctcctgacctcgtgatctgccagcctcggcctcccaaagtgctgggattacaggcatgagcaccgcgcccggccctgccttttctcttgttggagacatggagctcaagttaggaagtcagggatggagatgaagatgggatggtcgatcatatagatgtaatgcttaaagctacagacagggaagagatttccataggcatggaagtgtaaagctggaaaagccaagggcagttgctgtaacactattccttcagccgttttcaccagaactttggaaacttgcatctggaatgagtaggtgaagtgaattagattttccaactgtatggtgcaggctgcatcaacatctatgtgcaacccacagacttcatgtccaacattcacatcttatgacattgtctcattgttaagcatcttgaggtaggataactttttgagctacaaatgtggaatttcctcttgtatttccccacttttcctcctcaggcaggcttcgttttactttcctcaggagctggcaggctgaaggcagaaattgcctgcaaaacacttcttttcctggctttgttttcaaaagcctaagtcccctgatgtgtctgagtgtacagtgtactggagggagaggagacaggaagcagctctgacggaaaccctagcaggcagtggtggatttcccccagggtaaaagattgctccaagccaggggaggggtccagggtcctgcaatagctgggacctgtgctctgccctctgacaacaccccaggggagtggtcagatctcagagaggaacagttacagggctcccagcctcaccaaatatccatatgtcccaagggtggcgtgaaagctagtgggctgttagaactgagggaaccagataaattgggccctggtggccttgacagtgaccagtaatgatctataactgcagggtcttcctaggaccttgaaggatggcctgaagtagaaaatcctgttgggtttggagtagaaattaagttggtttaaatttattattattattatttgtttttcttttttccttttttttgaggcagagtctcggtctgttgcccaggctggagtgcagtggtgcgatctctgctcactgcagcctctgccgcctgggttcaagcaattctcctgcatcagccttctgagtagctgggattacaggtgcgcgccaccacgcctggctaatttttgtgtttttagtagagacggggtttcaccatgttggccaggctggtctcaaactcctgaccttgtgatccatccgcctcggcctcccaaagtgctgggattacaggcatgagccaccactcccggccttattatttgttttgtttagagagggggtcttgctctgtcccaggctggagtgcagtggcatgatgatagctcactgcagcttcaaactcctgggctcaagcgatccttctgccttagcttaggactacaggtgtatgccaccatgcctggctattataatttaatttaatttaatttttttttttttttagacatggggtcttactatgttgcccaggttgatcttagacttctggcctcaagcagtcctccctccttggcctcccacaggcctgggattacagatgggagctaccattcccagcctcgtaatggaaatttaaaaattttataaggaatagctatactacatcaataatactgcctgaccatctttgtacatataacttttttatatacaggaattttttttttaaagatagattcacagaagtagaactactgattgaaagggtatagacatttttaagcatcttgatacatgtggcttaaatgccacatgtatggcctaaactgattgagtcttttcaggtttggattttaaaactagaaccctctcttcagtggagtgggatgggggaaacactggaaacctcatgggaagcagttgcaatatttcatatgaaatgcgaggaagggccagactgagattatggccatggggagagagaaagggataaaatcccctatcattcaggaggtgctatcaataacccatctctgcatatgggtgaagaagtgaaggggaggcaacaatcaagatccccttactaatttccagttgaaaatcgagtagatgaaaatcctatcaactaagaggcaatgtggcttggtggtaaatgcctgtgttttggatctaactgaccaagttcaaattccaactgtcccaactaattagctgcatggccttgggcaggttgttaaaactctctgagcgcatatgcctagatttccttatttgtgaaatgaggatagtagcgtttatgcctaccaaagaactgtaaggattaaatgtgaatttttttttttttttgagacagagtctcgctctgtcgcccaggctgcagtgcagtagcatgatctcggctcactgcagcctccacctcccggattcaagcaattcccctgcctcagcctcccaaatagctggcactacaggaaagcactaccacgcccagatgatttctgaatttttagtagagacggggtttcaccatgttggccatgctggtcttgaactcctggcctcaagcgatcctccccccttggcctcccacagtgcccggccataagtgtgaaaatgtctttaaccgcctggcccattgggactttgaagaaattaatgaaaacagataatactaatagaagaggatgtacagagggttaaagaatatatttggtttgagatccatttgtttaagatgcatgaaatctcacgaaatggactttatcttggtatgcttttatttttttaattttaactttgaaataatttttcctttatacttctttctgtacactgctgctttcatttttttttaagagacctaaaggtatgatagggacaaggaaagagagggtggtgatcctgttgcccttgtgggtaaggactgcggaggcagtggtgcagttctcaagcatgaccacaaggtggagtccgtagtaagtggaaatggtttaccctgcgtgggaggagactgggcaggatcctggagcagattcggtggcagccgcagagccctcggtccagttctgcaggcgagtcccatctagcctcttctgccttttggtgactgacttttcacgatgtaaagttaatcacagttacacataacagccaccacacactcccaggaccccaaagaaaccatgaagaaaataatcacaagcataacagttcaccttttggtggttctccattgccagttgcatgagctcccaactccttgactttcagttctgggacttccagtctatgagaccccacttacctttctggaatcttctcctaatacttttctacctggcccataggctccagtcaactgcctactcacggatccccaaaaatgcccctcattttcaccttgccttttgcttgttctgttccctgtttctggaaagtgatttctccatttctgcttattgaaacctcagtaatactcgaagaactcgttacatctgtgagggctctttatgtttcaagtaacacccggacaataaagggaatctaatggctcctatactgagaaatatcgaggtatctagttagcttcaggtgacgtctgttcagcagcttggacagcaccacaggtgacttggttttactccatttttgtcttctgccttttgctgtgtcggcttgcgttcagaacccctagtggctctttcagtcctcccctagcaggtaggtgtgctccgtatcttccttctgcttcttaacgtctctattcttctcctccctgctcagtgcccttggaggatgacctggcttagatttgcgggcttccttgccttctgtcttccacttgggtttggccagtgaggagcaccagcatgggctccacggatggctgggctattaattaaatctctgtcttccatggtgcacagcacaggctgccttcatccctcatctatgaggtgacagtctccatatctctatctctgcattccagcaaccaccctctgtaggcctagggtggtaatggccccaagatatttcattattccttaagttttccctacacatgctcacacttttgcaaactgtccatgtttttttttttttttaaatagagatagggtctcactctgtcacccaggctggagatcatagttcactgtggcctcgaactcctgggttcaagagatcctcccgcctcagcctcctaagtagctgggattacaggtgtgcaccgccaacagtccacttactaactgctcctcaaattgtccagtttgagtgtgccatctgcttcctgctgggaccttgactgatatagcaatcccgaatcacacatcttcatactacactgctcagtggtagaaaggcgggagaaagaggttctcttttggccattttaacaggaaagagagtatgcttcttgcccggcaaacaacttttaaattcttttttattttattttatttttttgagacggagcctcgccctgtcatccaggctggagtgcagtggtgtgatctcagctctctgcaacctccccctccgggttcaagccattttccggcctcagtctcctgagtagctgggattacaggtgcacgccaccacgcccagctgattttttctattattagtagagatgggatttcaccatgttggccaggctggttttgaactcctgacctcaagtgatctgcccgtctcagcctctcgaagtgctgggattacaggcgtgagccactgtgcctggccccagcaaacatcttgattatttttggcctcagttgtaatctgcctaaactaataagagactttcttggtgccaagggtgggtcatttcaagccaaaccccatgactgaaataggcaaagggtggttcccccagaacagaatcaagatgcagcagtgctaactggaagaaggagaaaattcagcaccttcttcccaaatgccatctctttctttgaagcttgtccttattcccccaagaggatacaacatgatggccaacaagatggtgtagttcccaagatggagattatagtgtagttggggaaacaattatttaatttaactttttcttttttagggtctcactctgacacccaagctggagttcagtggcaccatctcagctcactttagcctcgacctcccaggctcaagtgatcctcccgccttagcctcccgagtaactgggactacaggtctgcaccaccacacttggctaatttgtaattttttttatagagacaggatctcactatgttgcccaggctggtctcaaactcctggacacaagtaatcctcctgcctcagcctcccaaagtactgggattacaggcatgagccactgcacccaccatggggagacacttaaatacacaaagaataatgatctattacattaagtactgggaaggaaacaaatgaggtgctgagggaagaaaaacatggatgacctattaaagatcatgtgaccagggaaggctcccctgaggaggtgacatttaagctgaggctggaaagatgagaaagagacaacaagtgatgggaaaggacaggaattccaggcattctttttatttgtttgtttgtttgtttgagacagaatcttgctgtgtcgcccaggctggagtgcagtggcacaatcttggctcactgcaacctccacctccaggttcaagcaattctcctacctcggcctccagagtggctgggattacaggcacgcaccactatgcccaactaatttttgtattttcggtagagacgggggttccccatgttggtcaggctggtctcgaactcctgacctcaagtgatccacccaccttggcctcacaaagtgctggaattacaggaatgggccaccatgcccagctgaattccaggcattctgaggtgcactggctagagaatgaatagataccaaatgtggaggcacttaggtgaggccactgtggctgaagtgaggtgggcaaagggtagagccatctgggtgaggcaggagaggcaggcggggcttcctggaccagtgtttggattccagctgggtgcagagaagagaccctgaaggatattcagcaggggtgaaaatctgatttctgttttaagatcaccctggaaatagaggcactcatttggaagatgctgtgttgtctaggtgacagatggcagagacgtagagagggtgccagctgtggagatggagaaaaccaaacaaatcgagctgtattttacaggtagaatcagcatgatgattagcagctggaacggggtggttgggaggtaaagaagagtgtagagtaactcctcagttgctggtttgattattgagttgtggtgatgggggagggatggcaatcaggaggtcagcggccagaggccacccagcatctctgggtctaaaaggcaaattccaacagaagtttaattggcttcctttgagtcagacgcttacctggttcattagctaggctgaggttgggggagcacacagggatgggtatgctaggtagggcctgcctaaacttgctagcagcctacaagaatggagaaaagaagcatgtgaataactagaatccagagaattttaaggcctggggcagatgccttctggggtgccatcccagccccccagtcatttccctttctctagaacctgttccacccaccccagggtagggaccagccgcagtagatggcaggcagaaagagattctgctataaaacaccatacacataaaagaaagaacagcaacaaatggacaaagatggagtatggttttgtgcccaaagaatttacaaccccaaaatgagtttcgtgatatgcctgctttgatttctcatttattccaagttatcatttatattgttaatctatacagttttctccccccacgtattagacagcttttaaaaatggttttcaaggctgggtactgtggctcttgcctataatcccagcattttgagaggctgaggcaggtggatcattcgaggttaggagttcgagaccagcctg

SEQ ID NO: 1804 - DNA, 5697 bp, Homo sapiens
tggggtttgtatgtctgttttaatcagttttattaagatacaatttacatacaataaatttacctcttttaaatgtacaaattgatgagtattgacaaatgtataaccatctccacaaaggcaatgtagaaaattttcatcaccccttaaagtccttttacacttttttttgagactgcctcagtagtaaccactgctaaatttatcagagaactgcacacctggattgtattttgacagaacttccttccaacccaattgcttttaataatttttttatgataaatttttacccaaaatgttatagaatttatttacaaagaaatttcgtaagttgtatttctcctactggtgtggtattatgctaaggaaacaggtctggagtcatgaaatccttaggtgtctaatttttctaacctgtaagtttctgtgctactgcagatctcagttactgtctctggtggtgggtgtgtgctgcggaagagtcagaggtaaggcactagtccatttccttccaggacagttgagaaagaaggaaatgaactccagtcatcacaaatccactgttgatgattcctctggccaggtctcccctttaaatccttagggagaagcaacactgagaaaagataacttcttcttttttttttttttttgagacggagccttcctctgtcgcccaggctggagtgcagtggcgcgatctgggctcactgcaagctccgcctcccgggttcacacaattcttctgcctcagcctcccgagtagctgggactacaggtgcccgccacctcgcccggccaatgtttttgaattttttagtagagacggggtttcatcgtgttagccaggatggtcttgatctcctgaccttgtgatccacccgcctcggcctcccaaagtgctgggattacaggcgtgagccaccacgcccggccaaaagacaacttctttagttgtaatcccccatccctgagagtagaagaggcagaaggccaaaaagtcgaccacacatgtttgcagctcctcatcccagcaagatttctgtgctgccctggtgttaccctgcagatgccaccttttcccagttttctactggattattggtctttctcttaatgatttgtaaaagctcataatattatgaaacttcatacaatatctgagacctgggctcaaaatacagtcatgcttcacctaacagtggaggtcactgtttgaacagcatagagtgtactcacacaaacctagatggcatagcctgctacacgcctagggtgtgtgggatagtctattcttcctagggataaacctgtacagcatgctactgaacactaggcaattgtagcacaatggtaagtatttgtgtatctaaatgtgtctaaacatagaaaaggtacagtaaaaacacggtattatagttttttgggaccccattttatatttggtccatgaatgactgaaatgttattatgcaacacatcatggtgttttctccctagttattcttttttttttttttttttttttttttttttttgagatggagtcttgctctgtcgcccaggctggaatgcagtggcgcgatcttggctcactgcaacctccacctcccaggttcaagcaattctcatgcctcagcctccccagtagcagggactacaggtatgtgccaccacaccaactaatttttgtatttttagtagagacggggtttcaccgtgttggacaggctggtctcaaactcccaacctcaggtgatccacctgccccatgggattacagacgtgagccactgcgcccggcccctagttattctttggatttagtttatgatttctaaatgtaatttttaaatgtttcatctaattaaatgatttatctaattaaatttaacaatcctttatgttttctgggttgtgagtcatacctataaaagtcctccccacttcaagattatttttaaataacataaaattttttaccattttaaccaattttaggtgtgtaattcaatggtattaaaaacattcattcatattgccgggcgcaatagctcatgcctgtaatcccagcactttgggaggccaaggcaggccaatcatttgaggtcaggagtttgagaccagcctggccaacatggtgaaacctcatctttactaaaaatacaaaaattagctgggcatggtggtgggtgcctgtaatcccagctacttgggaggctgaggcacaagaatcgcttgaacccgggaggcagaggttgcagtgagccgaaatcgtgcccctgcactccagcctgggcaacagagagagactctgtctcaaaaaacaacaacaacaaaactcatattattgtgcaaccatcaccaccttccatcttttttccagaacttttttgtctttccaaactgaaacgctgtatctgttagccagtcactcctcgttgtcccctgcccccatcccccaggaaccaccattctatttgcttcactacattttgcttgtcttctttaagatccatccttgtctcccctatagcttaataaccagggtcgggtctcagtagagcctgacagggtaaaggcagttcctgatgtgagtggcaattgctgagccacacaaagactgcagcatctgcggacgcactcttccaggagccagaggagcccacagcagcgtgggtctgagcgtgctgaggtggtgagcgtggatataagactagatcaggaaatggagggccaggcgaggtggctcacgcctgtaatcccagcactttgggagtccgaggtgggcggatcacttgaggtcaggagttgaagaccagcctggccaacatggcaaaaccctgtctctactacaaaatacaaaaattagccgggcatggtggcacacgcctataatgccagctacttgagaggctgaggcaggagaatcgctttaatccgggaggcggaggttgcagtgagccaaggtcgtaccatggcactccaacctgggcgacagagccagactccgtctccaaaacaaaggaaatggaggtttagtgtcatgtcaaggacacctggaactggccctaaacatgcatgatgggtctccttgaagcttggatcccacaggactctacagctgagtggtccaatacaggatccacagcaaaccagaggcaatgctacattctgagggaaatagggtagttgtacttgttaaaatgataggattttggatatgctgggttaaataaaatatattattccaattcatttcacctgtttctcttcttttctctctttccttccttccttccttttcctttttcttttcttttcttcttttctcttttcttttcttaacacagggtctcactctgttgcccaggctggagtgctgtggtgcgatcttggctcactgcaacctctgcctcccagatttaagcgattctcgtgcctcagcctcctaagtagatggaattacaagtgcccgccactgtgcccagctaatttttttgtatttttagtacagacggggtttcaccatgttggccaagctggtcttgaactcctgacctgaagtgatccacccaccttggcctcccaaagtgctgggattataggcgtgagccaccgtgcccggccatcttttcatttttttattgtgtctactagaaagagtgacaagtgcccatgtggctgacattatatttctattggacagtgctgaccagtggaaaagatcatggagatgccagacaggtgtgagcagaatattgaagagtcagaaggctcagagaaggatgcatgttcggatgaatttattcttggagaccctttatttactaaagcgattcagggccgggcacggtggctcaggcttgtagttccagcactttgggaggccgaggcaggcagatcatctgaggtcaggagttcaagaccagcctggccaccatagtgaaaccccatctctactaaaaatacaaaaattagctgggcgtggtagcgggcacctgtaatcccagctactcgggaggtcgaggcatgagaatcgcttgaactgggaagatggagattgaagtgagccaagatcgcgctactgaactccagcctgggcaacagagtgagactccatctcaaaaaaaaaaagagagagacaagagagaatataaaaggccacgtgaagacagaggcagaagttgaagggaggcaaccacaagcaatgtctggagccccagaagctggaagaggcaaggagggtcctccccacaacttttggagggagcatggctctacagaaatggttgctctaagccaccaacttgtggtcatttgtggcagcagccctaggggactaaaacattctccctcccccacaactcaactctgtgggctctctccctggcagcacatcaaggcacacctttggcattagctaaatctggagggctagctaaatcatgaacatcaatgaatatcaatatctttttttttttttttttttttttttgagatgaagtcttgctcttgtcgcccaggctgtagtgcagtggcacgatcttggctcactgcaacctctgcctcccgggctcaagtgattctcctgcctcagcctcccgagtagctgggactacacacacacaccaccacacctggctaatttttgtatttttagtagagatggggtttttgccatgttggccaggctggtctcgaactcctgacctcaagtaatcacctgcctcagcctcaagtttgctttttgttcatggaaatcagcttcataaaaagcatcttaccctgagatgtagtttgtttctgtaaatttcagaagttgagttcagaatagacatatccagatttataagaatcacaggcttctgaaatataaaagggaaaataatttacttaggatatgtgaccagcaaggctgtttttaaaaatcctatttctagtagctgggtggcctgacagaaccaggtattaactaattttttcctggactgtgttaaataatttattcttgaaaatgttagctgggcataatgcctcatgcctgtaatcccaacactttgggaggccgaggcaggaagattggttgagcccaggagttcaagaccagcttgggcaatatagcaagatacttgtctctatccaaaaaaaaaaaaaaaattagtcagacatggtggtgcacacctgtagtcccagctactcaggaggctaaggtgggacgactgcttcagcccaagaggtagagggtgcagtgagctgagattgtgccactgcactctagcctgggcaacagagtgagagtctcaaaaaaaaggagaaaggcaggaaagaaagaaaagaaagagaaaaagaaagagagagagagagaaagaaaagaaagaaagaagaaagaaagaaagaaagaaagagaaagaaagaaaaagaaaaaataaagagagacagaaagagaaagaaagaaagagagagagggagggagggagagagggaaggaaggaaggaaggaaatgtttgagtagtgatcctgtatcctcctctctgggttttttttctatgacattcccccaccacatctttccctcttcctcaccctccatctcctgatgagatttttttaggagctggggtgctggttgccattggttccttgcagtgtgcctgcattgctcccatccaccccattaacgggctcctgaa

SEQ ID NO: 1805 - DNA, 5697 bp, Homo sapiens; identical to SEQ ID NO: 1804

SEQ ID NO: 1806 - DNA, 456 bp, Homo sapiens
cctttcactcggctctcattgttctttcttgctgccttgtgaagaaagatgtgtttgcttccccttccaccatgattgtaagtttcctgatgcctccccagcgctgcagaactcctggctgctgcactacatgattacggccccagaggaaaacctgcaggcctgcttccctcgagtctgagaggtgtgcatcacttccctgccagcacagaaaccactgcaaatgcacagatggaaaactcacacttaaggactggagtgacagcagcagcagcagcagcagcagcagcagcagcagcaggccacctccgcatccagaatcctggcacagcctcctcattcctgtctgatgatattctccatatccagagaggatttgtatttaaagctggactttaaaatgtacagttgtaaaatgtacaactgaatgttgtcacttcaaacaccataaatata

SEQ ID NO: 1807 - DNA, 1196 bp, Homo sapiens
tgctgggctgacaggtgctgctgggactggggggtgtgggtcgagcacccctgcacacacatccagggactggttggtgcagacacacactggcttgactgtacacaccccttgactgcacaagggctgattttgtggcgttgttcctgctctagactgaagcagggttctcaaagcaaacccggccagtagcaccgtccctcctgggaagttgttggagacgcaaattctccagcctcatccctgacctatagatttagagctctggggtatggcccagcagcatgtgtttaacgagccctgcaggaggttctgatgcagctcaaattggggcacacagctctgagtgtcccttggtgtctggagggctctggtctgcagcacagacacctcctggcttagctttgcctccaccccggcttctctccttgctcccctgagagcaccagctccggccatctcttggacaagcacctcgccccgggagtctgcgtctgggaaccaagcgggctttctgcacaccgcctcagacaagaagcacatctgcaaaatgcagcctgggagctgtctactctgcccggaacagtggggatctctgcaggaggaaatcgcatagtttcccacgggtgaattgtcatgatgctgttgtggctgttggcaggaagcttcctcacattttcagtttaaatgcattcctcctgatctttccaaaagacggaggcagaacagctggttgccatactccgcataaagtcctttgggtaaattgaaggcatttagtgctataaatttccctctacacacagaaatacaaactaccatcagagaatactacaaacacctctacgcaaataaactagaaaatctagaagaaatggatacattcctcgacacatacactctcccaagactaaaccaggaagaagttgaatctctgaatcgaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttga

SEQ ID NO: 1808 - DNA, 656 bp, Homo sapiens
catttttaaatacttttagttcacattttttaatgtttaaaaactatgttaacagagcagttatagaacagaacttcttatgtattggactcagatgaagtctaaagtacactggactctagagagtggattacataccaacgaccaagattcaagtgtttggggaaaaaaataccttagacagtctatgttggcgtcaacactaaaataaaaggcaaacatgcaggactttcaaagcttgattagataatggttctttgttttctttccttcaaatttgtgctcataattaatattcaggttccctctccccgctttcatagatcccaaagtttgagaaatgcagcaattcaattgtgaaaaaaacattcttctccccagcttctgttttcatatgtactgtgtagtggtatcagtgttaaaaatggaagatcattatgaagaaacaatttgtcatttgggtatatctgtttctataggacaaggatttgtgtctaaatattccttacttgtatctcagaggactatctgttaaataattgatcttaatgccagcataagaaatcaagggaactatttctcagacatttctttctctaaattaagtagggtttcaggttccaagtttacaacagggatgtttctttttctcggcg

SEQ ID NO: 1809 - DNA, 656 bp, Homo sapiens; identical to SEQ ID NO: 1808

SEQ ID NO: 1810 - DNA, 656 bp, Homo sapiens; identical to SEQ ID NO: 1808

SEQ ID NO: 1811 - DNA, 656 bp, Homo sapiens; identical to SEQ ID NO: 1808

SEQ ID NO: 1812 - DNA, 513 bp, Homo sapiens
aaatacttttagttcacattttttaatgtttaaaaactatgttaacagagcagttatagaacagaacttcttatatttctttatttacaccacactctgaaaaaaaaaacccagttctatttgattaactatgaatagcaaagttttgtgacttgtgactcacttaaatcacccatctgaaattcatttacaaggtttttacattaataaaacagtagtgtggtacatgtattggactcagatgaagtctaaagtacactggactctagagagtggattacataccaacgaccaagattcaagtgtttggggaaaaaaataccttagacagtctatgttggcgtcaacactaaaataaaaggcaaacatgcaggactttcaaagcttgattagataatggttctttgttttctttccttcaaatttgtgctcataattaatattcaggttccctctcccctcttttaaagacttccctaaaatactcaatataaaacaggagttacttatcct

SEQ ID NO: 1813 - DNA, 513 bp, Homo sapiens; identical to SEQ ID NO: 1812

SEQ ID NO: 1814 - DNA, 2898 bp, Homo sapiens
tttaaatacttttagttcacattttttaatgtttaaaaactatgttaacagagcagttatagaacagaacttcttatatttctttatttacaccacactctgaaaaaaaaaacccagttctatttgattaactatgaatagcaaagttttgtgacttgtgactcacttaaatcacccatctgaaattcatttacaaggtttttacattaataaaacagtagtgtggtacatgtattggactcagatgaagtctaaagtacactggactctagagagtggattacataccaacgaccaagattcaagtgtttggggaaaaaaataccttagacagtctatgttggcgtcaacactaaaataaaaggcaaacatgcaggactttcaaagcttgattagataatggttctttgttttctttccttcaaatttgtgctcataattaatattcaggttccctctccccgctttcatagatcccaaagtttgagaaatgcagcaattcaattgtgaaaaaaacattcttctccccagcttctgttttcatatgtactgtgtagtggtatcagtgttaaaaatggaagatcattatgaagaaacaatttgtcatttgggtatatctgtttctataggacaaggatttgtgtctaaatattccttacttgtatctcagaggactatctgttaaataattgatcttaatgccagcataagaaatcaagggaactatttctcagacatttctttctctaaattaagtagggtttcaggttccaagtttacattgagagaactatgttacctgggagagaatgtaaatttttctaattcccaaacaaaaccactaatttctaggaaacatttattgtttatatgcagatcctagagacttctatttcagtgcagatcaacaacttcaaaaatatacagcctcctatttatttacaataatatttacatacaaatgaagtatttcctgcaataagcctcagctgcatagattcttcctttaaaaacgtaaatttgagcctgtatacagatgggcccagtttcatagcccttccttagataaaagcctaaagaaggaaaatgtctgcaccttgtgaactttacatattttgcaagaactttctctttgagatttagtgatagtttttagttgttagacaccccaccttcagcttgtacctgaaagctttatctcgttataaataattcactgtaatttaggggaagtatgtcctgttgctaaaggattctcaaacctgccatccccaaggaaaatcatgtattagtattgctaaatgatggtctgtatattctttgttttgaaggtggctagatgtttgctgtaaacttgaatgggagaattatattcttaaagtttacaccccctataagcctaaagccatttaaattgataaactgagagagactaatagattttgctctaaggtataaaatccattatctgatcatattcctgacctccccccgactccaactaaatgtgccatagtccaacactgtgcctcactgaattggaactcagtatttcattcttttgagagcagtttgtagctccttaagcagagcagacctttcagtagagaattcgctttaaaaggaggacaggattatcaccacacgattaacacaaacactggagaacttctgacacaaattcagtatttcttctaagtctgcatttacaaagggtcttttattttaatttctttcacaactgcctcgccccaaccaaagcctcactttcatttcctcacagctttaaaaaataaaatattatcatgcctcagcccgaggtaacaccgagtgcaggcagcctgtgtttaggaatttgcacctgcgctgctattttcaacgagaaggggataaccaggtggcagcgctggattcactcactttcttgccattgcagagacccctgccgccaggctcctttcctcccctccctaaagcctggctcctgtatgttgcaccatgagtcctaggaatcatctggtgagggaggactaatgggaagtaaaagggagactcattggcttagggtggttctcaaacttgatgcgctttagaatcatttgctgagtccctccctgagagcttctgacttcaccatgtctgggagggggctgagaatctgcattctaatgaggtccccgatgatgctgattcaggaagggaacatggctaagtgcctggaaactctgccaacagtctgcggttagattctacttgtctctggataagaaatctgtgctcagtgaacttatgtgtttggaaaatttaaccagaatatagaggaagcataagtcctgtttcaagagaccagctcacggagcatgcacatttctcaccataggcaagctatggacaattcaatcacatgggatggccccacttaggggaatgcagttctgggtttccttgctatccctattctttttcagctacaaactctcttctttttcagtctcttcagtttccttgtgctccctttaggagagggacaagggtaagagtaccaggcaactctgtcctcctgcatggacagttgagacgggcagtaatggcacagtccttggttggggaagagaagaggagacagcacagacactgagacccccttgtcttcctcatctgggggaaggaaggtactcagtgattctgtcagaagctcttcacaaagactatctctgagggttttttttttttttttttcacaagactagatggagaattaatgaagaagaaatagaaatgaggcttatttaaggtacaaaattcttgtatttgtaataacctagatttatagatataaaacaagtcttttaaagacttccctaaaatactcaatataaaacaggagttacttatcct

SEQ ID NO: 1815 - DNA, 1750 bp, Homo sapiens
ccatgttggctaggctggtttcgaactactgacctcaagtcatccacccgccttggcctcccaataaatttaaaacctccatagtgcagattaaatgctgctcccaaacccagaacagggcttgaacccacggaaaactcagtacatgctatagggatgactggcttgttcaggtccctccccagtttccttccccatccccacctctcctagacttccccttcacaacccatccctacttttccagccacctctgcctaccagggttcaaccctcctgcaaatgaaaagcctccttcattatattaaaacaaagcctctccaaagtcagccagaagacagcttacaggggacccacgctgtgggatccatctcccactcctccagtagtgtctcctcttgcatctcactttgccttctgctgcctggctatcaatcagacctaactaacagggaagacttcatctcgctatgtcactcaggctggagtgcagtggcacaatcacggctcactgcaacctccgcctcccaggttcaagtgattctcctgcctcagcctcctgagtagctgggactacatgtgggcgccaccacgcccagctaatttttgtatttttagtagagacgggggtttcaccatgttgaccaggctggtctcgaactcctgacctcatgatcccccccacctcagcctcccaaagtcctgggattacaggcgtgagccaccatgccgggccaagactcttttaatccccattccagtataggcaaagcccccctttcccttcattcccctgagatatatgagatagacagcatttataaaaagaattttaatagatactccagaatcaacaggaaaaaaattggcaagtatcacagcaatagttcatgttctagaataggggtttctaatgatacaataacttcactcaggccccagggagataggacaatatcagactgccttcttccccggtctctgccaacctaacagcttctgatttcaggacacaaaatctaagacttgccaggttcaaggcctccacccccaaagcaaagcagtttggatgacccaccttccatcagagccaaaagtccggttgatggactgagtaagtatacttgcccaggccccaacctctccagagcagactcgagtccctcaggtaaaagctttctcggccaggcgcggtggctcacacctgtaatcccagcactttgggaggccgaggtgggtggatcacctgaggtcaggagttcgagaccagcctggtcaacacagtgaaaccccgtctctattaaaaatacaaaagtttgctggatgtggtggcacgcacctgtaatcccagctactcagaaggctgaggcaggagaatcacttgaacccaggaggtggaggttgcagcaagccgagatcacaccatcgcactccagcccaggtgacagagcaaggctctgtctcaaaaaaaaaaaaaaagctttctctcacatctgtcaaaagtcccccataagccacaggtgaatgccacacaggtacagagcaactgaaccaaagccttactcccccaagtcatgaatccctcacctccttgagccgggcaatagcatctcctatctctgggtgccccatctcatcctcagtcagcaccctaacgatctgggagaagtgctgaacgaaatcctgcttttcttgggcataaacatctgaattctggtctccgttcattctgagggaggagcaaagggct

SEQ ID NO: 1816 - DNA, 1750 bp, Homo sapiens; identical to SEQ ID NO: 1815

SEQ ID NO: 1817 - DNA, 4958 bp, Homo sapiens
ctgccaccagaccacagggaggcttttgcagtgtgtagcctgcacaaccgtgccagtgtacctgcactgctccctgccaggcccatcctgacctacgcagcctcctctttcacctttggcctccccagcccaaggaaggggttgtaggcaagaggtcaaagtatccgtgctggaaggaccacacagccgcctggctttctaaatcaagtccattttatttgaaattttccacatgccacacatgtacatgaaaattcccatccagaatgtagtttgctacagtgaacaccaatgtcaggagcaggcatcaccgtgagacgccacgggggcaggtcagcgggacggggacagggaggttggtcatcgaaaggcaggtgatgcatgtcgtgtcatttagcacctggtcatgagatacggcgagacccccaggtccagggaaaggtctccccttaaaaccacgtggagctctgctgtctctgggcagtctcacgtggacagacaatgctcagaaggtggcgaaggggctggagggagataccaccgacggctgcaggggaggggcacgcacacacacaggcacgcacatgcttgcccatgaacaccccccgggcacacacacacccttgcacactccccaccctccctccaccccagacacatcagcacagcggtccaggctctggctcactccccgggaggcttctgtggccagggttcccatggcgggtctggtggcaacagcttggagaaaagcctcccgggaccaaccctcattcccaggtccactgatctggggtaggagtagccaagtgttctgacaggcggttttcccgtaaaccgaccccttcagcgtttctgctttttgttgtttgttttctgagacagggtattgctccgtggcccagagtggagggcaatggtgcgatcttggctcactgcaacatccaactcctgggctcaagcaatcctcctgcctcagcctcctgagtagctgggaccacaggcacatgtacaatgcccagctaacttttttttttattttatgtagcgatacagtctcactatgttgcccaggctggtctcgaactcctgggctcaagcgatcctcctgccccagcctcccaaagtgctgggatgacaggcgtgaaccaccacgcccggcccctcccatgtttctcaaaggagctttagagagcagaggagcccgagtcactgccaccactgggttcctcagtgtctgtggggtttgtgttcatcatgcccagtagatctagaaacttcttttgttttttttttttttgagacggagtctcactctgtcgcccaggctggaatgcagtggtgcgatctcagctcactgcaagctccgcctcccaggttcatgccattctcctgcctcagcctcctgagtggctgggaccacaggcgcccgccaccacacccgactacttttttgtatttttagtagagacggggtttcactgtgttagccaggacggtctcgatctcctgacctcatgatccgcctgcctcagcctcctaaagtgctgggattacaggcgtgagccactgcgcccggccagatctagaaacttctaacttgaatcccacacccccaagtgcaaatgagacccatgaccatcacaaagaccccccagcgtcgtggtcaaggctaccaggaactggcagcagcgctctgcccacgtccacaggaagtggccgacgtctcctctgcctttggtttagtggccccacacttcatcacctcactttgtccatgaatttcacacgttttcttacaagagctctgtaatgcgccaggcacggtggctcacacctgttatcctagcactttgggaggccgaggcaggagaatcacttgaggtcaggagttcaaggccagcctgaccaacatggtgcaaccccatctctgcaaaaatacaaaaattagccggtcatgatggcaggtgcctgtaatcccagctactcaggaggctgatgtgggagaatcgcttgaacctgtgaggtggaggttgtagtgagtgagctgagatcgtgccactgcactccagcctgggggacaaagcaagactccctctcaaaaaaaaaaaaaaggctctgtaattttcagatcctaaaaggagcagataacaggggaagaggaggtgggaggctgccacagcgctgcctgctgggggatcaaggtccccgcatccaggcctccagcaccctccatccctgcaggagcactgctggcaccgccaaggccggagcactggtctggagcttcattggccggcaggggcccagccctcagctgttggagccctacggctctaggtctggcccctccacaagccctccaggcccacgcctgagcccagccccggtcccctgggtccaacggcctgtggctctgggtccggacccagggtgtggttgagggagggcgctgctgagctggcaggcaacccttgtgtgtttgcagcgcaagaggagctcagcccgtcctggctgccgtcctgggtcgaagcagcaagtgtcttcccgccctgtgcacagacaggtcccaggagggcctcttggagaagaaaccgctcaggcccatgtcctggcagggcctctgggggcagcagatggcaaggatagagcccgccccctctgctgcagaaggaagcggccctcacccagcccccctgggctggacgggccgttgaaaacaagaaaagccttccatagcagaaaggagtactcaaggcccagaaaggcagctttgctctgggtcatcaggctcaagtgcctgctctgggccaccttcggaagcctggtggagccgagtgttgcctggtgacgtggagcaggaggcggggcggaggctgcgggacacggggctgcagggccgggaagggggtcaggagaataaatagcagctaggtgtggggtgagctgggagcacaggcaggagggggcagccagagaggttggggctctcccttttaaagaacaaagggatacataccctttcccctcctccctccctccaaccccacagtctctccctcacatacacacacggaagacgtgactcacacacacatgcacacacagggcacaggtacacgaaggcacacgtgcacacacagggcacaggtacacgcaggcacatgtacacacaggcacacgtgcacgcaggcacacgcatgcaggcacatgtgcacacacagggcacaggtacccgcaggcacacgtgcacgcaggcacacgcacgcaggcacggggacaagtgctgaccacgctcctccagcaggcagcatatggtctgctgcttaacagccgagctctgccaattggggaccattagggtgggttcttttcccagcatcaaatgctgcagaatataaattgcaactaacgctggtgccaaaatagcacttagagaaaataagcacgttattaacatctggtgaagcccatctcgggggtagcagcagcggaaattcttgctctaagtcagaggatggttgcaggggacactaaaaatacaaggtccactgtttcaggggtgctttccaaggcactgcaccccagcctcaggaacagcccttcccccagtcctgtctatgagtataaattatgctgctggttaaaaccgcttgctcatgagaacaggacacccaggcgcgatcgtacacacgctaggatgcattcctggagcagacgcaattctctagcccgagtggggaatgttctggaggaaggagtggggcggagctgcggtgcccagagacacaggccccctgagggtccgggaacctcccaggccactcgcccctgcctggtcggagagcaagaagtggtcagtcccaggaggcaccacaccacccgatctgatcgccgcgcctggtggtctccaggtgccattttaaagctctaaagaaatgcccaggaactgtgggtggggggggtgctcccaccacctctgagaccctcatctacagcccctgccccctggggccgtgggcagctggtcctgcggcctgcagactaggagacggggcctaggggtgtggctctcacaggccatgacaggagggccaggaggcctctgggaggcgaaggcttggtctggtgtgggtcccaccatcgggcactgctggaatcagcctgcagaagggtccctctggccaggaggcaaaggttctgcactgggtgcagcctggggctgggagaggacccgtgggcttcagagaggaggcgatgaccccatacatacaagaaagtcagggtgaagtgggaggagacctcaaaccccagatccacctgtgccagtgagcagaggcgccagggtggggtcaagactgccaggtggagagctgggaggcagcctgcacaggagggctgtacctccccacagctctgaccccagttctccaaaggcctcctggacaaggagcttggcccccagagcaaggagctgctgaaaaccatccccactcaggggcagggccggtgattggaggcctggggatggtgtaccccattttttaacagcaaagcaaatgtgagacaccaccccacaggacggggcatctgtcacacggaaacccaggaggaggaaggcgggctggacaaggggcccttcaccaagagcggccagggcggcggtccaggctagcagggcccaactacagccccctttggaagccactggcccagggacagctctaggagcgcctggaggtggaggacggcagaagcggccaccgtggcacatggggtgaggactcagatgccaggaggatgtcctcatttttggaataactttgtttttttctctttctttttcagagatggggtatccctgtgttgcccaggctgatctcaaactcctgggctcaagtgatcctcccaaagtgtgttgaatatatatatatatatatatattttttttttttttt

SEQ ID NO: 1818 - DNA, 809 bp, Homo sapiens
tttccctagggattgcgttgcacgccttcctgcagggcccagtgcggggaccagagggatgtgggatcctgaggatcactgtggggcacggacgctcaatcctcagtccccagtaagggaaagccgagggggtggcagaaaagtgtgtgtgtgtgcgtgtgagtgacagtgtgtatttgggggccgggaggggtgaatgtcctggggtgctcgcagctcggcggggcagggccatcgccctggctccatctccgtttcccttggcttacctggctctggcagaggccgcggcggcgaggcccgggtggaaggcggcggcgatcccggggaggacgcggccggagtgcagcagggccatggtggaccgtaggagggcagtgggcagccgcaggacggagcagagggcgagcggacacacacacagggaaccggctcctgctgaaggtaaggacagggacttccctgggccagagcggccgcgtgctgggcccgagccacgtcacagcgatccctggcggccggcgggcggagcggcgtgggctcagcggaggtcgtggaagaggatgactgcacagtttacctacgcccagcccttgctgcgcttcattcatttaatccagctgggccaggcctggccggccgaagaggtggctgctgttatggcagtttgaaagatgagaaaatgtaggctgacatagttgacgtattttgtctgatgccttacagccattaggacccaaggtggccttactttcaaccctaatagtttccctaagcacaagtcatgtcacgtcgttcctgaatgtttc

SEQ ID NO: 1819 - DNA, 3541 bp, Homo sapiens
ttgtaatgtgcctgtaagtgagggaaggaagtttgaattttacaagtatgtgaccagagagacaatcatttacaaaaggcaaccaggaggaactcccttcatccacaagcttgttaacaccagcccttggcccccagtggcccctcctcttgtgcagatctgtacagatgtggttttgtctacaggcagagctccctcatccacaaggatagggccccaccccacataccagtggccacttcccacttgtgagtgaggtctagtgcagaagcttcccaggaacgaagaagccttgaaagaaagggagccagagcagagaccccgacaggattcccactcccgctgccagcaagtccctgacacctccattctttgtctagggggaaatttggatacacagacagacatgcacagagagagcaccatgtgaagatgaaggcagagaagaggttggggcgatgtttccacaagccaaggaatgccagagagtgccagcaaaccacagaagccagaggacaggcatggaagagattcttcctcacagccaccagaaggaatcaatcctgccgacacctcgatcctggacttctagtctgcagaactgttagacgataaatttcagttgtttaagccacaccgtttgtggtactttgttacagcagccctagaaaatgtatacgactccaactctcaaagtattatttccagttcaaaatcctcttctgaatttcgggttgacaagagatacacaggcttctcaaactcacataaaggtgttatttagcccaatgcctgtaccataacaagttctcagtaagagttaatgctgctgctactattgatgatgatagtgatgaagtcgcagaaaagaaggggaagagaaggagcagcagcaggaagaagagaatgaattaactgagtctggctcccctctgtgacatacaaaagatgtaaacagtcaccacaagatgtgtcttttctatctttgtactccctccatccaaccactcactgaacgtctaaagcacactcatgattgaagcttctgaatgtccttattgaatgcattggtagacaactggtcgttaatcacagatggacattctttagaagaaatcatagttcctggcccctttgtgcattcaacgggagtgtttatttgcagtgaggcagtctgaaacacagtttcactggccaggactatactccatctcggctgaagagggagaggtggcatgatacgttcacattacagccgtgcctgggatttaagtaacagtatttgactctcaacctactcttctcccccatcagccacactcttcctctgatcaagatgaggaggcacagaatcgcaaactatgcccacttccttcagaaactgaaatgcccaggttattttaaatggcaccatttatcaagcacctgctagctatgtcaaaacactgtcacactcttactttgtattcatttttccaattgaacccaccaaccccacttccagtatggaagaagtattattaatctcatttcaaaaatactacccatttcattggtggctggagagactacattgcctgaggtcattcagctagaaactgtcagggctgggatttgaacctatgtctctgtgactggcctacttagggcccagcactggaattgtgcctggtgactagctgcggcgcaataagtattttgtgggcttactgactccaaaagcaatactctttccactacatgttggaaactctctaaaactggaggagaagaggtgaaaaagacagaaactcaaggcaaaaggtctgggtggcaggagtttggatattgagagggattccacaccacatttacagatgcaccaccacagcttgcatttttgaaggcacatggacaatttatcaaggcttcaaattttacagagacacacatggctgtgtaaagaaacttcagctgccacaatgatcttcactgtcacctggccccaacagaagggcaaatacgatcaaagcaatatacaaaacgagccgattgtgatctcttttttaaggaagagaaaactctgtctctgttctatttccttgtgtgtttcacagtttgggctccatgattatattattgcagaaatctctccaggaaaattgaactcatcaggacatttgcaccttctcattcatacacatctggacatgttatatctgaaaattggaaaatccacgtgcattcacagaccatgcaaaaaaaagaaagtgggaaatgccaagcccatttatcattctcagtgacaaaattgtacaggcagcctcttctgcaagaaaagcaaatgaatgaaagggtgagcagagtgctaataaagtaccatggctccagattaaagtgtcagtgcttctgctcagcctctgagcagctgaaatgcttctctgggttctgattaggaaaaggaagatattcaaagagatgtgagctgcatgcctgggatacattttcataagccaaccatgccttgtcaaaccagaggcagagattatgttggcaagggttgcaggccaggctgaagcccttggcaaaatcaggaggcagatgaattggtgtttccagggctctttgctgaagctcccaagcagcccacctcatgcccaactttctacagtttatgagcaaggcagaggcccaccatgtacataacctgcaacaccagcatcctctcagtatcacaaagaactcatttctccctccaatcaagcagctcccctcactctcagtctgaccttcactgcctcagggagcacataggttgggaagacaccttaaccacccccccagaccaaagaagcagaggcctctagactaaggtcctggctatatcctctgcagaggaggagagaaacgccttccattcctttggaataagcccactaccaacaaacgccaacacagttaacgcctcatccagtttgtcctgacatcaatttcaagcttttctaggattgggtcccagacaggagcctagagagacaccctcagtgtttcctgcttaagcttggactgcgtttcccctccccctaggaactttaactgccttccaagaggcctgcctcccaaagtcacgcctgtactgctaatttacaacatgaaaccttcaaagcatcacggcaattagattaatctttattgcatgctttctgcttttaaaaaaaatgtcgttatgtagtgttcaattttttaataaatgtgacaggaaatgagtcccaaagaaaatctatttcatgggttttcacaagtgtctatgagtggcgaggacatgggtgggctgcctctgcatcctcctgctctcaggctgtgtgggtcactccaagcaaagggttccctgctgacagcatcctcctcgtgggtggcaggggctgtgtctgcctctgctgaggagaggcaaggaagtgaagagttccgattcagaagcacttgcagctgtgggcaagagccggtttcatgcagattcactgtcaagtgaaggctgaggtaggaagtattctcttgattctga

SEQ ID NO: 1820 - DNA, 739 bp, Homo sapiens
ttgtaatgtgcctgtaagtgagggaaggaagtttgaattttacaagtatgtgaccagagagacaatcatttacaaaaggcaaccaggaggaactcccttcatccacaagcttgttaacaccagcccttggcccccagtggcccctcctcttgtgcagatctgtacagatgtggttttgtctacaggcagagctccctcatccacaaggatagggccccaccccacataccagtggccacttcccacttgtgagtgaggtctagtgcagaagcttcccaggaacgaagaagccttgaaagaaagggagccagagcagagaccccgacaggattcccactcccgctgccagcaagtccctgacacctccattctttgcgtctaaagtcccctagaaacaagtcacctgattctactaagccacctgcctcatcccactgaaaacctttccggaaagatgggccagacatgctctctgatggccattcgtcttctgaatcccaagaataatcctttggcacaaacatagaagtgtattatttggtcttccagcaaacatgaagagaaacaatgaaatgaaggaaatgcacatcacgagctgccacacaagatcctaattaccataatttgacccatcctccttcccattgccggaaagtcagccttctggatgagaggaagccaaaccagcaagataacaggcttctgttctctctccccgtccctcgcctctttctttctt

SEQ ID NO: 1821 - DNA, 1327 bp, Homo sapiens
gtgatgttccctgccgacattcaggatattttgttggttgtttaactcttcaaaaacttgacataagggtctattgattgtggaggaactgatctccttctcatgggttctttgagctcctgtgtgggcataagtatatctttgttataatttgttccacctgtgcctgtcaatttctttccacttgcctcctcccgtgacattctggctcatgtttcttcataaagctctaagccagttattaataacagaccagtgagcctcctgatccaccaagaccatatggtgtttttcataaaagagagagatcattcccttgactttggacttcgcttattgaacccctggacaacggaatctccctctgtcgcccaggctggagtgcagtggcaccatctcggcttaccgcaacctccgcctcctgggttcaaacaatactcctaccttggcctcctgagtagctgggattacaggaatcaaggttgctaagagaccacctgtgctgaatacactttgttctggcaagagcagaaaactgagaagccgtgttacctaccactacctgggattaattcagggagcgggataattctggatatgactggtaaaaactggatattaatttctactactactcccaaaagtctagaagatgaaattgtgggaagacttctaaaaattttgtttgttatctttgttgacttaatttctattatatatgttgtgataacttcttagaaagctgacttcctttccatgtacatttcaaactgaattacagtgaataaaaatttgtattttaacttgttgagtgactcacattttatgacattgccaatttattctagaagccaacaggacactgcaatacaaacaacattgtgtattgtttagttctttatggtttatgaaacattcacatatactgaagtgaatttttttccccaaaaacatctatcctactgagtcatgaaacttctagatttttagccaggtgtggtggctcacacctgtaatcccagcactttgagaggcccaggtaggcggatcccttgagtgcaggagttcgatacgggcctgagcaacctgaagaaatcccatctctactaaaaataaaaattaaaaaaatttgacaggcatggtggtgcatgcctgtatagtcccagatactcatactcgggatgctgaggtgggagaatcgcctgagtccaggaaatcaagtttgcagtgagctgtgatcacaccactgcactccagcctgggtgaaagagagagacccagtctcaaaacaaaaacaaacaaacaaacaaacaacttctggattttt

SEQ ID NO: 1822 - DNA, 1327 bp, Homo sapiens; identical to SEQ ID NO: 1821

SEQ ID NO: 1823 - DNA, 626 bp, Homo sapiens
caggaaaccgcctcaacggcttcttgccgctaagctatttcatttctgcactggttacaagagcaaaaatgggtgtttgaagaacttactcccatgatgcggcagtcaaggagatgcacagtagaggatcaaaaagctgacaacttggcctcccctgggtcgcttccaggggagcgcggcttcaccgctcgaaccagctggccaagttccgtatgctcttgggccggtccccagccctctgtacagcctggcacacccggcaccaaggctcgtcccagaaggaggtgatgtggacagcgtagctccggcgccagtggaagtagcggcgatagaccgcggggttgcggtcgaggaaaagcaggtacgaggccagggaggaggcacttgggaagtcgtccacgtggatgaaggcgccgcggggcacaaagcgctcgtagttggcacggtctgggcccagcaccaccggcaccgccccagcgagcaacgcgttgcgccagagcttctcggtgatataatccaggtgctgcgagttctcgaaagccaggtagaacttgtagcgggccactgtgtgcaggagcccaatttcgggcaccggctgccccgtggctcaccacccatgccaccag

SEQ ID NO: 1824 - DNA, 626 bp, Homo sapiens; identical to SEQ ID NO: 1823

SEQ ID NO: 1825 - DNA, 2607 bp, Homo sapiens
gtaaccttctgagctagagtaggctcagagactccctcatctgttgaaatcgaatctccaatgttttgcctttaagaggtggggctgttgggtcatgagggcagaaccctcgtgaatgggaataatcccgccataaaagaggcctgagggagtttgcttgcccctttcctccttccaccatgtgagaatgcagcaagaaggtgccctgtatgaagcagagggccctcaccaggcaccgaatccggtggcaccttgatgttgaacttctcggccttcagaactgaagttttgtggccatggggatgctgacaaagattgcttgggatgcacacaaggcagcggcgaagcctgaggggtgctgccaggccgggctctccactggccacggcctgaccgactgctattccagaggcatcacccgtcaggcctcaccggaaggctgcacagccggtgccacctcagagagtctctggcaagaggtcagcctcctctggctgctcctgcccttttgtggatctgctttcctagtccaggtgctctgttcggagggctcagggacccttaagggaagacacctttcttcactctgactcagtacttttacactctcagctttttcccctctcactacccaactccccagcccctggtccacaacccttcaggaagcctttggttaggggccccctcaagagtgagatgacccccacatctgtgctgatcctcctgaccctgaaccgtatgggtgcattgttccaaggggaaaatgaagcaggagagctcagcactccctccagtgttagcctcttgcttgtactactgcagtgcgggattaaagtcttcgctattacttccatttgtgcttgttgtagcttcaagtggctactctaacacctgacagctcagctcccttccagctctactgagctcctgacagcgccatgcgatgcaatttaatctaagaggaattcagccgcatggttataccggggcacggtggagaataaatgacattctgcctttgttctgcctaaaatacaggtgtgatgactggagatgcagaagccattccattatatcaacataacatgataagccaagaccctaaagatgctgagaaaaatggtcaaaagagcttggggtttttttggtttttttgtttgtttgttttgttttttttgaggcagtggtctcactgtgttgcccaagctggtctcaaactcctggcctcaggcttcagcctctcaaaactgctaggattacaagtgtgagccactgcatgagactgggctgttttttgtttggtttggtttttttagagacagggtcttgctctgtcacccaggctaaaatgtagggatgtgatcatagctcactgcagcctcaacctccttggctcaagtgatcctcccacctcagcctcccaagtagctgggaatacagacatgcactaccacacccagctaattaaaaaaacaaagtttagtagagacggaggtctccctatgttgcccaggctggtctcgaactcctcacctcaagtaatcctcctaccttggcctcccaaattgttggaattacaagcgtgagccaccatgcccagtactgtctggtttcttaataacattgttgagccattgcaatagccttgggatattgctctttgtactttttcttatgcaagaaaaacagattcacaagttatttgatgactctcttcccatcaaaaggaaaagtctaattctttttcccttgattatggatcagcttgagcttgttgcttctaacaaatggaagagagcaacatgctggagtgatcacatggaggaagcacaaagggatacatgcccaaggggccccagctgttccagcccctagacatttgaatctactcaggcaccaagtaagcaggtgaatagccttcaggtgattgcggcccactcccagctgaagccaagtggagcgcagatgagcttcccctgctgagccctgcccaaattgcagatttggaagcaaaatgaatattgttttaagccacaaatttgtgagtgttttgttacatagtataaggagccagaacagctctacagatgtaaattatagtcagatatgttgctatttataaccaaagcattcctaacttataaatgtttcaacattaataagcagaagaaagtgtaataatcttatcaaggtaatacaagttacttgtttaatataaccaccttcatggcaagcctcaatttcataacctaatcactttgagtacaacttggacctaatgggtagctttttttttttttttttttttgagacagggtcttgctctgtcacccaggatggagtacagtgacacaatcatggctcagcacagtctcaaactcctgggctgaaatgatcctcctacctcagcatcctgagtagctgggactaaaggcaggccccactatgcccagctaatttataatttttttttttttctgtagagatggagccttgctatgttgcccaggctgatcttgagctcctgggctcaagcagtcctccagctcaacatccccaagtattgggattataggcatgaaccaccactcttggcctctgtgt

SEQ ID NO: 1826 - DNA, 4241 bp, Homo sapiens
tttgcctttaagaggtggggctgttgggtcatgagggcagaaccctcgtgaatgggaataatcccgccataaaagaggcctgagggagtttgcttgcccctttcctccttccaccatgtgagaatgcagcaagaaggtgccctgtatgaagcagagggccctcaccaggcaccgaatccggtggcaccttgatgttgaacttctcggccttcagaactgtgacacagagaatgagtggaatactaatacattgaagggcaaaatcaaaaccccagaagatctctaaaagtctgaatgaatcagcccatattacaagataaagtccataatggtaaacggaaggctctggtcttggtttacaaaatccaaccactcaaatatgtagttgctggaagttttgtggccatggggatgctgacaaagattgcttgggatgcacacaaggcagcggcgaagcctgaggggtgctgccaggccgggctctccactggccacgaatttgtacatatggctttggaaacctcatccaacactaagtaatgaacatacatgaggatactatgtatttttcaacctgcaagcccaagatttcaaattctttggtttatcgcagagaacacatctctcaaattgtcttcaaggagcactgcaggagaaagtcctggcaacttggcgcagcgaatttgatcagcaccatacgtacgacctgtctcaggaacggtgccatgtgtgtgactaggactgcaaagcagcttgtgttcgtgggggaaatgacaggcacaggaaggaaaagctgagaacactgaaacggttcctaatcgtgcagtggggaaaggagggcgactgccgcgcagagtggcacgttggctggaagaggggattgatcagcagtgctggcaggaacagcataggcttgtcgtgtgatctaacagaagaggcagcaatctggaggcgccccagatcagagaagagacatcaagccccaggagaaatggatttcctttctccccacccatcagctgggtaggaagcccgaaggagcctttcatggaactatgggaagggctcctctgacgcagaggggatgaactggaagcaagatgctgactgtttccaaaggcttgacagtcagaagcaggcaggcttcagcctattgagatactttacccaagaggatttccgcttaggttctgtcttgaaagaaatattcgctcccaaatttcctcccatcaagagtgcttctccctacagaaggctaaggctcacaggttgtccccagggacacatttctttcaagtaggatgactggtatgtttagactgaaaagctgatttactggaagattgctatcaccccctggcctaccatgtcgttggtgtggccagtgtttatcagacagtggtgtttccagcttaggcctgaatggaagaagaaactgaaagaagaaataaaaagagagatgcgccgggcatggtggctcatgcctgtaatcccagtgctttgggaggccgaggtggcagaccacttgaggtcaggagttcaagaccagcctggccaacatggtgaaaccccgtccctactaaaaatacaaaaaattagctgggtgtggtggcgtgtgcctgtggtcccagctactccggaggctgaggcaggagaattgcttgaacccgggaggcggaggttgcagtgagccaagattgtaccactgcactccagcctgggcaacagagtgatactctctcaaacaagacaaaacaaacaaaaaagaggaggctcggcacggtggctcacgcctgtaatcccaccactttggtaggctgaggctggcatatcacttgaggttgggagttcgagaccagcctgaccaatatggagaaaccccatctctactaaaaatgcaaaatcagccaggtgtggtggcgcatgcctgtaatcccagctactcagaaggttgaggcaggagaatcgcttgaacccgggaggcagaggttgcggtgagccaagatcacgccattttactccagcctaggcaacaagagcaaaactccatctcaaaaaaaaaaaaaaaaaaatggagagagagatgtttctcagctttgggaaatgctgacttttccagcacacctttgctcagaaaagccctatgatataaagtgtcataggaaccttgtccttggaaccaagcctagcctaggctcagggacatcatgtgggagtgacataaaggaggctcctctgtcactgtgcttgggttacaagtaattctcgacatgggagcatgttgatttctaaccatcggtggcggagctgtgacttcccaagctggtggctgacctcaagaggactattatagacactgtgggaccacggcctgagaaaagaatggctacctccctctctatcccatgacctctaacggcccggtcaccaccatggccttttgttcctggagagggacaggaactttggaaagtggggtcgctctattgcttctgcaggtcatcttcccagacttgcctaagcctcagaatctcagtcttctgctctgttttgcacgtcttttttgaaaggtttttaaaaattacaatctactgtacagaagaaaataatacacagaaaataattttagaaaataatacaacagatatctaagtatccaccacccagattggacaacatattaacattttgccccatctatatcagatattatttattttcttttttacttatttttgagacagaatctcgctctgtcgcccaggctggagcgcagtggtgtgatctcagctcactgcaacctctgcctcccaggttcaagcgattctcctgcctcagcctcccgagtagctgggactagtggtgtgcaccaccatgcccagctaacttttgtatttttagtagagacagggtttcaccatgttggccaggatggtctcgatctcttgatctcgtgatccgcccgcctcagccttctacagtgctgggattacaggcatgagccacctcgcccagcctatttttattttttttaagacatggtcttgctctgtcacccaggctggagtgcagtggcacgatcttggttcactgtggccttgaccttccaggtgcaagcaatcctcccatctcagcctcctgtgtagctgggactacaggagcatactgccacacttggctgattaaaacattttttctttctgcagagacagggtcttaccatgttgcctaggctggtcttgaactcctgggctcaagtgattcccctgcctccggctcccaaagtaatgggattacaggcatgagccagcatgcccagcctatatcagatttttttaaaattgcagatagaattaaaaacttgcttatctatttttagtagagggaaaaacctaaataagtttaattctagtaagttgctgactctacacaacaacttcctttcagtcttcagataatggaaactttgtggatttatgcacagcacccaaaccccagagatctgccccaacagaaagattgccaacaaaatgtttgtcttaatacttgaacaaatttttctcaaacttacattgtatatttttctccaccagtttgctaaatgtccacaaggttaatacccgcccagccaaatgaaaagaccactgggatcaggtgcggtggctcacacctgttatctgttccagctacttggggaggctgaggtgggaggatcgctgtagcctgggaaatcgaggccgcagtgagctatgatcaagccactgcactccagcctggccaacagcgcaagagcctgctctaaaaaatcaaaataaaaaaaaaaagagcattgggtctccaaaggtaacaggtgtgaaatacaccttagcctactcagaattttgccccatgaaataagtaaggattattaaatatttctggaaactcaaacaactctttaaacaatgttcacaatttttcaatgtccacatcagccaaacccacggaaagctaagcattaattcacctactgttggagaggctagactatttaaggaatctctcctgaattctagtcctgaatttccaatgcaactcgtgtccactagaatgttctgtgaatgtttcaagcttgaaacgcctgcagccaaacttgttttctttccatccaattatatcctctttccaatgttccccttttttcattaaaggcaccactattcttccagccatcctgattcacagcctcagagctggcctca

SEQ ID NO: 1827 - DNA, 612 bp, Homo sapiens
cggagagcttaaaagtcgcggggggagcggacttccgctgttttagggagggagagcggcctgggtcctgggtgttgtgtgcggagctgtggcgtcgcgtgtgaggcgcgtgcagggtgagtgtgagtggacgcgtgagtgtgtgagtgtgcgcgcttggagcgtgttaggcgagtgcgtgcgcccacccctgcgcccctcctcccgcttacactttgatcttatttgatcggatcgtgaccccagccccgccgggccgacccgaaatgaaaagctctcctcctgcgaagccccctcggggcgctgtgcagcgaggccccttaggcggcggccacgctgtggtccccgaggtcccggagctggccctgcggggcccggcgctcagaagtgatgaattgatcagatagacgaggccgggcttgtccccggccactgattatcgaggcgattctgatctgggcacggccaccgggctgcgggctgccggtggcgtaggggcgagcacgtgaacggcggcggcgggcggggatgctgagcgcggtggccaagggtaaatgagccgctgcccctccccctggagctggaaggtcgcggaggcctttttggccgctg

SEQ ID NO: 1828 - DNA, 885 bp, Homo sapiens
gtttgatctcagactgctgtgctagcaatcagcgagactccgtgggcgtaggaccctccgagccaggtgcgggatataatctcgtggtgcgacgctttttaagcccttcagaaaagcgcagtgttcgggtgggagtgacccgattttccaggtgccgcccgtcacccctttctttgactcagaaagggaactccctgaccccttgcgcttcccaagtgaggcaatgcctcgccctgcttcggctcgcgcacggtgcgcgcacccgctgacctgcacccactgtctggcactccttagtgagatgaacccggtacctcagatggaaatgcagaaatcacccgtcttctgcgtcgctcacgctgggagctgtagaccggagctgttcctattcggccatcttggctcctcctgtaacaatttcttgagatgaagatcctgaataccaaagagggccgctgacaggtctaggagtacacttctagcacctagcagagagaggcttcactacatcatgcttcctgacatctctccctttgaagagcagtcagactcctgctttgctcttcagacttaatttgggggtttaacaggtgaggttgctgggggaactcttttacaacatctctctgaaagaatccgggctgccagtttcatttggtttgggtgtcagtagcatgatggaaagacaaaaaaacacaacttgacatctgcagaaatgggttcaaattttacctgcaactcaccaattctgtggccttggttcagcaattaaactccctaaaattcagttttttctttgtaaaatggggttatgaacagtacctacttcaaaatgtgtttgtgaagattaaaaaagttaacataaagagtttagaagagtgtctg

SEQ ID NO: 1829 - DNA, 885 bp, Homo sapiens; identical to SEQ ID NO: 1828

SEQ ID NO: 1830 - DNA, 885 bp, Homo sapiens; identical to SEQ ID NO: 1828

SEQ ID NO: 1831 - DNA, 525 bp, Homo sapiens
gtttgatctcagactgctgtgctagcaatcagcgagactccgtgggcgtaggaccctccgagccagatgaagatcctgaataccaaagagggccgctgacaggtctaggagtacacttctagcacctagcagagagaggcttcactacatcatgcttcctgacatctctccctttgaagagcagtcagactcctgctttgctcttcagacttaatttgggggtttaacaggtgaggttgctgggggaactcttttacaacatctctctgaaagaatccgggctgccagtttcatttggtttgggtgtcagtagcatgatggaaagacaaaaaaacacaacttgacatctgcagaaatgggttcaaattttacctgcaactcaccaattctgtggccttggttcagcaattaaactccctaaaattcagttttttctttgtaaaatggggttatgaacagtacctacttcaaaatgtgtttgtgaagattaaaaaagttaacataaagagtttagaagagtgtctg

SEQ ID NO: 1832 - DNA, 525 bp, Homo sapiens; identical to SEQ ID NO: 1831

SEQ ID NO: 1833 - DNA, 2239 bp, Homo sapiens
gtttgatctcagactgctgtgctagcaatcagcgagactccgtgggcgtaggaccctccgagccagatgaagatcctgaataccaaagagggccgctgacaggtctaggagtacacttctagcacctagcagagagaggcttcactacatcatgcttcctgacatctctccctttgaagagcagtcagactcctgctttgctcttcagacttaatttgggggtttaacagccatgtgaagtgctcactccccctttgccttctgccatgattgtgtgtttcctgaggcctccccagaagctgagaagatgcttcctgtacagcctgcagaactggatagcccagagctattccatgtattccatggatgggcacatttggaagtttggttctaaaatctaaaagaagaaatttaagtgtgctgaagataactgcaactccaaacctaacgctgtgtaattctatgttctgccattttgaagcaaagtggaaccagaagtgagaggactatttctaggtcatgctacggttaccctgaccccagtcactccctatgctggtccatccaaactcagagccacgatcaaggcccttctacaacacagatgtgattacttcactctcttttgtggggtaaatataagccaagagccaagcaggtgcactgtggaggaagggagaatgcaagaagaaaaaaagaaagcccgccaggcgcggtggctcacgcctgcaatcccagcactttgggaggccaaggtgggcggatcatgaggtcaagagatcaagaccatcctggccaacatggtgaaaccccatctctactaaaaatacaaaaattagctgggtgtgatgccggtagtccttgtagcacctgtagctactcgggaggctgaggcaggagaatcacttgaacccgggggcagaggttgcagtgagccgagatcgctccactgcactctagcctggtgacagaggaagactccgtctcaaaaaaaaaagaaaaagaaagcctaggagacatgtacaaacttgtaggcatttgagaagttatgttcatttgattaaaatcagaaagacacaactcggaaaatgtaaaatacagatgaaaaaatgaaagcaatcatcttcttaaacttataaagatcttaaactcatttctctggctttaaaagaagagcatcagtatggagaagctaaggggatggcatatctgagcccttgttgggaaaactcttaatcgcctgcaggtttaggaccaagcagggcatataagccacttcatggtttggccccttccttcttctctgttgcctaacaattttaacttcaccaatattaaactaattgcagttttccaaacctatcctactattttaccctttgatgattttctgcctgcctttttctttgttgagaatttccttactttctatctatctttgcctgacaaactgattgattctccaaagtgcaactcaagtattacctcatttctgaggatcattccttcatcccttcaagttccttcttctgtgtcatcattaactttctatgtgtggttttaatgtacttcaagtaatgtcttatacttattttctcatggctattgttccctttcagacttgataagtcctcaaggagagaatctatgtcttttaaaaaaatcttgatatttccttacagaggtcctggcacaaaatagatacccaatatatgtgcaactgaatagaaatttatgagggagtgataattatccgtgtcttcctttcagctatgactgtgtcccatgataaaagttttttggatgatgatcatttgtcttgtcatttttgagttcaacagcgagtgccagggggaagatcaaggaaaaattgtctgcatcttgattccagattttaaaagctctgtaaccctcactccaagggttatgcttgcagaagagaaaacattactactgggactaaaaaacaaaatcctttcacaaatgtaactgagtttgtttgcatgctctggaatataaatgtttgaaaatctgcaatggcaatgaaataaggtatcaaattctacaggcaaaaagccatagaaccaatattccaaaaatggctcattaatttcttttttttacccaccaactgcacagcttgagaatgtattttaaaaatctgatcttgttttaaactattaaaatattttccagtgtctaaatagcagccagttcttatattattcatgattgcagc

SEQ ID NO: 1834 - DNA, 2239 bp, Homo sapiens; identical to SEQ ID NO: 1833

SEQ ID NO: 1835 - DNA, 2239 bp, Homo sapiens; identical to SEQ ID NO: 1833

SEQ ID NO: 1836 - DNA, 1952 bp, Homo sapiens
ggcagctccggatgtgggccctgcaagtccaccgctggcccagcaggatcagtgccgggagcagctgccgcccggggcccgtcaccgtgtttattcaactccccctttgcgtagccctgtgaggccggaggccgtgagccctttcttggcttccgtggcatgaaaacgctggatttgcccaacacggaaacacactgccttcccatcttcccatctgattcctagcttctctgggaacccacccaggctccctaagcccccactaagcctcttttgctgacctccaccctgagacccccgctcagaccagcagaaggcccagtgccacactcggcctgcagggctgacacagccgctgcaaacctccctccagacccagttactggtcctgcaacttgcaacctccacgctctaagctcctggtcccccaagctctccagccctgcaaccacatctgttccgtgtgctgggcgggcaggggctgggcatccctcagcctctgggcaccagcttcacacacccactctccaggagcagccaggaccacccctgaaccttgcccaagcagcccgcccaggtgggtgggtgcaggcagctgcagggcaggcagcagaaagcctcagcctttgtcaggcccaaaacatgccgagaggagtaacaggctcagagaaggctcaggtcagtgcccactctcttctgtgtggctctgaggcacggggtcggccccagccaccttccaagttcccagtccggctgacagcctcaggccctgtccagcccatgccccgagccacccaacacccactgcggtctcagcagacccgtcctcgcatgtgaaatcccagtactggacgcacccctgctgtgaccaccagagcccagggtgcacctgctctcggaaaacccaaccccgtcaggcacagacaggagccaggagagggtgagggtggaggtgggggcgatctttattgtggcggtgggtgggaggggggttcccacgtgagccctggtgctatagagagccggccgtcctccaggggtgagctggggaggcttctgcggttctggagtcccggcgatggcgccagttccccagcaaaccccctccagagctgcccccggatgcacagacaaggagggggcttgggagtgacttgaggctgtgacggggtcgccctcggtgtgggcaagtgagtcctctgtggccaagaggtcagagtcgtccctgaggctgagtcgaacacagacccgtggccctcataaaattaaacataaaagcacaaaaatggcgcaaccagacagcattggcttcagacaggcaggacacggggcccctcgtgtgacctgtgactttccacaaagggcaaggacctggcactgactccggccagtggagaaggctgtgccgcccacccggccatgactcagacccagaggctgaaagccacagacggggccgcagggcagcagctcccgggctctcgtgaaacacttcagaaggaaaaaaacctaaggaacagaatcctgaatggagaaaacccaacttttttaaaaaagaaggaagtgtatgatgggaatctacggggtgggttttctttaagagacgtggagcagggagcgtcctcgggccacctgtggacagggaggggcgctcagactggacccacctcccagcgacccacaggcgggacccaggagcccacacctggctagcagatcccgcccaccacacctggctcaggagttcccgcccacccacccaccacacctggctcaggaggagctcccgcccaccgcacctgcctcaggaagagttcctctggcggacgttcttgcctttgtcattctggtgctgcccgctgctcttcctggggcacgaggggccgggtgagagggtgtcccccgcaagtcactctctccaagtcacccctgcccaccccggcccccaggac

SEQ ID NO: 1837 - DNA, 1952 bp, Homo sapiens; identical to SEQ ID NO: 1836

SEQ ID NO: 1838 - DNA, 1952 bp, Homo sapiens; identical to SEQ ID NO: 1836

SEQ ID NO: 1839 - DNA, 1746 bp, Homo sapiens
cagggacatgcactcgggatggcctgtgccagaagatggggcagggggtggctggtcaggaactctagacacggctcctgggactggagagggcggcctcaggaacagcatgagtgggtgcagtccccactcagagcctgcatgtcccagcagcccagagaccatttaagatctctcctgtgccggtgcgaagggtaatcttctggaaccagagaggggctggcaggtggtcagctgcccttagagctagaggtgagaaattcccatggtggaaaaagggccagaaacatccaccaggcaagctgcccagacacaggattgggggaatgtcccctccctgggtaaaagcaagtcttttctggtctttaatgcacgacgtaatacttttacagtggtgggtgaggtgaggacagtaggagtttggaagagggaggtaatattagtgcatgtttgttaaaaatccctcccaggtgaatgacttttttcttcatctccaaaatacaagagaattatttttaggtctccaacttaaaaataatatctggagttagcaggtaggtggatcagggccagccctggtcccttagccccccacccctgtcttagcctagggactgttgcccagggacccgtgggcacagaagcaccccccaccccacgccctcgggacaactgccatttccacattatccccatctttagcctgagcgtggattaagacagaggagatcacagacacacaaggttaaagatgtttcttccatttcagatttccattgtaaacagaagtcctgttaatccctgcatgcctttaataaaaaaaaggaattagttgataaaaattggtgagtcacattcatacattagatttttttctttaactttcaggatgttggtatattcgtaagaaaaatagcctctcaggatctagccaaaaaggctgaaagtcaatcagtttagtaattcaccaaaaacaggagctaaagaaaggaaaaggcaactggaggctaggattttttgttgctgttgttttttttttaaataaacatcatcatctatgtgtaatcaaattcccatattttcttcctataaagaatttgctttagtttttcaataaggcatttttttgtcatccaaacatctcttccttttaaaattttcttagagttaaaaccataaataagaggatttaaaccactaaaatgacacgtgccaacatcttcattcagccagacctggtaaattctatcaaaactagacagttaaataagaaccacgttataaaaatattagccaaaaaaagactattagataattctgcaaactcaaatatgaaactgtactaaacaaaatatgtgcaaaggtacacaagcatagagccacgttgggggttatgctcagattagttttaaagctcgctctagtggatttaattcaagagttgtccacggtggtggtgtttactttgaactcacacgagtcaaagaaaaataaaatatgcacaaccacttccccaaaaggtgtcttatggagccggtgcttcatcgtgtccacacccaggactgcctggggtgtccctagggctggggggtggtgagagcaggccaggctgaggggcctgccttggaaggcgagggtctgagggttggggctgtaaagacagccctttcatcaggaagctggagctgaaaagccctaatacccctaatccccaaactcttggatcccgtcccacagacgagagtc

SEQ ID NO: 1840 - DNA, 1746 bp, Homo sapiens; identical to SEQ ID NO: 1839

SEQ ID NO: 1841 - DNA, 1746 bp, Homo sapiens; identical to SEQ ID NO: 1839

SEQ ID NO: 1842 - DNA, 1746 bp, Homo sapiens; identical to SEQ ID NO: 1839

SEQ ID NO: 1843 - DNA, 1746 bp, Homo sapiens; identical to SEQ ID NO: 1839

SEQ ID NO: 1844 - DNA, 1746 bp, Homo sapiens; identical to SEQ ID NO: 1839

SEQ ID NO: 1845 - DNA, 1880 bp, Homo sapiens
cccggcggaagaagggggctctccaagcacacctggcagcctgcagcctttaggtttcttccctgttccctctgctgccgacttttctttcactttcacttagagcaagatggcagcccgcgtccctgtgtgaagccgtctgcagcagctgccagagccctgcttgctgtttcctttctcaccacccacctcacccggaaatcccctgtctcgaaaaggcactctgtcacgtgtacacaggaaagggccctgacaagaggatgggactgcagttgtggctgccagggccccggccagggtgaaaacaaggaacattccagagaagatcacaaggatgcgaataaaatcggagctgcacagggatctttgggctgagctttctgtctggcttccctcctggcccctcgtgtatgcattctctctagcggtggggattaaggagaaaactcacgtggccagtgggtagagagagtccgggcaggcagctgcctgaagtcagccagagtctgcatgtgcccagctgtcctggcctccagcatctctggaaaaacagagacagaatgagtagcagcaggggaccccatagggcacatctgaaggcctgagaggtgctggatgggatgggaaggcagaaacaggctgaccttatctaggggtaggagtggggagtactggttggggtatcaccgctaccccacgtgatggcacagagagttgcctggaacttaccactgacataaggttggagtgcagtggcacgatctcggctcagtgcaacctccgcctcctgagttcaagtgattctcctgcctcagcctccctagtagctgggattacaggacaaggagagggacaaattccttcttggcatccttatggccctgtgacctgctaatgaatgctgactctgagttgctactagaatttggtttccttgtggcttcccaggaattggtctcactctgctcactctgtctcccaagctggagtgcagtggtacagtcacggctcactgcagcctccacttcctggactcaagtgatcttctcacttcagccttctgagtagctgggactacagccccctctgcagctcttcatgggggtccactcaagtcagaagccacatttgggtgtgattcagagagctgtttatgcaaaaccagctttgtcaccatcaggcaaggcacctgaattcccaccgcagagagtgttgtggccgtgaggacttttctgtcaccagccatttccaggtagacccagtgtaatcacaagcatccttgtaagtggcaaagaggcagaggagacagcgccagagaggcagctgcatgagaaggatcaagatgttgctgactttgaagttggaagaagaaggccatgagcctcagtatgtgggcggcttctagaagctggaaggggcaaggagatggatttgacccttcagcctccaggggcagctgtacctgccatcactgattgtagcctggtgaggcctgttttagacttctgacctgtagagctgtaacataatacatttgggttgttttcaaccactaagtttgtggtaatttgttgtagcagctgtagaaaatgaatacatatgaatcctctggcatttgtttgagatttgctctatggcctagtatgtggttgtaaatgttccatctgtgcctgaaaaaatgtatatttctaattcagtagtctctgctttttttttttattttgtaccccatcaataaaatgattttcagcatgtatccccaaataaacaatattttatttattgattgattgataaacagacatgtttaatgatagcttgcttttcacagaggtgacttcggagacttctaatctataatccaggagtatataaccatg

SEQ ID NO: 1846 - DNA, 1880 bp, Homo sapiens; identical to SEQ ID NO: 1845

SEQ ID NO: 1847 - DNA, 1043 bp, Homo sapiens
gctcgaaggacagcaggagatgaggccagagtccagccgatcagccagaccaaatatagacacactggaacttgcttaaagtctcctgtgttgaaacctccactttatgttggaaagctacttcctaggtttgcttttcagaagcttgctggcctgcggaatgggctggaccagggctggttcttaaagaaccaggcagctagcagtctccaggctccaaactcctgatggcgaagaggaatgcagagctggagttagttttgatcactttgttgaataattcacactcattactaatcttagggcttttctttcaaaatctgcaccatggtgttttgcttttgtgttctctgtatatgcctatcctccacatcaatcccacatcgaagggtgctggcttcttactagctgtgtgacctctgagcttcattccttacaagtgtaaaaatagccaaatggggtaataggtagtaatttctcaaactcctgactttgtaatccgcccgcctcagcctcccaaaatgctaggatttacaggcatgagccaccgcgcccggctaatagttattattttgttttactggtttctcaattattgtcccagtcaggcaagggttactttttttttttgagagacagggtctcactacattgccagactggagtacagcggcagtttaccatcactgcacttacaaacctccaactcctggtgctcaagccatcttcctgactcagcctctcaaatacctcaaaggactaccggagctccccatgcatcgcgcttttttctactttttcgtaagctattggtttcaccagaggtgtggtgtttttttttttcatcacttaagctttaggcccctgccaagcccttgtacctgattttataatttcctacctgtgtaattagagaaagctataaatgtgtaggcttcaaacccacaaaacctgtgtttgcctctgctcctaataaggctgtcctcaagaactctcaggaagtaagaaggcaaataattctgtgtctggaattggttccttct

SEQ ID NO: 1848 - DNA, 1043 bp, Homo sapiens; identical to SEQ ID NO: 1847

SEQ ID NO: 1849 - DNA, 1043 bp, Homo sapiens; identical to SEQ ID NO: 1847

SEQ ID NO: 1850 - DNA, 1043 bp, Homo sapiens; identical to SEQ ID NO: 1847

SEQ ID NO: 1851 - DNA, 583 bp, Homo sapiens
cacaactttagtcctatctttcccaatcccaggcatgttaacaatccttgaaaaatcatgctacattactttggaggaaaatacttccagatgaacatgtttcaagacatactagaaaattattcctatcaaaacatcctttttctgtgtcagctacctcatttctaatgcagtgcacatcaatctaatgtcagtatgaatacacatcaaccaggtgctggctttctaaagtgattcctttgcagatatgaggagcaggtatgactgcttcacagacacctcccaaagacatgccatgggcagtgggttggtgcatgggaaactggatccgatctgtctcataccaagctaaggaaacaaggataacaaggagttttcctgtaccttgattttttcaatatgtgggtttagagttggatgaaagccagcttttaagtgaacctggtaagatttgtaatgacaatatttaaaatgaaagaaggaaagaataagcttgcctgaaacagaatacactatcatgggcaggagagttatagcactaaggtgtgactctttcacccagaaaatgcattcctacttttct

SEQ ID NO: 1852 - DNA, 583 bp, Homo sapiens; identical to SEQ ID NO: 1851

SEQ ID NO: 1853 - DNA, 583 bp, Homo sapiens; identical to SEQ ID NO: 1851

SEQ ID NO: 1854 - DNA, 5218 bp, Homo sapiens
tcccagctgctggggaggctaaggcaggagaatcacttgaacccaggagttcgaggctgcagtgcactatattcatgcctgtgaataaccactgtgctccagcctgggcaacacagcgaaaccccgtctctaaaaaacaaaacatcaagcaccttgcctgatgttcatcacgcccaagccagccttcctctctggcccactttggcaaaagctcctgtgctcctctctcaggagaggatcaaatacccctctcccattcaccccaacagacactgaaatgttctcctggagcctatgaacgtgcccttccatgagccaaggaccacactgtgtgttgggtccatcaagaaaggaagtcactggtaagcatccttctcccaggagtgggccagaggccttgccaagcctcaccaccactgagacccagagtggtcgagaagaggcctcaccatgtcctgaagtgaagagaactccatctctgactggtttgaggcaacggaccggacctccgaatcctccagctttgctcctgctacagaaaggccaagataaatggagagcagggcccacccaactccacagtacaaaaatgaaaaccagcttggccacaggtggaaagccacatcccaagcctgcaagctcccctctcaccactcaacataccaaactcctcctctccatcatccctcagaagcaacagttctgggtccagggccatctcacacaggtcctcagaagcctcgccccggggtttttcttcttcctctcccccagaagagagtggtttgggcaaaagcccatcctccttctacagaggcagacaaaggttataaggaaaaggcaggcagttaccataattaccaatagtaagcatggctgacacctgagtatcaactatgccccaggcactgtatggagggctctacagataccgtctcatttcatgtatttaatttcattaagtgggattcagagcatgccagggcatcgccagacacctgggcttttttcctcaggagttgatcttggtcccagaagaaattacattcatttgattgatagtatttaaacaagcagcagctggccatggtggctcacacctgtaatcccagcactcctgaggtcaggagttcaagaccagccaggccaacatggtgaaaccccatctctacaaaaattagctgggcatggtggtaggtgcctgtaatcccacctactggagagaggctgaggcaggagaatcgtttgaacctgggaggcagaggttgcagtgagccgaggttgcgccactgcacttcagcctgggtgacagagcaagactccatctccccaaaaaaaaaaaaaaaaaaaaaaaaaaaaaagcagactagtattttagaaaaggtttacaaatctttttttttcttttttgagacagagagtcttactctctcgcccaggctggactgcagtggcgcgacctcggctcactgcaacctccgcctcccgggttcaagcgattctcctgcctcagcctcccgagtagctgagaaaacaggcatgcaccaccacacccggctaatttttgtatttttagtagagacggcgtttcactatattggccaggctggtctcaaactcctgacctcatgatctgcccacctcggtctcccaaagtgctgggattacaggggtgagctacagcgcccggcctacaaaattttctagttaaccatcaggcaatcaaagcaccccactctgccaagcgttctcagtgacaagggtttctgtgctgtcaggctgctcagccatgctccctgcactctgcgccaccttcccttgcactaggtgtgctacttactagctgtgcggcctcagtccatgccgagcaagggtgcagggaatgagctaaggcacaggaagcgctcggaacagagcccggggtaaaggtgcgcggtcacggtaagcactatgacagcccgaggtggcagggtactcaccagcggggcctctgactctgtagccgggccctcattctgtgcctcatccttgggctccttgaccacctcctctttgatggcttcttcctccttggtggcttcttccttggccgcctcctccttctcaggttcaggtggggacacgaccttttcaggaaggctcagtagcatcttataaactctatagccaaaatccctctggagcatctccagaaacagctcggccagcaccatcacctgatggggaggtgggagggtccatgagcatcaggaagaaagactgcttcaggcccacaaatcccagcccacagcctccccaagactcttgacacctgcctcaaaagagatcctttcctttggcctccgatcctccacaatcccatggagggacaggtttacacagccagggcgtgcgatgacagcaggttctagggggggtggaggggcctctgggagatcagtgtccgtttcctgctgtgtggtggcctctggagtttctgcgttccgtctagaagtgtctgctgcttgctccaaggcatcaggtgcctgttcagtaggctccgtttcctgtgacaacagctgaaatgagaccctctgggtcccgggattaggccacctatatcccccgctgctggctaaggcacagccttaccccttgtgcctcctgggttgggggagctgcctctgcagctttctgctggcacagggcctcccactcctccaaagtaggcatgatggtccagacatccggcaggtacaccaccactgtctgaagccgccgggggggtcccggctgcaggtactgaaactcggcaaagcgccacctgcacatggcaaaaggaggtactaacttctttagtgacaactccacgcagacaccacgttcacaggcaagggcttcagtttccagtcagcactcaatgagcacacactgcgaaccaagctttgaagacacaacaggaaagctacagaccaagtcctcaagaaatgatcagtcagtggggaggccgcaaccacacaagcaccctacaaggtgcaaggacaactccagggagtctcaagtgcagcctggtggctcagccagattttggcatacaccccaccctaccctgaggcaccagagggggaaggaacgggactagggggcagagagctaaccagcagaaaggggcagggaccgggccttcccaacaaaacctccccaacctggtgcgttggtgcagctgaggctcaggaagcccactcaccacttggtacagccgctcaaatcaatgccagtctgggcctgcgcacagcggatggcggtacgcaccagcacctgcgggtcagcctgggggtcgaggccatccagggaaggagaccattcacccccaaccagcactgcctcctcttctttcctgcccagcaaaaactgcaagaagagatcagggatacaaaacaaaaaactacattacctgggtctcccactgcagggcaaggctgccacccatcaggatgaaggcagccggaagtggggaagtccaccacacagtgaggtctctatctgcaaacatgaaccagccacctcgctctctctgactagtcgtaacagctctgagctgcaccttcctcctgggtgaaatgaggggtgttcggctctgagatgcctcgttttatgcattcaggaacaggagccgaacactcaaaacatgacaggttgtgcacattacccgtgaatgcatctcctcctgctctccagctcttaccttaatctgcttcagaggatgctctggcgtctcccttggctcagccatgtcatccacaaagagcatgcaacaacgatacaattcctccaaccccggggaagagagcagcagtacctgtgcaggaggagacactcagagctgccttcagcctccagaaatcagataagtgagagacgcctgtcagcttaccttcgaactataagcggggtcactgtctgcagtgatgggctcagcaccagcgtctggagctgcctccttttcagaagagacctggatccggcttggatgatggagggaaaagggctggctcagggggaaggctgatagccaactcagatgcacggacagaaaatctgaggggaccaggaggctgcggtaacggcgctggagttctaggaagtcacagatggggctacaggaagacagcaagggaatccagactgagcaaagactaaaacattcgaaatgaaaccatcaaagatttgaaaaaatgggcgaattttttttcagtctgagaacttttgaagtaaggcacctctcaaggaagctagatcagatctgaccacttaatttacaaactctagatggcaaaagtcaaactgggaaagggaaaaaagaaaacacttataacacatgacagagaaatgggtcattgccttaatataaaggaactcacaaatcagtaacaaaaagttcaaaagcctaaaacggaaaattgacatcaataggttcttaagagaaatacataagaattagaggccaggaaaatatgctcaatctcacttacaattaaagaaatgcaaaccacattatcatgtgtcaccaactagacagacaaagatgaaaaagtcggctaacagtgttggcaacggcacggggaaataaggtctccacaccccactggttagagcagaaggggcacagcctcttcaggagaactggcaatagctatggaagcttaaagcaaagcctttgagccagctgctccatttctagaaattgatcgcaacaaacacacaggtgtaggtagaaggatgttcattccaagaaaatttaggatagagtgcaaatggagaactgggtaaataaatcatgttcatccattcaatgaatactgtgtagttgctaaaaaaaaaaaaaaaaaaaaagaactagatctaataaatgttcatacgaaataaaatctaaagtacattcagtgaaaaggcaaaccaccaaacagtatgtacaacaggtttccatgtgcttttcgttttgtaagaaaaggctgtaagaacatacatgtgcacttgcatagacgccatctcatttacataagaaactattaccagcagcaagactcagcccacctcagcctcgccactcacctgtccacagtgtaaggagtgaggtggacccggtaaggaggcaggtcatgccttggcttcttagcaccccagggctctccaccagcccgctgtttgcgtttcttggagtcatagtcatcactagagg

SEQ ID NO: 1855 - DNA, 5218 bp, Homo sapiens; identical to SEQ ID NO: 1854

SEQ ID NO: 1856 - DNA, 5218 bp, Homo sapiens; identical to SEQ ID NO: 1854

SEQ ID NO: 1857 - DNA, 6093 bp, Homo sapiens
ccccaccctgttgccgctgatgttcccagggcctcattttgtaatccacaagtagctgccgccggtccccccaaagccaaatgggggctccagggtgggacagggtgggcgggggtgaggctgtgacacccagaggaattcctgtgagaggatggggaagggattcgctcttagttcctgggtgcacccctccccctctcccgtgcacagggaaatgatggcgggaacacagcaaaggagaccatgtcctggagagggtcccgggccccaccctccccgggggggcttgtgcaaggctggcggcccgatctctgctgattccagtattgggggtgcagagaaggcacaggacagtttttgttgaagccgttgcagcctccacttggggaagctgaggccaggggcacaggacaacgttgagggcctgaggcctccaccttcttgaagaaggaccatgtgaatttcctgacagagaacggggatgggtttctgaaagcaccacccagctgagcctgccgaaactgcacagctgtttccaggccaggctggctgcatggaggacgtgagaggaacagccagctgtgtgtgctgggcccactgatcagggtgctcaggaccaggagccttctgaggatgtgcagaggggactctggggagaggaacatggtggccacagctggagtgaccgcagtgtacagagatgggatgggagcaggaaacccaaaagagccggccctggaaccaggtggaggggaggcagcccggccatgacccagagcaggacacctgctccacttcaccttttgccatgagtaaaagctccctgaggcctcccaagaagttgatgccctgtgcttcctgtacagctgcggaaccggatggctttccgtggctttgctacagccactcctggaagtgctgcctgactgaatcctcagggcaccccggcaggatggacgtggtgtaccccctactttacagatggggaaactgaggcttgagagctaaagcagcccacccagctcccagagatgaggaggccgactctggcaggagtcactgtcggtgcatgggcatttcttcctgttacagcctgcggccccttccaggccgggaggccttctgcgcaggtgccctgacgtgatggtatgacccattctgggaggccgagagcacctcaaagaactcagcaggaagcacagtttcaattcagaagttctggaaggcgaggcaggacagggcaccctccctgcatggcccgatgacctgcactcctgtttcatctccccgtgtggcacctggggcagcttggagcctaccaaggtctcaacaaggaaccagtaaataccaaaaaaaggacatcacgtcccctacagctaactgcaaatggtgaccatcccagcccttgtttgataacacaagcaaagcaatggcttcttcaaggacaccgagaggaacctcacctctttctaaaacctccaacacagggccaggcgcggtggctcatgcgtgtaatcccagcactttgggaggccgaggcaggtggatcacgaggtcaggagatcgagaccatcctggctaacacggtgaaaccccgtctctactaaaaataaaaaaaattagccgggcgtggtggtgtgcgcctgtagtcccagctgctcggggaggctgaggtaggagaatagcgtgaacccagaaggtggaggtagcagtgagccgagatcactccactgcactccagcctgggcaacagagcaagactccatctcaaaaaacaaacaaacctccaacaccacctggaagggcctggaggcactcactgatgagcctggaatttctcacaggggacagagaggtggccaaggctcctgcacatttccccatctgtctgacacccctttccagaaccagaaagcgtgctgagctcggcctctgtcacgcagggttccaggtatttctggggctcagcagggagaaggccaggacgtgctccctgactctcggcagggcgggagaagaatgaatcctctgaggtccccagcttggggaaaagggggtgggagagtggcgggcagagacctcctccgtatccccctctcctgaagccctgccgctgtggcagccctacagggactacagggctccagccctacagggactctgcggtggggcgggtgtgcaggctcacaggctctggaaatgccccaggatgccttggcagtgtctcccacagacccaggagcgccactagaaacaggacccttcctcagtcatcctgcatgggggctcctgttgctttgggggctgctttccagcagctgcgtcagacaacgacccacctcatccccccagccaggacctgaacaggcactgacgtcagatacgtagaccttgttgctgaacttgtcaaaaacttcaatggtgatttcatacaggcggccggtctccagcacccacctatcaccagggtgaatggtgaaccctaaaacaggcagggggagcctgagcactcaggcctcaggggcagcagggtggaggaggatgggaccaccaccctcagcacaggggccctcagcatccacatgggaagccccactccacccacctgtaggccccacaccacccacctgcaggccccacaccacttacctggaggccccacaccacccacctaggggccccacaattatggcgctggcctcctccacagagagggacctgttgctgaggaacagatgcctgatgccgccttcagccctgagtcctgagctgacctcccgaggaccaaacctggactcatcccattctatctgaacaaggctccttcaaacttgttcctgttcctcagtgggtctacactcagaatcctagcagctctgtccttaacacacagcaggtctatgctctgaagtgataatagatctatagtgttcacagtagaactagtctgaaccttcagggggtctgtgctctgaggagggatggacatagactccaagaaagtgatgattctggaaaaggaacgcgttgttaaagtttgttgatcaaacccagacacaaggtctgtcagaatctaccacagcattccctatcagcccctcccactggggccaacactgaagaaataaggggtgtcccgttagtcagggctggggctacctagagacatgtccctgcagcttcctacatcagatctgcccatgtccttgtgaaaaatgcagatgcttggcccctggcccaggctgtgtctgcaagaagcctgggaaactccattttatccacctgcatacgtgatggaaacactgacatgcaagaccagccgctgagtccacacaggaacaatgaggcctgagagatgaggcaacaggcccaagaacacagcccagccgaggccggaccagcagcgccctcgcctccctgaggctgcctgctcctgtcccacctccctggcctaccacccagctctggggaacgattctccatgactggtcccttagccctggggaccggacggcaccacgtctcactctccccagatcccagcttggggagatgtcggggacgtggtgtagcatggagtgtgggctgctgggcaggctgacttcagggatccttcccacgcagcctcccacttcagcctgcatttacaaacgagcccactgttcccctgcacaagagcaatctgccgccatgcttccatctccccagcatctgccggtgccgggccacgccgtaatttatttcctcgcctggttactctaggtgtcacatgtcaaattgaccacaaatccaggacaatccagctccaacctgccttggtgtctgggatttctgttatcattcggctcaggtgcagagctgcctggaagcttggggggcctgacatggcaggggacggggctgtcagaaggggacagggaaccagcatcccctcaacatccaacatgcgccaggcccagagaggggccctgagcggatcaatctgccgagctgggcatgggatcccctccagctctgtttcccagggcaggaggctgaggctcaggtgggtaacgttccctggctaaggccacaggcaggaagtgacaaggccaggactggaatccaggtctctgactctccggctcgtggtcatagttttacaaaacaccagaaactgcagagctggtccagaaagctctgcctccaggagggcgactcagctctcaaaggcatcaggacgtgaggacgtctgcctggagtcaccgtgagctgagttctggagaaggttgtgatggaggaaccaccacgtccccatcatcccctacggcccagagctggactttaatggcgtaattgtgggcggatcacgaggttaggagatcgagaccatcctggccaacatggtgaaaccccatctctactaaaaatacaaaaattagctgaacgtggtgggtgcctgtaatctcagtactcaggagactgaggcaggagaattgcttgaacccgggaggcagaggttgcagtgagccgagattgcgccactgcactccagcctggtgacagagtgagactccatctcaaaaaaaaaaaaaaaaaaaaaaaaaccagaagatggtaaactccccaacaaaggacttataattacaaaggggtgagaaggtgacttccccagatcagaagcaagtggaagaatggagtctcacttcggtgatattcctgccaaagacgcagtgctcagagcctggccatgagggaacagcagataaacccaaaatgagagctgctctacagataaccagactgtcctcttcacaagtgtcacggtgtccaaagtcaaagcccaggaggctgtcccgggctgacagagactaagagaaacaggacacatgcggcaggtgactcagggctggggtttttctttttgctgaaagggataaaactgggacaaatggctgggcacggtggctcatgcctgtaatcccagcactttgggaggctgaggtgggcagatcatgaggtcaagagatcgagaccatcctggccaacatggtgaaaccccatgtgtactaaaaatacaaaaagtagttgggcgtggtggtgcacacctgtagtcctagctactcgggaggctgaggcaggaaatttacttgaaccctggaggcagaggttgaagtgagccgagactgcaccactgcactccagcctagtgacagagggagactgtctaaaaaaaaaaaaaagggctgggccagatgtggtggctcatgcctttaatcccagcactttgggaggcccaggcgggcagatcacgaggtcaggagattgagaccatcctgactaacacagtgaaaccccgtctttactaaaaatacaaaaaaaaattagctgtgtatggtggcgcgcgcctgtagtcccagctactcgggaggctgagggcagaagaatcgcttgaacccgggaggtggaggttgcagtgagccaagattgtgccactgcactccagcctgggcgacagagtaagactctgtctcaatttaaaaaaaaaaaaaaaccgagacaaatgagcaaactcgaatgaggtctgaagatggtcggcatcagtgttcgtttcctagcaccataactgcacggtggccatgcaggacaacgtcactaatggtcgtaaagcacttgaaaatcatcagggtgatgggacatgaggctggcaaccggctttcagctcccttccaaggcttcatagcctcaagtgtaaccctcgtgctccccagcagcctctcccattgggtcctacctggagtggagtcccctacctcccgtcttcatcctcactgctgcgtgcaccacatggtgtccaggggccacaaacatcagcaagaagggtattccagagagtgactcacccatccctcctactccattgaggtcacattagatgacacaagatcatgcttctctgtcctctgggctctcttaccctccctgggctctatggagttcgagaccatcaatgaggcgttgctgacaattgtaaaccatcaagtgagaaggtctcctttcctcctctcacttccccatttttgctgcaatgttacagctctcgctacagactta

SEQ ID NO: 1858 - DNA, 1568 bp, Homo sapiens
tttcagtcagcatgactggaactttgatcaacaaatccccaagagccacaacccgtcttttgtgaacaagtagtatcaaggtgggggtgggcttggagtgcactggatgcttttcttctttcatcatgaaacctggtggttttgtgtcatgtgatatgtttttcagagattcggcaggaagcttgcaccgagtgaaggatttataaagattataggagataacacaaagctattttatctctttaaaaaaaatcaaaggtgtaagctcatcctacacatgtcatttggaccagaccaaggctgctgtcatggaggacccacaccacagcttgggaaccattcatctaccagagggtcacatgacttcaaatgactcttctaggggccacctgccatgatagggtaccagctcttcctctgaattcccaatccatttcttgagaactactgtttctaataaggatttgctcaaaatggatttgcaaagagaaaaaaaatttaatgtcacactgccatgataagtcaaccaaccatctcatatatcaaaggagagaggcagagaaagaaaaggaggaggataaagaagaggaggaagaggacgaaaggaaaaccaagaggaggagaagccacttcttactttggattaatgtgaaactaaatagtttactacattttaagtgggaaaatgttagttgaaaagatatttgtcaaccacaaacatttgaaagggaagcattccaaagattttcactgtttatgttcaaattacaacatgtgcagaaagttgtgcaactgaaaatcctttcaaacaacagctacaaaagagattggtcagttaggacaggaatagaaagtggaaacttagaagactggctactccttgtgtatgattgctggggtgagtctgtgctgagaactttttacaaagggtgtcctttgctgatatgagaggggggtgtcaaacttttgagtgatcactgtgggtcctcagcttagacatcttctctggcccaagatggcaccccttgctctctttccatgggacacagggaccttgccatccttccatcttataagccttctgtcatgatttttacttcatcctagatagccttaatttgggccaggtctccaggttcctccactttcttctgtcccatccatacccctcaccaatcctctgtaaattcctttccaggattttactgagaactacagagaaacaggctgggaataacaaacatggggagttatgtagttaacatacactttgacatcacctagtcattttcctgagtatatagataactctgttattactggttataaggtccatgagaagcctttatccttttctggaaaccaagaaagcacctgccctccctcagtcctaaggggagaatctttatgggtgtaacaataaaatggataatgggaaattctgatgtcctcaagcatacattcagatgtccccaatgagcatcatttgtatatcaagggaactccagagagatgatccacaattcagtgtgtccctttggccagtagagaggtcaccttagtctgga

SEQ ID NO: 1859 - DNA, 1568 bp, Homo sapiens; identical to SEQ ID NO: 1858

SEQ ID NO: 1860 - DNA, 4300 bp, Homo sapiens
ttgggccgcgtcaagctcccctcggagttggcctccatggcggcctgggcctcggcctcgcgctcctccttcttcttgatgccgtactgcgggggaggcgggggtcagggcgggggtcccggcggctcccgggcgggccgcagcctccctgcgccagggactggcccaggaacccccgaaggcgtgggtgcggccccctaccccaccaggcacacaaggaccccagaaggagaagagaccccaccccggggggtccctggaggaatgggaagcccccacggagaatgggggccaggagctgacatgggggggagcagggagggggaggctcccatcttccttgagaggagagagggctgtggccccacctctggctccaaacccagcccagcccctggcatcctgccttccaggaagcctccggcccggggcagggaggggtgggcaggatgctgcgtggcagaggtggggagaaacagtcaacccgcagctgaccctcctgcccagtgcctggtccacgacctgcattcacactcccgggcctggccaaggctgcctggatgcggccgcggccccagcagggccactccctggcaggccgctgcagctccgtgggcagccggcagagggtcctgggctgcggtcacttccaggcactgggtgtcctggaatcccgcctagtcgtgccctcagccagtatgcctgggcctcaccgaccccctgcccacccgcgtttctcatctcccgtgagtgcgtctgccctccgtagtagctgaatattgtccccctcaaattcatattgcctggagcttcaaaggtgatctcattcggaaacaggtctttgttgatctcataatggtaaggatggggacgaggccatcctggatttgaggggcctcaagtccagtgagagtgtccttgtaagagacagaaaggacagacacccggatgggggcgggcatacgaaagcggaggaggtcgcgagtggtcaagaaacaccagggattcggggccgccagacgcaggaaggggcagggaagggccctcccccagagcctccagagggagtgtgggattttgttcttctgccctccaggcctctaagtttttgtcaggccccggggttttggtttctagatcaatacgcctccccacgccacactcctccagccctcccgtgagccaccagcccaggaagcctgtggtcatggtcaggccacggaactacggaacagcctcctgctgcccaggaaggacccccgggccaggtccaaggtcctggatctgagattacaggtgctctggagtagtgaaggcgtcagcagctgcgtccaggagaaaacttaggaggggagtgggcaccagcactctacaggacggaggagcacaccgcgggatcaccagccacagggaggggcctttctgcccaggaggagcccctcccctgccatctcctgctcctgtctcagcagcccctccccatagaagcagttggttctgctcctggtgctgggcaccccctggatctccaaggaggcccctccttcctcccaaatggagggggggctgcctgtgtgctccccaaccccaccgagggcagtctcggcacctctcccctcccctagggctgcaggtggctctgggtgtggggggccagggccaccttcagtgagatggaaaggagggcgccacgttcccagccgcctgtggccagaccaccacctggccactgaggagagaggggccgtgggctcgccctagtcctcagcagcccctgcgcactcttgacagagccgggactccaggggtctcctcagtgaaacgaagagcacagggtaggaacgttctccgcacaacaggggcgacacccagagggccctgcaggcccagaacaaagccctgaccctgtggggcagcaagagcagattggttctcgtcctagccatccacagcgggaagggcagcagctccaggcacggaagtggagggagcatgtgctcttcgtcctgtggggccaggggtgtgctggggagagcgatgccactggaagctaggtccggccagagagcctccctccagccaggggtgtgggggtctgtgcatgtggcggcaacatgtgtatccagcccaggaggctgtgctgcccacagcaaaagcactcaggaacatgtgtgtgctcagaggagcatgcctgtaacggcggaacatgagttgtgtgagcaaaggaacctcccaggtcaggggagtgacccttggggcttgtgggaccctgtctgcaaacggtgtgggatccttccttctgggcccaggaaggagaccccaggccctgccaccaggttgtgggacactcggagcttggcctgaagtgccagttgctgcagtgaggctccaggtcattctgaggctgaggtcacgccggacttggcctgagggccagggtcactctgccgggaaaacaggctccggggctgggctgcacaccagagcctggcttccacgtggtctggctgagacccagttctgaggcgtctgctccagagacaaacgcccaggcacacccagccccaggcccaccgtgatgctgggcagcagctctccaggaagtaacacctgaggatgggagtggctgctgggggcgcccaggaggccctgacacgtctgagacgccggagcggcgagaccggcgcagaacgggcggccccgagcactgctgcgaccccgccggcctcgacctcgacaccccgcgaccccgccggaccctggaagcatgagctgcatcccgcatccgcaggagggcggcgctgcgacccacccccgcccccgtttccagaggaggccgctgcggcgcggggcggtcccacgtggtgcctgaggctgggacaccccgactctgattgcaggggggtcggatccgaggctgggggtcccgcagtctggctggggtccgctactggcctcgacgtacaggggccgaccccacccctacctcgttctctgagcctcagcttccccccgtgagaggtggaggcggtgggggggcgcaccgggcacgaccccgcggcaatgacggggctggcaacgccccccacagcggcacaggcggataaaccctctggggagggagttcagtcccagcgggaggggcccttcccacccgggagctcgccccaaaccgggtggagagggggtggggggggggtgcagatcgcggcgcctccctgccctctggccctgctgagactccaccgcccaccccacctcccggtagcagaaggggcagaagcagagacgtttcctctgcagacatcggggagggtggggtcagggccgcgcgtttccagccctgaggctcttcccgggaacccacctcccagacctttgctggagtggcacccacgctcccgagacgcccaggcagtttctggggggatctgcttatacagagcagccgcccctgaggtcaaaaccctgcccagggttcccttacacgatttacggaagagtcacaaagattgtataagagggctccctagacgctgacattgcagccaccgagtgttcgtcaaagctgagacctggacatggtaccagcgaccaccccactgaagacttcatgtgggcctcaccacttttccagatccgcctcccgggttcacgcaattcccttgcctccgcctcctgagtacctgggactacaggcacgcgccaccacgcctggctaatttttgtattttcagtagagacgggtttcaccgtattggccagggtggtctcgaactcctgactgcctgatccgcctgcctcggcctcctaaagtgctgggattacaggcatgagccactgcacccagcccaatgttaatttttaagaatggaaaaatgctttttaacttgaaataaaactacggggaaaattatagaattgaatgaaaaattaaacaatatctaaataaagaaagacacttgttatttttctggccagggtaactccacacgtaaagacgtccatcctccccaaactccgaagaattaagaagaaaattctgtgaaatctgacaagctgagtgttgcatacagacctgcaaaaggcccatttgccaggacagacacctgaaggaaaaagaggagagtgaggtccaccagataccaagacagaatgatgatggtgcagtgggaggaagacagacaacgggcccagagtggggagcccatccccagacccccacagacacaggacccccacgtgggaccagagacagagggcaggactcaaatcttcccctgacttcctgttggtgagt

SEQ ID NO: 1861 - DNA, 4300 bp, Homo sapiens; identical to SEQ ID NO: 1860

SEQ ID NO: 1862 - DNA, 10130 bp, Homo sapiens
ggcagtggcgcttcgggagggcgcctccactgggctccctgggaaggaggaagggaggttatcagttgcacccaggtgacatccagactctggatccctcccccagagctgaagatctatgaaaactggtcccaggtcaaatcctgggaggagggatcctccaggtagatgtactgggtgtgaccctccagtgagtcttggcaaatcctggcaggaaaggggatcaagggaaggcctggatccagggctgagtcttgcccaactcctatccctaaatcagggtggggcccagctcagatgctggccaaacatttacaagtctcagcttctggggaaagattaagtgcaggtttcaggtgcctgccccagcccttttggggcattgggctgccagcacctgtccagtggagcaaaatggataaatgaggtctaaaggaaggacctgcactgcagccaggggtgagatgggagcatctgaaggagcccgcttccatcctggtccaatcccacttcaagcgatgggctccatgcctgagttctatgcccttgtccctggtgtcacctcagacatacagcccaaacaccctctcccccatctgtctcgtgtgccagggtggacacgagtgggtaaagctggattgtatcttcaagatgatgtcaccttcctcttgtctccacccggggctccgcccaggtccctcccctcctggcctgagctgacaggcagaggtggagagggtcagtccccatcgacagaagcaaagagatcgtcctggggcagtttgcacgctgatggcccaaggtccgcgacccaggttcgcttgagtctctatcagagggcaagctcaaactgttccttccattttgggaccagggaacagagctcacttaatgctgctctcccactgatgatgcccacccattctcggcctgcaagccctaccactcacagcttcaaaaatggctccgcccttcctgattccaccccacacagaagaaagcaacttcttgtgatgcttccttattctggatgtggctcacctcttaccccttccaactcctttgggtcccctagaaagcctccctggctaaggggtacaggccctctcctcagcagtgggcactgaccgtctaaccagggctctgtctcggcacctggtagcaaggacggcaagatacaacaacatgctgattttaatagcctctggctttctccactgcgtttctcacctgaatgccctgcacaccaaatcttccatggggtcacccttgacctctagggcaattcccaagaatctagcagaggagtgggggaaaccaaaaggctgacatgaaggactcaagggaagcctctggaaagaagagaccagacactaaaagggatgtgtgtgaaatactggtttttattggttggcacaagattacaacctacaatttcaatgcccttccctcccacacagctcaaatggaaggaaactgattaacacatagaaaggaacggcaggctcacaggtttaagcatttgtttttacaaaaaggagtgggatatgggggtggtcaagttttacgggtaataacaacattctctctagatggcagggggtaagtctgcctgtcctccattgctggtaccacataagggatacattagtaaagtagggaaagggttatatgtgtggctggcctgttctttagagaggaaggtgggatggtatctgctgtgtacctgtctcagaccaaacctggggctggaccagtgcccctttcttctcagccctcctccacagcctgactgtactgccagccgcacccatgagaaggaggtgtgaaggaagcctgaggacatccacctcgagaaaaggaaacaggaaaactatttccttccgccttctctggaccaaatttcactcccctcagctccagagagtgctgcaaaaatcttccttagggacgctgtgaagacacggggaagaggccagccctgagcgggcaagaagaaaagcttgaactttccatgcagtaccaagcaaggctattttggaaacaagcaaacaaacaaaaaatggaaaccaacaccatataaccacaggttgggtagctcctaaatcctggacagcatttggattgggggtaagggcaattttactccagctccttgttttataacccgcacaaggtgccaagaggtttaaggaccacaactgacctctctttccctacaagcaccattccttggattcccagttttgttgagctcatttgaggtcatccttgccatcctcttaaaaaatgacacagcctcttggttattccattttctatccctttctacaattatgaacacactctctaaacaggagatctatatatgctctcatcctgcaacccaagagattaggtgacctaatgatgagaaggctaacttatttgctttcctgggtggtcctgatggaaatgaacagcagcagagttctggtgggatagagcagtctagtctgagccactgtgtgattccccaggggactggtccctgggtacatgggtccctggctctctgtctcagttccacagatattactcaacttggccatttacgcctcagctaaaacatatgagcatgagggaaaagggacaagaaatacttttgtcctctagaaaaacttaactcaatacatcttggctactttgcctcaacccacggggttccctggaaacatttgttgaacttggccaagaggagattgtatatggatggcacacctggaaaaggggagaaagcacactagttcatctcttttataagtagaatggtcccagggatgttaacctttctgatgctgatagtagatgagtggagtggaggtaatcgtgagaaaacttaaaaacccttaagctgtttggagactacacaccacagtggagcaaaccaaggtggggcctcactgcctcctcagagcccatccctgaccatgtcattggataggatggaagacaaagtctttgaaatggaggctgggctggcaaaagtaagtatgaagatgctactactggccttccacttcctctctctgatacacctaagaaggtgagagacactagcttcaattccattttacaacagttctcaacaacctgaaatattcttgacttccttaagcacatggaaaactggtaagctatatctttctaactgaaattttacttattctaaccaccaaccttttctttgattatcaaccagtttgacagtcttcagatcacaaaacaatagaacagacctgacatttacaaaactgtactacatacttatttcttttacagtagagctgaccaattacttttctaactactaatgcaacaccatgccactgggccctggactctgatgtttctgatccctgagcaacacatctatgtccattcacagatggaaatgaaagagtgagattctcagaggctaaacaacattctgggagcaaattggatttttgaagggagagtcctcttagaaaattctgagcaaacatgctcccagtcacgagggatggggtgagcgggcaggtttctgtctgtgagctatagctcccttctgaactccctcatgttcttgggaggacacaagcctcttgctcattaagcaaaggccctccaagtctcctttttacttcagcactttggaaactctccaagacttaacttccgatctggggaggttctacgtggagcagacctatcccttcttattcctgttcctgggtgtctccataatcagcctctaccttccctggcataagtcatatctgttatgctgcaggaactgagtaaccaaagctagatatcccttggaccactgattagtgacacattttctccacaacaaagggaggttaaagacaaaggtttaacctgagaaactttttttttggcaagataataaagaggttaaagaggctacgtggatctgtcactgctttagcttaccattttcaattcagcaccaaagtgctcagaaagacaggctcagatcaggacgacttcttaaagggattcacaggcaatattactggcaaaatgattttccaaagctgagccacgcgccccaccctacagggaggggagtagaatcttatggcccagcattggcattgaggcatcttgctttttttcctcagaattccacaaaggcttaagagtgatctaaatgcctggctggaagctcaagtctaggagagctattttactgcactgttgagatgttctctgcaaggtagtcacagataataagcaatttagtagataattattctatacaagaattaatgttctctgaaacagtgattaatagaatcttcacatctggcctggctgggaggcttgggggcaggaaagggagggtggaaggatgggtagcacatcaaaatggtgatgaacctggcaaaacgacaatgctgctgtttttgtatcctttaaagcctatatccagggttttaaatgacgctttttttgtgtgcttcctgataggaagtcaaataagttttagtattaagaactggggatataaaccaaaggaaacctagagtcaactgactgctggaggaacagaagcaatgacttctttccaccttctagatagtaatcttacttttgttggctaaaagcactttcttcagcattctgagttaacacgggttccctataagctcccctccccaggtggacagtcttattttctaagacaagctcaaagctcaaactcaccaaattaccactataaacaaagcttcagggaagagacataaccttacttcaaaagcttcaggtcagagacagccaaaatcatgtgactgctagcctcagctcaagtagtgtgcccaaatcatcacaaaatgggattcccttcccttttcttttttttttttttttttttgagacggagtcttgctctgtcgcctaggctgcagtgcagtggcgggatctcggctcactgcaacatccacctcctgggttcaagcgattctcctgcctcagcctcccgagtagctgggactacaggagcgtgccactacacctggctaatttttgtatttttagtagagatggggtttcaccatattggtcaggctggtcttgaactcctgaccttgtgatccacccgcctcggcctcccaaagtgctgggattacaggcgtgagccaccatgaccagccctccatttattaatttataaggggactagaaggacaaactatttgattaatttgaaggtgagaggtatcattttctcagatgctccaactaggcttctcacatccctcaaaggttatcagctaaagacaagagtttctgaggctaatgcaaaaacatggtcaaatgtgaaaccgcccttttagaggcagggtttgtgaaaggctgctggcctccaaaggagagtatgcctaaactctctgggctcccaggacctgtggtgacctcaagctaacctgatgcacagacaacagtatcttttagggactgcagccaatgttccccaatttactttttttttataccttaaaatatcaaatgtttcatttttaggtgatatcccaagtgacacagaaacacagctcctccggatggtgaagtctccgctgcaaaactcacgaaacagcacagaggatgactctagggtgctctcccacttgctccaagttaggcaggtgccctgatggaggcaaggctgagccattaacatgcacagctccatatcctggaagcctctgtagccttgaggagataggctctatccaacaggactcagaataaatgactgccacctcaactgagcagtatgaactgcccacctcaactgggcagtctgacctcttccacagtctttaagaaacagaagagccatttgcattatttaatcaccattcaataatctcctccctccccatagctgcttgagttaactgtcccacaagtgtcctgtgttttgtaaagatgagggttattttctgaaatgcagatgggactaggatgaagctgtattatcaattacagagacagccaactctcatttctcttaaagcaaaaattcattccactgtgatttctccaggtatttcctgcaattctaaatccgcccttgatattagagaatattaaaatcacacagttgtggcaaaaatcacattgtggctattaaatcctttttgtgaactaaaaaaagtgaatgtggcttaggctaagctgtttttttttttttttttttaaagatgaggatgcggactccaacaaaggcattaagaaagtactagatgaaaatgagaaatatgtgaaggataacatgtgaaatgtacactcaggtctaacaaatacctattatttctctggttaagaaggtttagcaggagcctccaatgagcactgtatgtagagaaaagggaaggagcaggaggaggaacagatctgcacagaatttttttcttaaaaaccacaaagggtgacttttttcttctaagcaagcaagcctgagaggcattacatgggctggctcctaatatcaaaacaaaatatttctttgccacaaaggaacttgactatgtagcaacacatttacaaaactactgcaaaacactcccagagggcagtgacctactctgctccccagaggctccaagaagcaaggcctcaagtgcctcatgttccatggggctgtgcagtgcaatgcagaaggcggaaatcctgctgtgacgccaccctcgagaccttctgcagcctgagagggggtgatactcccacaccctttgatccttccagatggctcagcctagatctagcagtgagagagccctctccatgcagggcagatggagtggtggacacttgtgaaaacaaaacactaactgttccatcctgttatatttgctgtgaggaaaattaagattcctgttgtatgggctgcactgtttctggaagactacagaaaatctaacatggttgacacttcctggtagcccttctgtacatacacacacacacacccagagagaagacagagagaaaatcctggtccaaaagatcacatgaccttactagtgtttccccaatgactgtaatttataaactaaaaatttttacaaatccactgctatcttcttctgtcctgagtttggtagactttaatggatgctccagcaataaccagaatctaggacatgcagactcactgtgagcgagaggctagggatctgccctaaacataggaacctgtttctatcaagcctgaatgaggtcagctctggtagaattaatgacaaatcaatgtcagtgaaatattctgcaaacagggtagcttttgtgctttcttttgattattttctttggggagataaaggtattgcaaccatgggtctaactaatctatcactaaaggactgtgacgacattctcaataaagacagtcatggtgtttactgtgccaaggagggaaaatcccagatcatcagaatcccagtgcaacagaaaacagcaccagtttcaacaattctgatgttggacaaagcctctttttgtcagttaagaaagcgtaagcacaatctctcagtcaattgcattaacaggaatccattcatgtcactgaaaaatacttcttggcacagttcactttcctgacccaaagacaccaacaacaatcaaaactgcactttcagggtagtatattgttacactagcccagtcaaaacatactcagaacatttaaaaatgtataaattactgttagcactgcagttccgttttattttcttatttatttattaagacagagtcttactctgttgcccaggctggagtgcagtggcatgatcttggcttactgcaacctctgcctcccaggtttaagcaattctcatgcttcagcctaccaagtagctgggattacaggagtgcaccatcatgcccagctaatttttgtattttagtagagatggggttttgccatgttggtcaggctggtctcaaactcctggcctcaagtgacccacctgccttggcctcccaaagtgctgggattacaggtgtgagccactacacccagccctgcagtccctttttaaagagtactgactgttttcctgcaaagtactttcaaatccataccataaaggtagaatttatctggaagaatgtgttttttgaattccacctggcacttggttaaatctactttattttgccctttatttatttgaacagaactttagaatgctctaggtcaggaaaagaaacagtgtgttcgtttttaagaaggatgtgtgaatagtaagttggcattcagactcaagtcccatggtattgttcttatccaatgggacctctccttgggaatataattcctttcccagaggtatcatggtatcccaagaatataactgctctttggctctgtgtgtgaagattgggggagaggatgtaaactaagagtatatagcaaaaaaaaaaaaaaaaattttttttttttttttttgagatggagtttcactcttatcacccaggctggacgacagtggtgcaatctcggctcactgcaacctctgcctcccaggttcaagcgattatctcgcctcagcctcccaagtagctgggattacaggcgcccacctaatttctgcatttttagtagagacggggtttcaccatgttggtcaggctggtctcaaactcctgacctcaggtgatccacctgcctcagcctcccaaagtgctgggattacaggtgtgagccaccgtgcccagtgagtagacagcaaaatttaaagttcaccaactgatgttcccaaaagtgctgaacactaaatgacacagggctatgaggtacatacatttcttttagtaggagggaaaagtaaaagcttttcaaagtttgagtgctttattagaatttttaaatgaggcgaactatgattttaatttcacatcttggctaaggagatgccactggagtacagagataatctcctgtcttaagccacggatcagtcagtgtagccctccctacccctcaatctcaagaccctcttacttccgaactaaacaacacaattggcaaatgaagccagcacgaaactgtatcaaaaaacaagagagtctgcagtgagccagtgtattatgtaaccactgtaataagtgattacgtggcctcccatatggacctttcatatcctggtgggagatgggagaccaatttaatagctctgagcatgctccatggtgcaatcacaagtgccatgccaatacaaagacaagcaagcaggtgaatttccctagtgtacttttcaggaacacggttactcagttcagggacaggactacattgatgcacctgcaaagtaaagttggatgcttcagagcacatggatgatacccaggtcagcacggtgtaaggcatatatggacacaaagagaggccattgttggcaataaatagcattacggaaaagattccaaaccagcagaacagaaatggacctgatgctccagttttttagataagtaatcccaagaatccagttccaactctactgtcaacatgtggggcagaattcaatttctatcattgtttttacagatctgggctgaggccatttgctccttgcttggttaaaaaaaaataaaaaaataaaaaaaggtttcttcctgtttctttctgggcagggaaatacagcttaaagaaggaaaggccatgagtcctgggagcactatgaaggtagctaaactcttcccatatctacagtcaatgactgggaaatagagaaaggacagggcaacctgcccagccactagcatcgaaaacaaaaaggtatgttaattgtgaggctctcaattctagaaatgcccaaattaaaagagaaaaaaaccttgaaaaattaaacaaatttctctttctagaagtcatttatttacatattatatgtccgatatataatgtgtagataaatgtatactgcagtgaaagtgaccactctactgaactgtacagcacattataggacaaattattggaagttttcatctcatactggtatcttttaataaaaaaaaaaaattaaaaatcaaagaaaacgtctggccagggccaggataag

SEQ ID NO: 1863 - DNA, 21073 bp, Homo sapiens
gccctgcgcgcccgcggcccgagccccgcccgagccgggcggagcggagcgcgcggagcctagacccgctgccgggccggggctgggccggagcggcggcgcctggatgccggcccggggctgggccggagactggcgcccgccccgaagcgactttcggtccccgacccgctccgcctgacccctatgatgaagagggcgtccactggagaacatcatccactcgggcagtgccctcctggccccggccaccagggcagcgtgggagcagatccagcggagcgagggtggcacggcacagctgctccggcgcctcgagggctacttcagcaatgtggcacgcaacgtgcagtggacgtacctgcagccctttgtcatcgtcaccaccaacatgattcttgctgtcgacatctttgacaagttcaacttcacgggagccagagtcccatggttcgacgccattcatgaagaattccccagggagctggagtcctccatctccttcccagccaacttcttcaaaccacctgaagaaaaagtgcttaggtagaggttgagcatcctaatcctgaaatctgaaatgctccagaatctgaaccttcttgagcaccaacctgacacttaaaggaagtgctcattggaggaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcatgtgagggctttgccaagacacagagaacccgcagggttgttggctcagcggcagatcgtcccacggggacagtctcttgtggtctgtgtctcccccttcagccccctgtggggcagtgagcctcctgctctgcttctgtgggtgcatcagagcccccccagatgcccacacgcagacgcgcacaggcctgcacgtggaaacacagacatgcgcacacgcaggcccacacacagacgcacacagagctgcacgtggagacacgtgcgcacacgcaggcccacacgcaggcccacacacaggtgcacgcggacctgcacgtggagacacagatgtgtgcacatgcaggcccacacacaggtgagcgtggacctgtgtgaacagatgcgcgcagacctgcacgtggagacacagacatgcaggcgcacaaagagatccctcaaggctgacacccaggaaggggcctctcacttgtgggactcccgagatgcagtggccaacacgagtgtagtgcccagttcactgctggataagacagaggcctgttctggtcacacatgggaggcagaacccagagactgggcccaggagcccttctgctgacagtgggaactcccagctacgtgtgggggtccccataccagacaaaggtccctgaccttagtcttgcccgagaggccgacacagcccagctttggggtctggctttacccacaagaggccacaccttgccacagcactgtttatctggcctgtttcagaagcaccgtcagagtggcgaaggcaggaggtggtgcacgagagtctacgttctagcatccattcaagtgagggaaaggcgtttcgtacttagaaaaatgcaaaattaatgattctcacccacacatgagactgtggattcacccatgtatgagatagtggattcagagccatgctgtggctctcatctgctgggagccagtagtgtttgtgctttggttttgcttttttagctacatggtttatgtgaggtgcggacttacttgagttgctctgtctttacagggagcttgctttttctctgctggtttgttttcacttttgctgtctctgtttagaagaaaacattagaactggggtgtggtggaaggatgggagcacaatctgggaggggaagacctgctctctctccacataccaggagggagtggcaggaaggggagacactgtgccggactcagggagtcaagagcgtgagcacccccaggcttcaatctgctgaacgttgtgcatctgggggcgcccgtgcagcaggaacactctccccatcacaattcctctgggcacagtggagagccatgagtgggggctgtcctgggggctgcgctatggtgagtgagcccacgccaggagccagttcagcccagcctcattcttctcctgcttctttgctttccaagttctagttcataagcaaccagcacagtacctggaatgtaagaggcgcttggcttataaaagagagaagaaaggaacccctttcaccacgagggacgtcaggcccagctctctgtcccgggcattcatcttttttccggcaattagcttcagctctaatgacctgctgtctgctttatgttgcacctatgatttccagattgtaaagtttgtggcaaatgtattaacgttcacatcccatttacagattagcaaactaaggatctgagaggttatgtgattttcccagtctggcggagggcagggccctgtcagaagccgagacacacctcgtaacagcttgttatttggggcttcccatcagtgaggcaggagtcataatggggccctggcttctgggcaattcccataaaacattgtgccacctgaagatggaagtgtcagaggaaggcgagatgttatttctgaaagcatctaccctcagaaagagacagaggagtgcatcgcagctgtgtgaacccggggtggtggtggttccagcagcggggcacgtggtggacgcaagacggccccgtttgagttttgctgctaggtgacatgtagaacttgaacttcagagggtgctccttggaggccctgatgagagagacacagaagggaagggagactgttcccatggtcctgcctctgcggcagcgagcctgctgctcttgcagctgggtggctgttcggtgcagggggccggtgaggaacacggtggggagcagcctgcgagggcgccgggctttcagcactcactatacctgctgtttggtttggccaggatggcctgggagtccccagggccgggcaaagactgcccccaacagacatgggcggagggaaccgtctcacccctgcctcttctcccttctctacgcagtgtcagtgggacgggagggtggtctgcccggggcttcaagctcctgtccaggaaccggacccatgtcgtacgccagtgcagccacacggccagcttcgaggtgctcatggacgtctccaggtgtgagatgggcatcttcttgtggccactatgcccgctgagcctacccccaaacctgcccctcctcaaactaaatcttccattctaagcgctttgaacgaagcaaatcaaccaattaaaaaaatatattccaggattggccagagtctgtgaagatttccataacaaatccccgttacaagggttttcagagagccctggttgtgcattaaaccccgcgatggcaaacccaaagctcaggctctgaggagctcttggagtctgcccctcgcttcagagatggtctgtgcgagggtgccgctctcctcccgctttgatcataaggaaggtgacagctgctggggacggtaggcactctccctcagggccacaagctgggctgcaggataaaagactgggcggctaatgtttaacctctggcattttaagcggcctgggagtgtgagccggccattgtgggcctgcagatgaactggggagtggcccgagtgctgtcctcggcaggacagtgctatccagccaggaagtgggtggcagccagcctgggagtggcctatgtgggaccctcctgtctaggagtcagagccagaggcctgggtggcctcccctggcccctccccagggctgcgctgtagctcaagggcccaggccaccatccttcccgagggctttctgatgtgaagtggccctggtttctgtcacagtcttggaaggcaggcccattctgaaagaaaaaggaagttctcgtcgcagaaagaaaataataccaaagggaaacaaaatttcaagaaggaataaagaacagtggaagagtaaatatgaagaccaagagcagtgatgaccttttagctggaatggccagaggggtaacggtgactaatggtgttaaagggaaggaaagctcctgcccatctgcagcaccttcggcatctgcccctgccatgaccactgtggagaacaaatccaagattagcacaggtatgggtgacattcagtctgagacttcaactgcttttttgtttgaataggcaggatgcattggtgtttacagtgttccatctcattataggaaattgtagacatacaaaagtagatggattgatatttcagcccaatacgctcatcacgctcatcaccattatcagctcacagccagttgtaactctgtgatacccaccctcccctcttattattttgaagcagattctggacatcatatcatttcatccataaatattttattatcttggaaagagaaggattcttttaaaaatataatcctaataccattatcagtccttaaaataattgataatcattccttaaatcataccttattcaatgagtatttaaatttctaacagtcttataaatatttttgttttatttactatctatttttatgtttggatcaggactcccataggtccatatataattggctgatgtgtctcttaaatcttcttttttaaatctatgggtttaacccaattcttgcagtttaatttttgtggaagctggtcacgtgacctatagagtttctgagcatgtggatttttatatcacaatatccccatgacgtttttgcccatcaccctttgttgtgtgtatttattgtaaatggcattggagacttatgggacagattcaggtcccctgtccccccaatttgaaaaaaaaaaaaaaaaacaaccaaaacaccatgttgaccaggctgatgtcgaacttctgacctcaggtgatccgcctgccttggcctcccaaagtgctgggattacaggcatgagccaccgcatcatttaaatgtactgaaagtccaggcatggtggttcagagctataaccctagtactttgagaggatgaggcaggcagatcacctgaggtcaggagttcaagaccagcctggccaacatggcaaaatcttgtctctacaaaaaaaaaaaaaaaaaaaaaattagccctgcgtggcggcgcacggctctagtcccagttacttgggaggttggggcatgagaatcctttgaaccccggaggcagaggctgcatgcagtgagttgagatggcaccactgcactccagcctgggcgacagagcaagaccctgtctctaaataagtaaatgttgccggtaatcctagcactttgggaggctgaggcgggtggatcacctgaagtcaggagttcgagaccagcctgactactatggtgaaaccccgtctctactaaaaatacaaaaattagctgggcattatggcatgtgtctgtagtcccagctactcaggaggctgagacaggagaatcgcttgaacccaggacgtggagggtgcagtgagccgagattgagccactgcacttcagcctgggtgacagagtgagactccatctcaaaaaaaattaaataaaataaaaaataaaaataacagctccctaacagctccggaaagataaacagaaaacagaaaatgacatgctcagcccttgaggccaaaatgcccttccccagagcagctgccagaagacagggagcaggatcgggttggaggtcacttctgggtgagggggagaatggtcagacccgtggcaggggtgttggagcctggtcggcctcactggaacagaagagagctgcttcatgatgctcaactgacaggcagagcctcgcataacccaagttctcatggttcagagaggccagccagtgcggggacaaagacaggcacgcactgaaatggtttcctggaagacggcccggttgcatctctcaaacgggaccagattggaagggagaccagctgctttgggcaaccgaggctgcttctgggtgaactcccaaactagatggtgccgagagccctggacctggcagctgggctggacatcacatggctctgtattccaggaaacggcatctcagtgcttgtctggccagttctccaaaagaaccatccacaggccatttttccattcccttcctatgcacagactgggctgggcctgatcagaaaactctcccttagggttttcagtcactggcgaaacttgagcccggcactgaggataggatgttaaaatgtgactctgggccaggcggcggctcatgcttgtcaacccagtgcttttgggaggctgagctgggagggtcacttgaggtcagcagttcaagaccaacctgaggaaaatagatctctacaaaaaaataaaaataaaaattagccagctctggtgacatgcacctgtagtcccagctacttgaaaggctgaggtggcttgagcccatgagttcaaagctacagctatgatggtgtcactgcactccagcatgaaaaacagagtgagaccatgtcttgaaaaaaggaacaaactaggcatagaagaaacatacctgaaaatggccaggcccagtggctcatgcgtgtaatcccagcactttgggaggctgaggtgagtggatcacctgaggtcaggagttcgagaccggcctggccaacatggtgaaaccccatctctaccaaaagtacaaaaattagccgggcgtggtggcgggcgcctcccagctactccggaggctgaggcaggagaatcacttgaacctgggaggcagagtttgctgtgagctgagattgcaccattgcactacagcctgggtgacaagagccagaatccatctcaaaaaaaaaaacctagaaataataaaagctgtatacgacaaagccatagctaacctactacagaatggggaaaagtgaaaagcgtttcctctgtaaacaggaacaagacgaggatgcccgttctcaccacttttattagacatcacacaaatatgcaagagaaaaaaataaaagccacccacactggaaaagaggacatcaaattatccttgtctgatgaagatgtgatcttggatttacaaacatgtaaagcctccaccagaaaactctagacttgataaataaattaatacagtcatttgcaggatacaaaatcaacatacaaaaatcagcagcattttatacaccaataatggtctaggaaagaaattaaggaggcaatcccatttacaatagcaacaaaatgaaaaatgatatgccacagaggaaattttaccaaggaggtgaacgatttctacaaggaaaactacaaaacactgatgacaaagtttaagaggacggaaagaaatggacagtcatttcatgctcatggaaggaattcatagcattaaaatgaccacactgcccagagcagtctagagattcaatacaacccctaccaaaataccagtgtcatctctcacagaactggaaaatcgtaaaactcatatgaaaccaaaaaagagctcaaagagccaaagtcatcctcagcaaaaacaacaaaactagaagcaccccatttcactgcaaattagaatgacaaaatttttgacaagtgcatggtaaccaaaacagcatggtcctagcataaaactagacacatagatcaatgggacggatgacagagcccagaaagacagccacatagtcttggggcttgtgtctctcctgctgtgcatccatgctgggtgctttacatacaacaggcagacaagaagtccctgttgcaagtgaggacaaagtgtgggaaggccgtgagggtctgcagtcccagatggccttggcctcaccccgcagtgcgcttttgcaccagagtgccaccttcttctccaggtccaggtcttcagcagtgaccccagaccccagctgtaagggaggtggcagcatcagaggctccccttgcctgagtggcagcagaggaaacttgcatctatggggcctagaggcctgggatgtgggggagccattcctgggggcaagtgtctgccctggtgctgcatctgctgccttttcacactgggtgagaccccaagagacagcctgaggccggtcctcactcactgtctttgaggacctgaggggcagctgacagtgggatgaggctggccccctcctctttggtgacaggaagcctcccatggaactgtaggagctcacgatggcattttgtttggtgcacgaactcatccaggaggtctgggatctctggttttatccgacttctgacctctgggcatggaggtctctctgcagaggcccaggcctgggcacgaagggagagaggcctccattgtcccacaggggcctaaatgcagactgtgcatccccggtgccctcaggaacccttctctgatcatcaggattctcttggactctggggtccttgtcctgctcaggcatccctgcccccctcttcaggagggccctcaacacgatcttctctggacaggagtctggggcacaactggatgttgtgggccccaaaggggtgactccctgctcctgggccccacagagagtccttgtgctcagtgcactggctgagctgcaagacatcctggaattgggagcacacagcaccggcttgctgtggtacctgtgcattcaaattgaaggcaggatcgccagcaaggaacacagggcttgcaggatcacagaaaacccttggagttgttttgacacaccactgatgccaagtgtctgggtacttgtaggatggccctgccattccatccaggggcagtggcaacagggagattccacaaacaaagtgaactgggggatgggatgagcaggctccaggcaactgagccctactggcaggcccttggcccccggggccgggacaggggtgacagacacagagtgcccaggtaaccactcctgggagcagtggggaaccgtcggatgcttcaactcttgagagctgggctctaagcatccgccttagctgccaacttggccaaaggctatgcgagcagtttcccgttgacgggcaatgcatctttccaacctgagcgagtgggtgtgtgtgcaaagatggtgcgagtcacggatctgcgcaggaagggtgactttaagggattagcatggccaggtatgcacacaaggcacctgctggcaatgccttggtggggagcgggcagtgcacacaagaggtactggagggagaggcgcgcgggaagaacaggcgcgcacaatggctgcagatccacctgtggatcgctgaagattcctgctgagggttgaggctgctgggctggaggactgtatggtccatgcattgtaatgtccccttctctccctggcccggagccccaagagctatccggactctctccaagacctggttctggcccagcaaagaggtctcggcaggggagcaggattcccggcccagcagctggctcaggaggtgacagctttgggattcgcatctgagcatcctcctactcttctcctgggaactctgttggggagggttgctcagaacagaagtgcctgggacgcccagatcctgctggagtggcagctggggtgatggccagggcaggctgggagggacatactttccataggacccagtgctttcatctccgtgcaactgaccaagagaaaccaaacccaaactccttcctttacacagacctatttgagggaggctgggtattgtttgtgtatttcaacctaacaagattttgagatagttggaatgcagaaggagacaggaggactcaagtgtcctgtcttttgcaaaaatgtcaaacgtagctactcagtctcttttttgtttttttgtttgttttgaagactatggttattttgcaaaatatatattatttgagtttctctaggtgctatttttagataaattaatatacttttttcatcagcacatgaaacgttcttcaaaacagatcctttgttagtccacaaaagctgtccctacacattttaggaaatcataatcataatcattccaaagatcagacaacagaggaataaacctagaaatggacatcaaggcaaactacagaacctatacgcatacatgaaaattaaaccccaccctcctgaatgagcactgattcaatgaagaaattaaaatgaaaatccgaaaatgttttcaaacaaatgaaaatggaaacatcatataccaaaagcctttggattcagcaaaatcagtgctgtgagggaaggttgtagcaataaatacctacatccaaaaagtagaaagatgaaaaattaataaacttatgatgcaccttaaagaactagaaaagcaagaacaaagcaaaaccaaaattagcccatgaaaaaaataataaagatcagaggagaactaaataaaatagggtctcaaaaacaacacagaaatcaagaaaaggaattactggttcttagcaagaaaaacacactttgggtatttcctttttttttttttttttttttttgagaaagcttttttttttgagaaagcgttttgctcttgttgcccaggctggagtgcagtggcaagatctccactcaatgcaagctccaccttccaggttcaagtgattctccttcctcagtctcctgagtagctgggttacaggtgctaaccaccatgcccagctaatttttgtatttttagtagagacggggtttcaccatgttggtcaggctagtctcaaactcctgacctcgtgatctgcccgtgtcgtctcccaaagtgctgggattataggtgtgagccaccgtgcctggcctcaaaatattcttttgagggactcttgcatacaagccccaagaggcaggtgcaaaaatgtccatagaaacacagtaatagaaaaaaagaaaatccagactgattcaaatgtccattaacaggagaatgaataaattagttggaatcttcttttcttttcttttcttttcttttttttttttttgagacggagtttcgctcttgttgcccaggctggagtgcaatggcacaatctcagtttgtggcaacctccgcctccggggttcaagccattctcctgcctcagcttcctgagcagcagggattacaggcatgcgccaccacacctggctaattttgtatttttagtagagacggggtttctccgtgtttgtcaggctggtctcaaactccggacctcaggtgatccgcccgcctcggcctcccaaagtgctgggattacaggcgtgagccaccactcctggccattagttggagtcttcttatacagtggtgagactgaatcagccacagttgcacaacagaatggatgaagcttagaagtaatgttgggtttaaatggccagtcccaggctgttacatttaccatttgcaataacaataggaactaaggtaactgaagaatctaacaaaaactatgcaagacctgtatagaaaaattataaaacttgattgaaagacatttaaaaaatctaaataagagagataatacataatctactctttgtggattgggagattcagtattataaagttgtcgattctccccaaattgttctacagatttaatgcaaatccagtaaaaaattcaacaagaggctgggcgcggtggctcaagcctgtaatcccagcactttgggaggctgaggcaggcagatcacaaggtcaggagatcgagaccatcctggctaacatggtgaaatcccgtctctactaaaaaaaaaaaaaaaaaaaaaaatgagccaggcgtggtggcgggtgcctgtagtcccagctactcaggaggctgaggcagggaatggtgtcaacccaggaggcagagcttgcagtgagccgagatcgagacactgcactccagcctgggcgacagagcgagactctgtctcaaaaaaaaaaaaaaattcagcaaggggtgtgtgtgtgtgcctgtgtgtgtgtgtgtgtgtgtgtgtatgcaagccatagacagaatactttttttttctttttgagacagagtctcactctgtcgcccaggctggagtgcagtggctcgatcttggctcactgcaacctccgcctcccaggttcaagtgattctcctgtccctgcctcctgtgtagctgggattacaggtgtgcaccaccacatctggctaatttttgtatttttagtagacacagggtctcaccatgttggccaggctagtctccaactcctggccgcaagtaatctgcccacttcagcctcccaaagtgttgggattataggcgtgagccaccgagcccagctagtacacagaataccattttttacttaagtatattaatctagaagagttttttttaaaatacagtataccatttttatctataacacttaaagacaatcaaagccaaattatgctgtttcaagataccatatacttagaaaaacatctataaaaagcaagagaaacatacaaatcaggcccatctggagagaagggagtgaagcattgcgctgatacggggataaatatgctggttgggtagacaggcagtccttatgcttttggctgacgtagatgttacgtactatttcatgtgttatcacactctccagtaaacacgtaacataagagaataattaaccactatcaagcgttctcatcttgagacaggaagatgtagaggaaagaccttgatgtgtgtgtcagttacaaggatgtacaccagtgactgacatgacttggtgcaaatcttgggtagagacctatacttaagctcctcacccccacctgccgaggcgtaagggctcagagggggttccatggggtgggcgggagtggtaagggtcgaggtgcagccacagcctggctctgtgcacaccccctccctccccctggtcccatgtgcacaccctctccctgccccctgccccttgtgcacaccctctgtaccccccttcccgccccagcctgtgtttgcagtgctacagggtggctgcagcctttgcctcccacagctcctcaaggtcagagggctgggaacccctgggatgtggctgggatgaggaccctgcccctcctcaggcatttccaggcaaggggcacagagacacagccagcccagcagctgagcccctcctatcaggccaggtgggaaactgaagcatgaacacaaccccagactggaaataaaaagccgtcatgtactgtgtgcctactgaatgccaagccctatgccctattctttaatgtcatctttaatgagatgtcttcactcagttcaccacatgatagtagacaggtatttatgatgcgcctactgcatgctgggcacttttctgggccatgaggactcagggaggtccctgctctggtagaagtcaaacccgacaggagacagagactaggggcccacacaccaggaggaagaacccagtgcagagagtgccagcaggaagccacaggggcagggaaggcgctcctgggagggtgggtggctgcgtcctgaggctgagcagggggagctggcctcgggacaggatgtgcgcaggcgtggagcaggaagttcctggaatgatgggcaagagggagcaggtcactgggggcaggtctaaatactgggggctgcattgggatagcagaggcctcggacaggcccgctcagcatgtagactcccctccctggccccttccctaggatgacagtggaggtccatccccaggtggtggtgagggcaatcctgacacagagaccccagcccagctggcaggggaaggggagcccccaaggacccctgtatgttggggcgtgtcccgccaggcggccctccatggtgcccagcagcagccctgcttgcggaccctctttagtccccactgttaaaaaaataattcagtgaaaattgacactagctgggcatggtggtaggtgcctataatcccagctactcgggaggctgagacgggagaatcgcttgaaccagggagtcgggaggttgcagtgagccgagatggcgccactgcactccagcctgggtgacagagtgagactccgtctcaaaaaaaaaaaaaagaaaaaaggaaaaatgacacttgccaaagcgctgtagggaagactgtccaggaccgtgtcactaggcataagggaccacggtgatgagattctgcagtgggtaagagactgggctcagcctcgaatacagcatgggcaagtgggatcggaccgtcaaggagcagggggaagactatccaggaccgtgtcactaggcataagggaccacggcgatgagattctgcagtgggtaagagactgggctcagcctcgaagacagcatgggcaagtgcgatcggacagtcaaggagcagggtggggggcagcgcatggaaagtgactaagaggaagcatcagcagccagggattctggcttaactcccctaacagaattcttgctgaaggccggccaggatggccagaccgcacctgggggacagagggggaacccgatcagatgtcaaggacggggggcttctcgctaaactgactttgcaggattcttgctaaaactagagtttataaggaagtgctcagatgtgcctaggagaaggctcaggagcctaaataaagcttgaccaagcagagaatctttgtcaccagctgtggtgagagtgaggcccagagtgggtcagggcttacctgctcaggttgtgcaattgggaggggtccatcaggagcccggagtcttcccactgggggctgagtctgggccctcagggcacatataggtagatgctgtcagacccgacaccccatgcagtgcagactgggatgctggtgcctgtggcacagactggtcagacccaccccaggctagacattccttgcagggagagctgaggctgctgacaccaggaacagacaaacaaggtcatcaccaggtaatgagcttgttacccacatcaggcaaggccattgctgggtaatgagttggcctcctgcagagccacctgcgctgggatggttcccagagatctggctagccagtgccacaggaggccggggcacagttccagggcctagtgggcaaggcaggggtattcagggacaaggtgcacctgagtccccacaggaagccccagaccctgcagtaagacctggaacaagtcattctcctctctaagctctcaaagaagaggtcagctcaggggtctgggaggcaaggtctcctagagtagactaagctggccgctgccatgctaacacacaccctcccagccagccgctggtcctgacagatgaggaaactgaggctaggtgttttcatgaggcctctgaacccagaacccagtacccagtgtcctgagcaaagcccaagccagacctgccagcttatgtgtacagaggccccactatgcagcctgcactcctggggcctaaaaggaccatcacctccccttctaagaggctgggcacaggggctgggtcccagccaggccacccttcctcctcctccaaaggcccagcagcagctgctcccagagcaagcagcacagtcgcagcaaaggctggacaagtgtcctgtgctctgtggtctgagcagagggccaggggccgtgacccacatggcccctccaggagcagctccaagatgagccttcctgtccccaccagtgtgtccgggacctcagggtggatcagccgcacctgccggctgctcctgttccttgctcttcctggggctccccaccacctttgggaggcagctccaagaccctgctgcctcccttgcttaccctcaggcccctgctgggtgtgccccctccccacacagacccctgagccagcttcgaggactctgcctgcatctccacgtccactctgatgactgtgaagctacagtcacactctccgcctccacccccgccctgccgggtccctgcagcagctctcagaggcccccacagcccctcccacacacagagctcgcctggccctgccgtctgagcgctcccctggctcccaaccgcccttgggctctgggacataaaacctccagccaaggtggctgccaagttttatttaatagccatagagcacaaaagggatgacaattaagtcacacggagagactgccccatcgggacccctggccaagctaagcagaggagccctggggtttcctctgaccccccactgtgaatgcattactgacgggcaaggtggccagttgcccacccagcctgcacgtctgcatgcacagagctacagcctgggcccagggacagccccgggagccggtggcttcccacaggcacagccagcctccccacccccaccatgcctggcccccggcccagggcacactgaggggaacaggaggggaaggagcaggccctgcactggagcctcagtcagctcctctgtgccaggggcagctggagctggctgaatttgaggaacttcccggaggaactggagagcagacctgtgtgcgcgccccgctctgccacgttccctgagggacacactgctttgaccagcccccaccccatctcctctccgccagtccccggtgtccaccccagccccgctaccgatgaagctcaagccagggtccccatcacctgcttcacggccatccctgcacttgagctcaggggctcagggttgtgctgacacgcctgcctgtccacccctcaccgacacctctgcagtcctcctcagggcccaacaggacccccaggaccccgctcccattctgcccttgctcctgccaacctgtcttctctatgcccatgactttggaaccctctgccacaagtgccagcccccacatctgtagcccctgcaggaacaagccctaatctggactcattgcaatggctcagcttctcttccaacctgtccataaacctccaggcagagatcacaaaactaacagctctttctgcaaatctggactctctcctgcaccttcttcaccgtccaggcctccctgtcatccgtcctggggacctcagagatctcttcatttcacaggtgaagacttggctcagagagggcagagcccctgggtcacacagcccgtctccagtagggctggggaaaagaacccagggcgctcttgttggcagtgttttaatgactggggggagggagagaatggctaatgaggctctagggatcagcacagccagctgctggaggtcccagaggacgggtgactcagcaggaatgggggagtctgaggggttgacagagtgcccaattctcacctcctcctgcaccttccagagagacgggctgcagggagtgattgagtggatgaacatgactagagggacccagtcttctcctcagcagctgcttgaggacagtattagcggtcccctcaatcccccccccaacacatgcacacatgcactgacctgcaggggccagatcccggtggacccggggacacagcttccaggggctgtcttgccatgtcccttcccagatctgcctggattcatgccaggccaccctccacaatttgctgagggaggccccagagtccagggcacccagagtgctaactagcccctgggggtacagggagaacagcatgctgtgtgggggatactactctctgcccatacctagggccctgtggcggccacaggcagcactgcttatgcagaggcactggggtgagaaggagtagggtgcagtagtgagggctccacagagggtggaagggctgcaggggaaggcagaccagcagggatgccatgagggcctcagatgccaggctgcagaggtggacgggctggccagctcctctccccagcctcctactgtaaaatgggagaggatcccagccctgctgattcatccactcactccatggcaagacagccactgacagctctgtcctggggcccacccgggcctggcctctgtgcaggctagcactcagtatgcttagtgccacactcggcccaggagaaatgacccagccctgggctcagagaccccacagtgggtggatggaaaacagtcatttaaatacaactgtgaagggtgctgtggaggaggggctcgaggtccccagtgtgggatggggtggtcatggaacgtttccctatctaagtgggaaaagtgagagccaccaggaaaatggcgggggtggggggggagaggaattatgcaaagacccagaaggatgaagaagactgttggattagaggaggttaaagacacagacaggcttggacatggtggctcatgcctgtaatcccagcactttgggaggccaagacaggaggatcacttgaggccaggagttcaagaccaacctgggaaacacagtgagaccctatctctacaaaaaaaaaaaaaattaaaaaaaattagccgggcatggtggtgcacagttgtagtcccatctactcaggagactgaggtgggaggatcgcttgagcccaggaggtggaggctgcagtgagctatgattgcaccactgcactccagcctgggcaacacagcaagatcctgtttgtaaaaacaaaacaaaacaaaacaaaaaacccagcttgagatggccagggatttccagaggccctaggcagaccgccttggagagtaagggagaccctgaagagctcccatggaagggccagcagcctggggctggagatgccacctggatggattcctccagctgtgtggactaggggacagggtgaggagataatggcctggactacatggaaggacgtcgccctgagccattgaaaagggctgtggggtccatgaccactcctggctttcccttgactatgatggagacagtagcttccagtgtaaaatgtgagctcagttcctgactcgtgtctagcgggtggtgcctggtctttggctggcgatgctccatgtcacctatgcccagaaactgggccatgccctttgtgaggacctgcccacaacgtcgtcgttcccgcagggtcccctgggaaccgggctgcccgagacccggccctgccggggttccctgcgccccagaccggaacccccagggctttggtcgttcccacagccgtcccgcgggccccctccacggtgcgtcgcctgggccccagcggtcgctaggctgcagcctggggctcccggccatcccgggcgctggcggcggtggaggcagcagggcggatggcggagcccggccgcccgtgggcccaggcgcgtagtgcgtacagagccagcgaggtgctgcggcgcggcacgggccgccggcgggatccggggccgcaatccaatgggccgggccaggaagacgcccgagccccgggccggatggctcgcctgcgcggccagctccgggccgaagcggcttcgcggtccgaggtgccgcggctgctgaagctggtggagcgtgcgggggccggggcggccgggcgcgggcgagaggaccggcgcgcacagccgcgggctccgtgtgctcggtatgcggggagccccgcggcggggccacctacccggcgggggtcctggaggtgagcgagcggcggctgcaggagggcctggcggcagtgcgcgaggagctgggcgccgggattgaggcgctgcgcgcggagcttcgagcggagctggatgccctgcgcgcgctgctgccgccgccgccgtccccgcctgcccgccgcgagccccgcgccgtcccccgcgccgcgccccgcggcccgaccctgccgcggacgctcggcaccgtgagcgccctggtcgccgcctccaggcccgcagacgacgccccggacggcccagcagaatgcggagcgcaccgagccccggccaggaagaaccacaagaagatgccagtgccgcctggggccccgcaaggtggcggggactgagggcggccgcacaagggcagcctaggcgagggcaccaactggacagaggcctccggtcagcctcactctgactgcaaccccctctcactggacagcatcacctggacacagagcctcacctagtctgtgtcccatggacacaactttgctttggacagtgacaccaagaatactcacccctttacttagccagaccacaggcagccacctggacacaaacatctctccagagtcagcctccacacagactccacagcagaactcccagggaggcactggggcatggcttcagagcaccaggcagcgctccgcggtgcctagcacccgctcagccagggcagcctgcagcggagcttggagccagcagcttctcatctcttggcctcgggaaatgtagctggagtcatcatttagcagagcacggtgtccctgggttggccacccagcttagttttaaaataaaataatgtaatcttggcctaatggtggaatttctgactgctagatgttctccttccatctgaccaggggattcagacacaatgtataggatgagggtgggggcccttctccctctgagaggaacctggagaggcccgggttctgctgaggtaggagagggtcactcagagggctcccacggaacagacaggcacactgaggcctcagtgggattagggcaggaaatgcccctcttgcaatgggggaccacgccgggtcacgcacccaccccctccaggctacattaggctaaggtcactctgtgcattatttcattatttcacatggagggtcgcccacggttgacagaaccacaggctgagccccaggcccatcagagcgcagtgcacaac

SEQ ID NO: 1864 - DNA, 2092 bp, Homo sapiens
ctggcattgtcactaaagagaggcaggatgcattgctgagtcatcacatcgggggcagccaccttggtgaatcacccaattcacagaggacttcattagatgagagtgcctatttctgcacacgacttgtattatcaaatattctaatttctgccaacataatagggagcaaagtttgtcatcttgatacactagatctttgatgatatcaataaggaaacatccacaccctttggttaaaagactctgagacttcaaggactgctggctgttcagaagaggctgtggtggttcaagtgaggctcaaggctgtagttataccaatctgttactccatgaagagtccaaggctgctgaacagagtgaacctcagaacagatagcagtggcacctagaagatataatctcaacagcagatgagttattgagggatgattgctgattatggattcctcttcatctctcttaacttatattccaagctgttaacctagaataaatcctactatatctaattaatgcattaatcaaactttgttttgaatggaaggggggagaatatgttgattaccccggctagtgggatacaaaatatacctaaagcagaatatctttctccatcatgaataacattaatctctgcagttcttacaagtgaataattattatatagtttgtttcctatttgtctggcttggtatttatcctttatgagtttccaggtgacaatttgtttcaggaagaattctccagaaacaattttttaagattatcgtcaaattccttaataaagagttgaaagccaaactcactaggtgaaatgcaacaacaaccaatgggcaacagactgatctccaacttcctgaattctttttttttttttttttttgagacagggtctctctctgtcgatcaggctggagtgcagtggctcaatcttggctcactgcagcctccacctcccaggcccaagcaatcccgagtagtagggactcaggcacgcaccacgacacctggctaattttttgtatttttggtagagagagggtttcaccatgttgcccaggctggtcttgagctcctgagctcaaagtatttgcttgcctcagcctcccaaagtgctggggttacaggcgtgagccaccgtgccaggcctttaattcttaattgccgccaggattgattggtaaggctgtagaagagttgctgtccattccaagtcttcccatctgaagcaaccaccatgccacagccttattctgtcccatggctgttttgtgcatctccaagtgtaccagtgtgaggccctcaaacacacccatgccctctgatgaaataatgttggtcgtgataaccacagggatgtcacagccgccgttccacactctaactaattcttattttgttccaacaacaacaatttgaaatgggaagaaccaccccattttagacatttcaaaacgagggcttggatagattatgtaccttgtccaaggtcacacaaccaaatggcaaggtacggactcaacctagttccatctgcctccagtccaaaacccagagctctcaactgccaccctcattgtctctactagatacgggcttccctgcggtaactgttgaggctggaaaacacaggcctgagagaacttttaaatatgaaatgataactctttgcctactgagattcttatttttaaaaacccagaggaagatcatatttatatatttattcaacattcacgtatgatatttagatttacaaaatgctttatagtgtaacagaatgggcagaaatttttactcgggcttataattgtcttttctttcatattcatttattcctttgatttatataatgtgttctctgcttggtcttctgagattacgtacaatggtaacaaatcgaaaataatattaataaaagattattttgtatcactcacagggaaaactgactggggccatgcgcctctctgttctttagaaacgttatgcgagagaacataatattgtccccagaatactgtctgtaatgccggctatgcttattcgtggtgctttaaaaataaatttaactcctgttcttcat

SEQ ID NO: 1865 - DNA, 1987 bp, Homo sapiens
ctctcttctgctttgccgtggtaagacgtgcctgcttccccttcgccttttgccatgattggagcaaagtttgtcatcttgatacactagatctttgatgatatcaataaggaaacatccacaccctttggttaaaagactctgagacttcaaggactgctggctgttcagaagaggctgtggtggttcaagtgaggctcaaggctgtagttataccaatctgttactccatgaagagtccaaggctgctgaacagagtgaacctcagaacagatagcagtggcacctagaagatataatctcaacagcagatgagttattgagggatgattgctgattatggattcctcttcatctctcttaacttatattccaagctgttaacctagaataaatcctactatatctaattaatgcattaatcaaactttgttttgaatggaaggggggagaatatgttgattaccccggctagtgggatacaaaatatacctaaagcagaatatctttctccatcatgaataacattaatctctgcagttcttacaagtgaataattattatatagtttgtttcctatttgtctggcttggtatttatcctttatgagtttccaggtgacaatttgtttcaggaagaattctccagaaacaattttttaagattatcgtcaaattccttaataaagagttgaaagccaaactcactaggtgaaatgcaacaacaaccaatgggcaacagactgatctccaacttcctgaattctttttttttttttttttttgagacagggtctctctctgtcgatcaggctggagtgcagtggctcaatcttggctcactgcagcctccacctcccaggcccaagcaatcccgagtagtagggactcaggcacgcaccacgacacctggctaattttttgtatttttggtagagagagggtttcaccatgttgcccaggctggtcttgagctcctgagctcaaagtatttgcttgcctcagcctcccaaagtgctggggttacaggcgtgagccaccgtgccaggcctttaattcttaattgccgccaggattgattggtaaggctgtagaagagttgctgtccattccaagtcttcccatctgaagcaaccaccatgccacagccttattctgtcccatggctgttttgtgcatctccaagtgtaccagtgtgaggccctcaaacacacccatgccctctgatgaaataatgttggtcgtgataaccacagggatgtcacagccgccgttccacactctaactaattcttattttgttccaacaacaacaatttgaaatgggaagaaccaccccattttagacatttcaaaacgagggcttggatagattatgtaccttgtccaaggtcacacaaccaaatggcaaggtacggactcaacctagttccatctgcctccagtccaaaacccagagctctcaactgccaccctcattgtctctactagatacgggcttccctgcggtaactgttgaggctggaaaacacaggcctgagagaacttttaaatatgaaatgataactctttgcctactgagattcttatttttaaaaacccagaggaagatcatatttatatatttattcaacattcacgtatgatatttagatttacaaaatgctttatagtgtaacagaatgggcagaaatttttactcgggcttataattgtcttttctttcatattcatttattcctttgatttatataatgtgttctctgcttggtcttctgagattacgtacaatggtaacaaatcgaaaataatattaataaaagattattttgtatcactcacagggaaaactgactggggccatgcgcctctctgttctttagaaacgttatgcgagagaacataatattgtccccagaatactgtctgtaatgccggctatgcttattcgtggtgctttaaaaataaatttaactcctgttcttcat

SEQ ID NO: 1866 - DNA, 1987 bp, Homo sapiens; identical to SEQ ID NO: 1865

SEQ ID NO: 1867 - DNA, 333 bp, Homo sapiens
aagacagctcaacccattggaacaaacagactcccaatgtggctggcaactgcgggggtagaagaactcaggcaaagtaggcacaggaatgggggagatgagagccaagggacaaacgccgagaaagcgttccgacaagcatgtgtgttcatacatgcatacccccaacaaagggcaatgcactgtgtaacagaactgaacacaatttaacaaagctgctcccagccttcctgtcacctctttggcagtagggcaggccatctcaacttcggacacacaaagacattctcttcaggaggaaggctgtcctgtgtggtggggacaaggcttcag

SEQ ID NO: 1868 - DNA, 333 bp, Homo sapiens; identical to SEQ ID NO: 1867

SEQ ID NO: 1869 - DNA, 333 bp, Homo sapiens; identical to SEQ ID NO: 1867

SEQ ID NO: 1870 - DNA, 333 bp, Homo sapiens; identical to SEQ ID NO: 1867

SEQ ID NO: 1871 - DNA, 333 bp, Homo sapiens; identical to SEQ ID NO: 1867

SEQ ID NO: 1872 - DNA, 333 bp, Homo sapiens; identical to SEQ ID NO: 1867

SEQ ID NO: 1873 - DNA, 4814 bp, Homo sapiens
gggtattgtgccgcgtgtggggggagaattcctacgggtgggtttccgaatattgtgttcaactttttgaaagcagctcgtgaccccgaaactgcatcccccggagccggggacccaggcgccgggcgggcgggtgaacccggtcagtcccctccccgtccccgaaacccccgcctccgggtggtggcgacctggcctctccctgccactgcccggccagccccggagggaggctgggcaggtgctgcgggctctgccgaaagcgctgaaataaaaaaccatcgccactcagggagaactgaggcaagtggggctgagactctggcgacacccccgccccccagcctctgccccagcgcctgccgccctgccgccctgccgcaccccgcctgcttgggtggcgaccgcggttccggaacgcgaagcagggcagagggctgcagagaggcgtgtagctttgtgcgccaggacccggtggggcaggtggcagccccgggctgtccgcgcctcccagcagagccgagctcggcgccgcccaccgagcccacctcgcggtccagccgccgccagcgcctttcggctctggcctgaagcagtactcccgcctcctggagcgggaaagtctggagactcaccaagctgaggaggaagaagggaacatctcaacccaagctgaattctgaagaacacttggccccatcttccagaaatcctaaatcacatagagggaaagttttggccagggcaccaagaatgaaccagaagctgagtccattactccaattttcacattaaccaggagacacattgaaaattcttttcttgagtgagagactgaaattttggctcaagggtgtttctgttgggtcttctctttatatggcatgtgaggactgcatcccacgtcacatctgcagccactcccagattacactgcaagggagggtagattaggagtgggtagggagtagaggggtctgtagacacagcaaaagcagcaagctggtgtgggaaaacccagaaaatatgtctcagagacagccagtggctgcacatacaaaaggaaggcacctacctggaagagaaggggttgtgaagttctgcccagagtcacagcgctgacgtcctcagaaggtctccagccctctgcagcaatctatagtatgcatcagtatggttggaaaagcttcttctatcaagtttaacaactttctggtgtaacttctgagagggctgattgcttattcatgcggaagcaagacgcccagttcattttgcccgtttttgctactctttgttgggtttgggaggctgttatggtagctgcaaatggcttctcaagtgacatttgctgacattcagtgaagtacatttatcagtattcgccagctcacctctacacatgcaatccattttgttttgttcttcatagcaaactcctttccgacacccgtgccctgaaaatgataaatggcaaggtggcatatttctgaagctgcactcaagtgtcactgtgaaaaatctttaatggactaagtgtagcttttcatgttacagcttgtcaggtactgagaaattctagagtttgtctttaatcctcaagtctttggaaccacacttctgcaagcagagactaattataagctgcaccactcagacctgggcaagcagaaaccaaggagaaaacatttgatatcagcaaattctttattattattattattattattattattctcattccatttttgctccttcctttcctactcaagatatttgaggcatgagcaatctgtgactctaattaagggggtgacagccccaaccaggccaccatgcaggcttataatccactcatacacccagctttctccataatggctttattcttttcctccaaggttcaaaatcaccatgacttctcccccacaaaaaaaaaaaaaaaaagaaaaagaaaactgactctgaatcataaatcctggctcccaaatattggccataattgggtaggtgagatgtatcttgtatgtctgggtggaagaggctcctttctccctggtgattcattttcagaacacacggccatccttccaatggctttgagtttcacgtcaccaccggaaagacctgccagtttcttcctgtttgtgtgcctgtccactgccatcatgctactcccaggactatggcttctgggcactcactcacccttcaacatggcttgttcactccagttctccctttccaaatgttctcaatcccctgggctgtgcgccaagggggattcagcccttgcccaccggctatggtctgaatgtttgtgtcttccccagattaatatgttgaaatttaatcacaaatgtgatggtgtaataaggtggggactttgggactttattaggtcatggagggggagcctcataaaaaaggctgccttgccccctccatcgtgtaaatcaccatctgtgaaccaggaaatgggccctcaccagacaccgaatctgccggttccttgatctcggacttcccagtctccagaactgtgggaaacacatttctgttgtttatgagccacccagtttaaggtattttgttatagcagcccagatggactaggccaccaccatagtcagggaagagctggctgatttgtgcgtgtctgcgctgtgtcccaatgaaagcacaataatcaatgaacattgattctgcaatcgatgtttgaaggtcaaaggagttgggaaagggggtctcctgaagccaaggaaaagcattgtactccccaaaactgtgccagccaggttaactttttgcgagatgctacagattgagatgctttagttttacttctggctctttaagccctactcaagctctaattttgatatctcgttctagacgccttagtttgggcccctcccaggctcccttctgtttttgttctttttttctaacatcatccttggcttttcttctcctttaggtttgatctcctgtctcttgggttgagaaaccatcccctctgactcctggccccctgtgacccctccaaagccccctgtacaggtctttggccacacagagattcaacagtctaataatctaaaattgtaaatgccacaatttgtgtgcgtgtttactgtgtctcagttttgagttctttttgaaatcttttagttattccagaagggataggataaagagaagaaatcagttatactcccagtggccaggcatggtagggcagaaagagtgttgacactcactacccctgcagggggagagggcagaggacccaggttaactacccagagatgagatggatcctggtctaactcaggccctgggatacctgcaccaattgctctcagcaggtcgagacatcacagaagaagagaagacatgtcaactctctacaatagtgtcttagccctggagatactattggagagtgacaacagacagcaaacagggttctattcatagtggccatggtttccccaagcagagaacatatccaaccaaagggacttcagcaaagcttttcctaatctgtgctctgaaatggctaagtagaagagagctatctagagtgtatgaggatgtctttaaagtcaaccttgcaataactattgcatgcagactgtaattgtgggctaaaagtgaaggctgttttgttaggtgagacccttccagagcacctcctgcatatgtacacacattctctctctctctgtctcacacacacacacacacacacctccccccacaacacacacacacacacacacacacacaacctccccccacaacacacacacacacacacacacacacacacctccccccacaacccacacacacaaaaccaaccccatcccagggaacccaacagtcatagatctcatctggagtccaactcctaatccaggtgtcatgatcatcacgtgagagatagcagaatctccaccaattttggaaagaactactcaagtgttttctaaaagaaataatggaaaaaagtaaacagccaattgaattgccaataataaaaataggatgtggctatctcctatattttgccgtttatatccaaaataacttatggacatgcacaaaacatccatgaaaataaaaacataaccattaccttcaaaaatcaccctggaccctttacattctcacctctctccctgccagctatctggctcactgaagtcttgacctccggggctcaagtgatcttcccacctcagtctcctgactagctgggaccacaggcacacgccaccacgactggctagttttttttattgtctgtggaggcatggtctcactatgttgcccaggttggtctcaaagtcctgggctcaagcaatctgccaccttggcctcccaaagtgctgggattacaggcgtgagccaccgcacctagcctctatcataattttattgacagagcacatggttgtttaacccagtaagagtctatatactattcttgattaggcaaactttggctcatggaacaaattcattctcatgctacctgttttgtgaataaaatcttattggatcagagccatggccattcatttatacacattatacgtagctgctttcctgctacaaccacaaggccaatcgacagagaccatgtggcccatcaagcctgaaatgtttactatctggccttttacagagtttgctaatccctgttttagattatagaggatgtttgaatggtcaagtagagatgacaaactgatgattctagcactagaggggcgagtcgaggactgcagaaacaaaagcca

SEQ ID NO: 1874 - DNA, 4289 bp, Homo sapiens
ggggaggggaggcgcggaggccgagggacaagaggtggaggggggagaggggactgggggctaggggcccggggacggcaggacggaagaaagccggggaagggcgaggaggagcgttttctccgccaagcagcggcgggaggaggggctgcaggtgggaggaggcgcaggctgcgcgccgcggcgcccctgcggagaggggcagctaactgcagcacgcccggctccgctgcccgcgcccggcggggtcccgccgcgaagccccgtgcttaaggtccgggccgcccgcgtccgctcggcaggccctgcgccgcctcctactccgggccgcggcgtctcctgcctgcgcggggctagcgtgggcgccggggccgcaaccagcgcgcgccacgcgcgggggcccgcgggggccctcggggccgaggagctgggcgctcgcctgcaccgagccgcctcctcatgccgcgccgggccccggcgccccgcggccgccgcgggagctgagcacaggccagggcggcgtcccggccagcgacgaacgcgctccgactccggccgccgccagctgcctgcctggccgcaagggcggcagcggcattaccgccgcgcgcccggggtgaggcgcccccgccgggcccgcggacaccaggcgaagagcaaccgggcgacgcgcgctgcgggcagagccggggagccggaagagcagaggccgagcgccgtcggagccgcgtctggttggagaaagaggcggacgtgaaggggcgggggagccgcggaggaaaaccgggaccggcgggaacgtctcgagacccctgcgcgcttcgcgcgctcgctcggaactcggcaggcggcgctgcgccgggccccgaggaaacctggaggtccccgccctccccgcgcccgaaacaccgcgcgtcctgataggcccgcgcccagcagccccctccccgcgcccgccgcaccggggccccaccgcctcctgcgtcaccgccgcccccgcccgcccggggaccccgcggtgaccgcgctgctgggggttgagggacgcgttgcgagccccggatacattgtaccctgggggtacataatgaaggatgctgtacctgaaaggaaaagggcatctccaaaaggggacttcgcgggtggaatttccttccaaaatcctcgaggaacaaggtgtatttccgacctggattaatgaatcccccctcctatcccgcacttcctgtggaaacagtgtcaggatgtggcgcggacctatgtgcgtcccttataccaggacttgccttcaacgctgaaggtgaaccctgggtcatcctcgctgtattcaggcggcgctgcaaaggcttctgggcagccaataggcccttgagcgcctcagccccatcttgcttcagtaggcaaacggacgggtgtcttcatccacctcctaggccgtggtctacccttcgttcaaatgtttcttcctgctagctgactgtccaggtccttagctgtatcacattgttcaaatgtgtgtgcgcaggtgtttctttttcaactaatcatgcaggaagtggcgggatgccttactgccattatttgctgagtatttccagatggaactgtagttgatagccaataaatttggtacgtttttatcgggatgcgcatgccatagatcgtccctgagataatgctttgcaatgtggaacctgaaacacctatgtataagcccaagcctttcattaatattaactgtgagacccctggaagctactactttgtgtgagcctgttttctccgccctcaaacagtggatataatacccccttgcaaggctgtgagattaaatggataactgtgcataatgctaagcatggtgtctgggacgtaagaggttccttatatcccattagttcactaggtgggatcaccaagttgaaattcattttttaatattttgcttgttggagtactcacaactcaacttctctggctaatttgatgtttaatttgaaaggtaatgacactattttgtaacatttttagatgcttaagggaaatttgaaatgcaaagtggaacaacattaaaaggaaactcatttgtaaaataaagaaaaacaaaatctatgcaagccaaagaagtcatgaatgctgaggaagcaaaaattgtgattttcccctctccaatcccactgttcatttatctttatttgcatcagttagactggttgtttacaaagctaataccaccataccactagtcaaaagagagttccatacctttgctgacctagtggtagaccattcttctcaggcaaggttggctttttcaaaggaaagtttactataaactgagagagaagtagtaacattatagaatttgatgattcatctataagaaatctgaagactgtacagatgaacctagctggcatagatgactgccatcggtttctcccctaattttaaccctatctcttgatttctcttgttcggcaagtgtcccccacggtacttgttaagactgattagctctccccaggagtagacttttatctgttgtaccagaaaacaagcctagtcggtgcagccattgttgtgaggattaaattaaatgaattaatgcctgtaaagagcatgggagaggctggtacatggtaagcaccattcgagtatttgtaaaatatatttttagaaatctctccttgcagtcactctctgtccacagtaacaaatgatggttgtctctttctgcttaaacaccaaatttcctagtgggtcacccattaagtctgtctctcatagtctgagggatgcctcagggtctcagctcatgtttaaaacagagatagattaaatactcagtgcacaggaaatgctaactgagcctttccaaacccacaatatcaactgatatttcctcaggagccaagtaagccccataacagaggaatgaccttgcagaaatctaaaagtctattttttaatgccattaaaaagatcttaatcctgtaatagtgagacataacttacaacagtaagacagaaataaattttatttaatggctttgttctaagtttattaccaccaagtattccttttattattttctgtccactagggacaccgtgctcttaaatatttgggtatcaaactgaataaattaaatcataattaatggttttctagttgtattaataagaagtatacacagattgcaactgaaaaaagaaaaatgtacttgttaatgagatggatgatattttacttagtctgtgctgactgagtgaggatgaacaatatacactgtgttttgaatttgcttgtgagcatggtaaaataaaaatatctaatttttttcagtgaattggggggaagaaatgaaagaaaatagtgtatagaatctcttttatggtagctaaagattcagatcttcatgttacaatcactgattaaaaatagtaattatatctgtttaaatgcatagtctcagcatctgagactcagctaaagaaaattattgggttgatgaattatgcttagacaattgaatttgtatttatataattgtagatcatataaaagacattggcatgattcataaaatggaatatttatatacatataattgagtgtatatatatatacatatatatatatacacacacacatatgtaattccaaaatgttgtggtacagatacttctcaaaaatttgtattgtgaatatgatcagatctctggtgagaaaaaagatattggtccctgtatcttatttagattatataaaagaaattttaaatgtcttacatttcagaacaaatatgatcactttaaagccaaattttaataattctatatatatgaaataatatagaactgtatgataattctgtattgtagttaaaattttaaaagaaaaccactgtagtggtagcagccctacttcagcatttgacccaaatttcttactaatctcaaagtgcctgaactctttgatcttagatccaagatcattctttcacatcatgcaaatgtcctagcattttcaagcattccaaccactttgatatcattttcacaacatccctttggggttggtatggcaagtattattatgtccttctgagatgaggaagccaaagctcgggaggtaaaataccgggcctgaggtcacacagtataaaggtagcagagctgggaagaaagcccagatgttatcagcctacttcagtgcccttactacaaaccacaccagctcttatcttcacacacattattttgcctatcagggtaagtgtttt

SEQ ID NO: 1875 - DNA, 4289 bp, Homo sapiens; identical to SEQ ID NO: 1874

SEQ ID NO: 1876 - DNA, 4289 bp, Homo sapiens; identical to SEQ ID NO: 1874

SEQ ID NO: 1877 - DNA, 527 bp, Homo sapiens
gggagagggagggggccggccgcagggtgacgggtggcagcctggggctgtgcagatgtgggtggctgagaagggcactagggtgggggtggctggaggaattttaagtgctgtgatgaaatgggcacccttctctgccctccatcgccaagccctacacctctgcgaagactgtgacacataaagtcctgtgtcaacggttgatctgtgcccgcagagagagcctgctccagcctctttgctacagccttgagtcttctgctgtgataggatgctagagaggaaaatttggaattagcttttaaaaggaagagaaatgacggtgtaaccatctgccaaatacatggaaacaacaacaacaaaaacctcatcattcacctggcctggcaaataggaggagaaatttcttccagagacataagcaggaggaagctggagctctctcctgagtgattgtcagttgcagaggaggtgaatatcacaggacaagcaagcgtgggggagaagactgcctagacattctaaag

SEQ ID NO: 1878 - DNA, 2715 bp, Homo sapiens
cttggtattttcagcagtttcatagtgattctcaaacatccttcaagtcttataaagtgcgattaagccccatcttttccaaagtgtatgtatgattctaagaactttacatttatccatgttaaatgtcaggcctctgggcccaagcctacatgcatacatccagatggcctgaagtaactgaagaatgacaaaagaagtgaaaatggccggttcctgccttaactgatgacgttaccttgtgaaattccttctcctggctcagaagctcccccactgagcaccttgtgaccccccacccctgcccgccagagaacaaccccctttgactgtaattttccactacctacccaaatcctataaaacgtccccacccctatctcccttcactgactctctttttggactcagcccgcctgcacccaggtgattaaaaagctttcttgctcacacaaagcctgtttggtggtctcttcgcatggacacacgtgatatttggtgctgtgactcagatcaggggacctcccttgggaaatcaatcccctgtccccctgctctttgctccatgagaaagatccacccatgacctctggtcctcagaccaacaagcccaaggaacatctcaccgattttaaattgggtaagcagcctctttttactctcttatccaacctctctccctatccctcaacctctttttcctttcaatcttggcgccatccttcaatctctcccttctcttaatttcaattcctttcattttctggtagagacagaggagacgcgttttatccatgaacccaaaactctggcactggtcatggacttgggaagatagtctttccttgctgtttaatcactgcagggacacctgcttgattattcacccacgtttcagaggtatctgatcaccgcgcgaatgcctgccttgatccttcacccttagtggcaagaaccactttcctgggggcaagcacccccccaccccttctctccatgtctctaccctctcttttctctgggcttgcctccttcactataggcaactttccaccctccattcctccttcttctcccttagcctatgttctcaagaacttaaaacctcttcaactcacacctgacctaaaacctaaatgccttattttcttctgcaatgctgcttaaccccaatacaaactcgacaatggttccaaatagccagaaaacggcactttcgatttttccatcctacaagatctagataattcttgtcataaaatgggcaaacggtctgaggtgcctgacgtccaggcattcttttacacattggtccctccctagtctctgttcccaatgcaacttgtcccaaatcttccttctttccctcccatctgtcccctcaatcccaacccatctgtcctctcaatcccaaccccaagtgttgctgagtctttccaatcctccttttctatggacccatctgacctctcccctcctccccaggctgctccttgccaggccaagccagatcccaattcttcctcagcctctgctcctccaccctataatccttctatcacctcccctcctcacacccggtccagcttacagtttcattccacgactagccctcccccacctgcccaacaatttcctcttaaagaggtggttggagctaaaggcatagtcaagattaatgttcctttttatttatccgacctctcccaaatcagttagcgtttaggctctttttcatcaaatatgaaaaacccagcccagttcatggcccgtttggcagcaaccctgagacgctttacagccctagacccagaagggtcagaaggcctcttattctcaatatgcattttatcacccagtcagctcctgacattaaaaaaaaaaaaccaaaaaacaaacaaaaaaaaactccaaaaattagattccagccctcaaaccccacaagaggacttaattaacctcgccttcaagatgtacaataatagaggcagccaagtagcaatgtatttctgagttgcgattccttgcctctgctgtgagacaaaacccagccacatctccagcacacacaaaaacttcaaaatgcctaaactgcagtggtcaagcattcctacaggacctcctccatcaggatcttgtttcaagtgccagaaatctggccaatgggccaaggaatgcccgcagcctgggattcctcctaagctgtgtctcatctgtgtgggaccccactagaaatcggactgtctaactggcctggctgccactcccagagcccctggaactctggcccaaggctctctgactgactgcttcccagatcttcttggcttagcggctgaagactgacgctgcccgatcaccttagaagcctcctggaccatcacagatgctttagaagacaggaatgtcaggcctctgggcccaggcctgcacgtatacatctagatgacctgaagtaactgaagaaagacaaaagaagtgaaaatggccggttcctgccttaactgatgacgttaccttgtgaaattccttctcctggctcagaagctcccccactgagcaccttgtgaccccccaccgctgcccgccagagaacaaccccctttgactgtaattttccactacctacccaaatcctataaaacgtccccaccccatctcccttcactgactctcttttcggactcagcctgcctgcacccaggtgattaaaaa

SEQ ID NO: 1879 - DNA, 2712 bp, Homo sapiens
cttggtattttcagcagtttcatagtgattctcaaacatccttcaagtcttataaagtgcgattaagccccatcttttccaaagtgtatgtatgattctaagaactttacatttatccatgttaaatgtcaggcctctgggcccaagcctacatgcatacatccagatggcctgaagtaactgaagaatgacaaaagaagtgaaaatggccggttcctgccttaactgatgacgttaccttgtgaaattccttctcctggctcagaagctcccccactgagcaccttgtgaccccccacccctgcccgccagagaacaaccccctttgactgtaattttccactacctacccaaatcctataaaacgtccccacccctatctcccttcactgactctctttttggactcagcccgcctgcacccaggtgattaaaaagctttcttgctcacacaaagcctgtttggtggtctcttcgcatggacacacgtgatatttggtgctgtgactcagatcaggggacctcccttgggaaatcaatcccctgtccccctgctctttgctccatgagaaagatccacccatgacctctggtcctcagaccaacaagcccaaggaacatctcaccgattttaaattgggtaagcagcctctttttactctcttatccaacctctctccctatccctcaacctctttttcctttcaatcttggcgccatccttcaatctctcccttctcttaatttcaattcctttcattttctggtagagacagaggagacgcgttttatccatgaacccaaaactctggcactggtcatggacttgggaagatagtctttccttgctgtttaatcactgcagggacacctgcttgattattcacccacgtttcagaggtatctgatcaccgcgcgaatgcctgccttgatccttcacccttagtggcaagaaccactttcctgggggcaagcacccccccaccccttctctccatgtctctaccctctcttttctctgggcttgcctccttcactataggcaactttccaccctccattcctccttcttctcccttagcctatgttctcaagaacttaaaacctcttcaactcacacctgacctaaaacctaaatgccttattttcttctgcaatgctgcttaaccccaatacaaactcgacaatggttccaaatagccagaaaacggcactttcgatttttccatcctacaagatctagataattcttgtcataaaatgggcaaacggtctgaggtgcctgacgtccaggcattcttttacacattggtccctccctagtctctgttcccaatgcaacttgtcccaaatcttccttctttccctcccatctgtcccctcaatcccaacccatctgtcctctcaatcccaaccccaagtgttgctgagtctttccaatcctccttttctatggacccatctgacctctcccctcctccccaggctgctccttgccaggccaagccagatcccaattcttcctcagcctctgctcctccaccctataatccttctatcacctcccctcctcacacccggtccagcttacagtttcattccacgactagccctcccccacctgcccaacaatttcctcttaaagaggtggttggagctaaaggcatagtcaagattaatgttcctttttatttatccgacctctcccaaatcagttagcgtttaggctctttttcatcaaatatgaaaaacccagcccagttcatggcccgtttggcagcaaccctgagacgctttacagccctagacccagaagggtcagaaggcctcttattctcaatatgcattttatcacccagtcagctcctgacattaaaaaaaaaaaaccaaaaaacaaacaaaaaaaaactccaaaaattagattccagccctcaaaccccacaagaggacttaattaacctcgccttcaagatgtacaataatagaggcagccaagtagcaatgtatttctgagttgcgattccttgcctctgctgtgagacaaaacccagccacatctccagcacacacaaaaacttcaaaatgcctaaactgcagtggtcaagcattcctacaggacctcctccatcaggatcttgtttcaagtgccagaaatctggccaatgggccaaggaatgcccgcagcctgggattcctcctaagctgtgtctcatctgtgtgggaccccactagaaatcggactgtctaactggcctggctgccactcccagagcccctggaactctggcccaaggctctctgactgactgcttcccagatcttcttggcttagcggctgaagactgacgctgcccgatcaccttagaagcctcctggaccatcacagatgctttagacaggaatgtcaggcctctgggcccaggcctgcacgtatacatctagatgacctgaagtaactgaagaaagacaaaagaagtgaaaatggccggttcctgccttaactgatgacgttaccttgtgaaattccttctcctggctcagaagctcccccactgagcaccttgtgaccccccaccgctgcccgccagagaacaaccccctttgactgtaattttccactacctacccaaatcctataaaacgtccccaccccatctcccttcactgactctcttttcggactcagcctgcctgcacccaggtgattaaaaa

SEQ ID NO: 1880 - DNA, 5614 bp, Homo sapiens
ttgttactgtgggaactggaggtaacagtctacagccatggtcgccccgcagcacgcccacgcgccgcgccacgccgcgccccgagccgcgggctggggacgcggagcagaaggaggcgggggcggcgagtcaagatcccacgtgcccgcgcgggtggcaggaggtgctgcgcagggaggcggcctcccggggccggcggctgagtccaccgaggctcgagcgcgcgcgtcctgcggagtgcgtctggcggccagcctgaggccgtcctgtcctcccggccaaggtatcccagccagggctcggcgagagaaggggtcgggctgggactcgggttctttcgatttcggtgagagggaagccactgggaccaggaggcttggaaggaggtttgtctcctggggcctgaagacagtagagggaggaaagttttctgagatactccacagccccgttcttccaggaacccctagctgaagtgggcattgggcgaagagtaaactcttgaatctttccctctgagctaggaggataagaagggtccccaaccctctggaagccaatgagcttgtaaagttaacctggtccgcgaagcgtctgaacagatcagcctgctcacctcagcctatctctaggtgctggattccaatctgagacagtttctcaaattagccctaaagaggagtgaataccacaggggctgaagtcctctggtgcggatgaagtgtgaacaaggatctctaaaaatattattgtatatgtcgcctgcctctgccaacatcacccactacaggggatgtctattgaatatcaggtgcactgtgaggattaaataggatcatgtaagtaaaaatccaaaaacagcagaatgttattttgatcttaagtattctgttaggctactacatgtttgtgaaggggtggtgttgggaggggaccccagctctgtgcacttaggcagaatgaacgggatgtggggggtacaccttgagctttaggctatatatatttattgtctaatatatatataatctatattatatatatgttatacatacatatacttttattttttttcttctgagacagtctcgctctgtcgcccaggctggagtgcagtggcactatctcggctcactgcaacctccgcctcccgggttcactctgggcctggggctgttgagaggttccttgctaagggggttctctctcctaagagctctaggaatccaaggtggaatcagaggtggaaaacagaaatggttgggatattctgagaagaggtcagaatgtggtcagaggggaaagaaccagaggattgaccgtacgtcagggttgtttagcatcttagaaatcatttagggcagggcacagtggctcacgcctgtaatcccagcactttgggaggcataggtgggaggatctcttgagcccaggagttcgagaccagcctgggcaatacaatgcgactcccatctctacaaaaaagaaagaaaggaaagaagaaaggaaagaaaagaaagaaaattagttgtgcacacctgtagtcccagctacttgggaagttgaggtgggaggattgcttgaggctgggaggttgaggctgcagtgagctgtgattgcaccactgtactccagcctggatgacagagtgagaccctgtctcaaaaaaaaaaaatcattatttagggctgggagacatggctcatgcctgtaatcacaccattttgcggggcggggcagaggctggaggactgcttgagcccagaaattcgagaccagcctgggcaacatagtgagaccccatgtcttaaaaaaaaaaaagccagtgtgataggtggcacctgtagtctcagctaagctactcaggaggctgaagcgggagggtcacttgagccgaagaggtcgaggctgcagtgagccatgatcctgcacctggtgacagaggtagaccctgtcttaataataatccagcctggccaatatggtcagactccgtctctactaataacacaaaaaattagccagccatggtggtgcttgccagtaattccagctgcttgggaggctgaggcactagaatcacttgaacccaggagacggaggtgcagtgagccgtgatcgtgccactgaactccagcctgggtggctgagtgacactccgtctcaaataataataataataatggtacctacctcatgaagttgtgagattaaacatgaagttgtaaggtttaagctatatatatttattgcctaatatatataaaatatatatgtgttatatatatataattttatttgtttttttcttctgagatggagtcttgctctgttgcccaggctgaagtgcagtagcatgatctcggctcactgcaacgtccgcctcccaggttcaagcaattctcctgtctcagcctcctgagtagttaggactacaggtgtgtgccaccacccccagccaatttttgtagtttgtttttttttctttttttttggagacagggtctagctctgtctcccaggctggaatacagtggcacaatcacagcttactgcagcctcaaaactcctgggctcaagtgatcctcccacctgagcctcccgagtagctgggaccacaggtgcatgccaccacacccagctaacttttaaattatttgtagagagggggtctcactatgtttcccaggctggttctgaactcctgggctcaattgatcctcatgccttagcctcccaaagtgctgggattataggcatgagcaatcgcacctggccctaaattaggccgcattaaagctcttgcttattacaatgtctggtatacagttattactcaataaatgctcttctggccgggtgcagtggctcacacctgtaatcccaacactttgggaggctgaggtgggcgaatcacttgagatcaggagttcaagaccagcctggccaacatggcgaaaccctgtctctactgaaaatgcaaaaattagctgggagtggtgatgcacacctgtaatcccagctactctggaggctgaggcaggcggatcgctcgaactcaggaggcggaggtcgcagagagcggagactgtaccactgcactccagcctgggtgacagagcgagactccgtctcaaataagtaagtaaataaataaatgctattcctatttctatccttcagacctaattttcctttgctataaattgaaaatgtttaagcagtgattgttctggggagcttgctcccctccctggtgggttgcaagagagtcacactaggggtttttcagataacacaccctcacccgaggctttcattcaacccctaaggcagtggcttttcaaatccctgcttgggaatgatgggggcaatttgccaaaatgcagattcctgggtcccagtgattctgactcagtacatctggagttggccccagaattcaagttggttttttgagatggagtctcactctgtcacccaggctggagtgcagtggcacaatttcggctcactgcaacctccgcctcctgggttcaagcaattctcctgcctcagcctaccaagtagctaggattacaggtgcatgccaccacgcccagctacttttttttttttttttttttgagacagtttcgctctcgttgcccaggttggagtgcaatagcgtgatctcggcttaccgcaacctttgcctcccaggttcaagcaattctcctgcttcagccttccaagtagctgggattacaggcatgcgccaccatggttggctaattttgtatttttagtagagacagagtttctctctgttggtctggctggcctcaaattcccaacctcaggtgatctgcccgcctccgcctcccaaagtgctgggattacaggcatgagccaccacgcagggccagaattcaggttttaaccaatgttctggatgtaaatggtacacagaatctgcgtattgggggtggggaggggcacaaccccctaagagtctctcttgctcctggacggcatgatgggaagtgacctgttccacttgtcgagaactagtggaccccatgtttccctctagcttggacactatggttctcaggaggaatcctcacccccggccaggagcccttctcctccacctactactgctgggctctacctcccccacttttaattttaagccttggctcaaaattcactccccaatatttctccccttctctctactttcgtcctcaataatcccaagcagctggggtgtacaagtcgttttcacctcttgggaccgtgctaaagggggcagcctatgattaccatgagggtatgggagccctgaactgcaaatctatcatttccagagaagccagaaatctgaaattttctgtgcaatttctgaaactttaaatcagaattttttctaaaattcaatgggtcagataccacagtctgtgtaatcaatccattccaaagtctcctccttttgctaaaggagaagattccttaaaacaaggcagaagccaactgaagcaagggagaaccacctcccacccctccccacacacactttccacacccagtaactaggtctctgggcggataattctgttttgttttgttttttttaattttggacagctaatctctgtagtgaggaacccagaactttcggtaatgtaagggatattagtctggttgtcagaaaaatgggctggagtatttgtgctgtgtccctgaccataattcctgctcagttgcttagctccctggcaactatgtctgagggctaaacaggagttggtgtgatcttccagaaaaagaacaggcttcttgtcttgcagaggcaggaagtcagaaaacaagagtgtgtgtgtgtgtgtcagggggtggggggtgtcaggcctccttcccttcagtttgggacttaaaacttccaccaataacgtgagtatgtgcacccatgcagcagcctgtccgaggactcacaactggagacacctccctgcttggcgctgcccagaaaactatgtagatggccaagaaaccgacttccattataaaatgtttttctgtgtgtaccaggaaaaagatgctcaaaatccaaatcaccactttattatgtggcagtcaccatggtgccagcctctgccttccccatgtcaccctcctaatccagggctctccaaccatattcatgtttgcgttttcacaagtcaatgtccattaaggccttgtgctccccttttcttcagtacagggcagggcccttataatttgggtctcaagaattgatagttgtctcttaactggttctggtgaggcgcactcacagcagtgagtggagggtcctgggagggcatggatgacggaggctgcccctagaggagctggatgtaggagcagagacatttcttgatctttcactctgcaaactggtccaagaacttgagaggggatgactttgtcagtgtccccaaaaacatggagcgaaggcaatgacaagggcctttgcaggatggattccttgaacccaatgccccggggacagaaaccagacaccaagaggataaaccgtggcaaggggaagcggggatcgcctgcctggcccagggcacacac

SEQ ID NO: 1881 - DNA, 949 bp, Homo sapiens
gctccttgaaccctgaacaatgggctatgaaagaatgaatctaggcccaggcctcgggcccaagagctgggcgctggccctcgggatcctcccacagccaagccaaggttgggcctgtggatcctgcagaaggggccagggagcagcaaggggcccccagagggagctggctgagctctaggcagtaaaattagactccgtctagagactgcctcgttcagtggaaggctgagctgcagcagacattatctcactcctgctcaatgtcccctcaggcaggggctgccgcactacctgcccgctccaaggccctttggcaggatgccctttgtttgcagcactcccaccctcggggcaccgtgtggcatgaggaagcacaggctgcctggcccatccctgcctgggaggacatctcacgagtgcttctgctaagtcaggatgaaccggattggggttgggcaggtggcaacacgctgctatttatggaggctcctgcccttcctgctcctgtgattccaggagggcgagggctgcggccatccccacccggtcacgggactcggcccatccagagagccaggctagagccacgaccgcaggcttgaaggctaggagtctgcacagagagaccacgagaagcagcaggctgcaggggagagccctggctcagacaggagactccaggggaaccagctagcccggcctctgcccactcctggggcctcatctgttcaatgagggggttggattaaaagagatcctctcacttcagagttcctccactgtcattagtctgggttccccgactcccgatccctccattgctcctctcattaaagtccattctaattaggggattagaattcacctctgtctaaattaaaggctgggcagggagtgatggcgggccgcaatgaacagaggttgtgcaggtgcagatctgggctgg

SEQ ID NO: 1882 - DNA, 949 bp, Homo sapiens; identical to SEQ ID NO: 1881

SEQ ID NO: 1883 - DNA, 1176 bp, Homo sapiens
tcagaggaggacgggccatggaaggagttgggactttcccccttttggcccttggcaccttcatcagaacttagcctgggactcctttctccgctgacctggggcagccagtcttgcaaccaaagccctctgctgaaacgctccgtgcagccctgtctactgagggctcaggatcttcaccttgctacttgaccagtcctgggactccatcctcagctcactacaggcaacacccttcaaagcaagatccttgcttcaatgggacctcagatttggacattcaggtttctggggctccactatgcacagctggggcttcccccaccagaccaagattctcccttccctgagaccctccaggccgaaatgacagtcacctcaacctgacagctcttcctgagcttcccaagtcacaggagaggcttttggttttggaccatgagaatggcttacatattcaaaaggttggatttgggaagcaatgctaagcagtggaatggacatcgacatagagagatcagctccacacttatactctgccactcaacttccccatgtgacttgaggatcactctaactccaaaacatagcaagctcgcggaacatcagggttcatgcaaagtattccaaggagccccttgaagcaacagaatggattgctcttctatggtggaatggcaccctggatgattaaaaccgtagcagcaaacaaaacctccatcaagtaagaattcagagtgtgagatatcacgcacagccacgcgtggatctttatatacgtgtcaatgtgtttgattgtatttttgctttcaaagtatgtattgagcatttcttctaggtcctcagtaacatctttttaaaaaaaaaataaatgcttagggaattgttttatattaaactcgcttccattgttatcaacttggagagtgtccctcatacatggagctctctcacaggattgacttttcatattaggagtgtaaataaaagttgttccttggtttgtgtattacagatattcctgaaaacagagtcaagttatatttctaaagtactagcgtctgcttaaagaaatgacaaggtgaagtctttcacaaagtaagcattcaatgtatgatttctctgctatgtaaatctggttgttcatacagtttctatgacataattggccacgac

SEQ ID NO: 1884 - DNA, 3659 bp, Homo sapiens
gagaggactttcattttattttggatcaaatgctccacaactagttgaaactggaattaaattttatatgaagttcctagatgatttaaagctgtaagaagaagaataatgaatcataagaaaacttgctgctacagatatcaaaaaggaatgttaccatccctcatgctaatccttttcattttaaataaacaggatctaaaaaaaataatgctgggaagtcctaaccacatcaagaatgcctcagatcagtgacccaaggaaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaataaaacaagagatatttaagattcattaagttcttgtcatttcaaattttaacaaaaatattttctaatggaattacatatatttgtatgattcttctagttatatccatggtaataaacactcttttcagttggaaataaaacccatttgtgctatattattagggaaaatatctacataaattagtttttaatttaactaaagtctatcttttgaattcataagcataaaattttaaccacttgcaaaatttataacacacttaaggtagtcagatgccttgtcaagtagtttaacaaaagtgattttcacctgtttgttttaataagagtgcatcgattttatgaaaatcaggcatgccctcgggtcctaacaaagtatacgaagctgaatggatctatgccaaatatgccagattttactttctgagtctgattttatacttctgtcctctttcttaccacatggcttccagtatcacttacagactaacccttcaaaaggagaaggctaagttactaacatttggaaggcttatgaaagtgaagcatagttatgagccagcaatgtttttatttagggaatgtgtgcaaaccatacacttaagcaagctctggggaatgagagttggggggaatcaactcttttatttgctaattggtatttcctttaaaagatagagttcttccagattttaactgtgttaatagttactctagaaaaattggagatttgtgtgcatatattttatgttgtaaacagacacatacccagagacacttagagagacagacagtaaacagaggagcactaaccacaaacggtttacaaatgacctctgtgctcattcacctgtctgttccccaccttgccttttatagcaactatagcaacagccatgagagtcattgtggaaagaaataaaataaaattaaaaaatcctggaagcttgtaaagaatgtgagcaaaggggaggaagttgtgaaaaaaatgaataaagggcaccgatccagagtattgaagaaggcagagtggagagcctagtaatgagtatctggtacctcagtatcctctcccacagaatctgtacagctctccgtttatgacagtttaaacttaatttaaattatcaaacagacactttcctcaaacatataaatgatgaggcagttcattcaggctgtatgtataaagttgttccagccacctttttctaatggcttctctatatcttttacatggagacaatgagagatttgcttaggacaatttgactgtaatttagaagtaggaaatgggaagtatttgtatcttctttgcctaactcacattagttactcaagtaagcatttcttccgttattgcattttcctgattacaagttttatgttttctctaaaacacatatcaaaagaaatgtcctaagcactatgcagggggaagccatgacatttatccaccactgtcagcaaaaacatgaacttagccctcaacagaatatttcacttcattctagtgtcacctctgcgtcacctgcactggagtcaccacttgcctgttgggtaagaccaggatgcaccgctgaaataaaaaggggtcagacaacacaagaaaagccagtagaaattgccaaatgtatcagaatacacacaggctttctaaggatatggcccaagaggaaggctctagagcccaccctgaaacaggatttttgacttcacagataaattatttaattttcaataacacaattcaattaaagaaagggaaatacaaggctaaacaaataagatatgaagacaaaaacccaacctttcaaatctaaagaaaataatctgttttaaagacacagatgaagatcaggaacccaaaacagaagaaaggaaaagcaattaacgctggcatctgataacaacgaaaagtatggagtctggagaatcgctagactctaaaaattataaaggtttagacttggactttgtacactgaagaaaagaaaactgcatgcatttatactgaccaatgtacactattgctgctttttaacttttgtgtatatgtagggtagatttttttttaagtgaaagcaagcttattaagaaagtaaaagaataaaaaggtggcttctccataggcagaaaactagcgtagtttttttattagaaattgttattcaacaatagtacatgttacaaataaataccattttaaactgaaaaaattgtagactttcaaatcagttagggtggtcaccctaaaaaagggcattttttccccttagtctccttgttcatgttgctcacaacaagaaatgggctaatgctatgaataataataacaaacactgccttctgtcaggccctgtgctgaataccgtctgcatatgtataggaaagggttaactcagcaggtcttgtttgcccagactctgtacatttccaagaaaggtctgcctttaggactggtccttggccagctcctggagaatgagctctcagcttttagaaaattctatctgctaagaatagttttgcatgtctcaggtcttgggccacaaaatatcagtttaatcagatggtttatgttaacaagtatgatttatggcaaacatagatctctaatctccatttctctctcatatatctatatttatctatccatatatatgtacctatatatatcaaatatgaagatatgtttatagcaattgcatatacatagagagatagtatgtagtaggaagagagacatagatattattcttcattttagaatgttatcttggtatgtttaaaaggaaaaacttaagatgtgttgcaattgcagtatgagtttcaggtatgtacatgttatgtgtgtgtgtgagagacacacacaaacacatttcaaacatgttttatgtttaagctcaatattcaaacacagaaatataacatctattcttaatatgttttatgtaagtacagcagcagcattattaaatactgtatttctatggtgattgaaaattagtaggcagagaatttttgtaatggttcttaataatttttgtaatagtaaatgattactttttgtttagtatagttttataatctatacatgaataaagtggatatttctattcatatagaaatgtgatttactctcatgtacttatctacatgctaaaaccataagttatcaattttagttctgtgccaaggcacttttactgaataaaaataatcagctaattttatat

SEQ ID NO: 1885 - DNA, 616 bp, Homo sapiens
gtaggcacgcagcaaactctcatcaaggattatgcctgatacgtcatcggttctctctcctttacagatgaggagactgacgcctggggttcccagaagtatctgcaaattgttggagtttcagcagggaacaagtgttttggacgagggtgtctctgaaatcccttccacctgcaccccgcccccactgcctcctcccagctcgggcctccgggtctccagttgggccctcatgttgctccttcctgagtctgacaagtaagcctcacagctccctccgcctgcctcttcgtgtcactcggccgtgcagagcaacatggagtcctaatgatttccatcccgtctgtctgctgcagtgggtttgagcccacgggtggcaggtaaggcccaggtcacctgtgcccctggaaccggcacagggtgcttgtgttggccgcaatgaacgtgggcaggggcgtgtgccgtgagtgcccctgccgggagctgctctgagctttattatctgtgagtctgcacactattcatgaggagggcagggcagggctgaggtcctccacaggcggcctgccttgttcctgcaggccagggtggacacaggcgtgtgtctgcatgggcc

SEQ ID NO: 1886 - DNA, 2265 bp, Homo sapiens
cgaggacttcccatatccccggatggaaactcccccagttctctcccttggcaattgaatggtcaaggggaaccggactttgtaagaattgggaatctaaattagtgcaatttagacctttgtgcgtgaagtgctgcagggaattccagtcagcaaaggagacgctgaggggatctcccagagtggatggtgtttccttactgcttataagataatgtgtcaagataggggctggttgcatcctatgaaatgcagggaaataattcattttaccaaaggctaagcctaaaatactagaatttgcaacccctaccactaaaaatgaggctcagaaatttattggcttgtttggattctggagacatcatattccccacttgggtaacatgttacaacctctgcatgcagccaccagaaaacgctatgactttggggagagaaagagatcatggcttccgaacaagataaacaagcagtgcaactggccctggatctatgacccatttgggatggtcccgtagaactgcaagtaactgtcctagatcaacatgctaattggagccttaggcagaaacaagatgggaagaggtacatttctggttttggacccagaaactgccagaggccagcaaagcttataaccctttcgaggagcaattgttagcttgctattgggctttgctggaaacgaaacacctctgcttcaaccatgatgtctttatgaggcttgaaattcctattatgacttgggtcatgagttcccccgaaactcaccagatagggcacgccaagggggagaactgggggagtttccattccgggatttgggacgtccccaagtttccagccttgggctccagagtcagacaccgcactctccaggctggaagattctccaccaggccaggaagcaacagcatgggttccagagtgggacacccgcactcaccagactatgaaggactcaccaccagaccaagaagcaacagcctgagctccagagtcagacaccaccctcatcagactgtggaggattcaccaccagacagggaagcaacagcctgggctccagagttggccactcgtccgtgcacagacgaggagaggtctcatgaagcttcggtgcagtctgggaccacagctctttagtaacgagttgtttggcataaagcccagtcacagggctcttcaggacagggcttaaggaacacaaaaagggcctgaggggcgggacctaaagcattatccaatcagagacgctgggctggaaaccgtccaatcaggcacgcagctggagcgacgaggacggctttccgcttttggcgcggcctttgtctctagctgcagccggcgtttcaggtctcgtcttcactggtctgtgtcctattctcctggaggcccagcctctgtggccctgtgacctgcaggtattgggagatccacagctaaaaccccaggacaccctggaagcatagaaatgtctccctctgatgccgagccgaagctggactgtactgctgccatctcggctcactgcaacctccctgcctgattctcctgcctcagcctgccgagtgcctgcgattgcaggtgcgcgccgccacgcctgactggttttcgtacttttttggtggagacggggtttcgctgtgttggccgggctggtctccagctcctaaccgcgagtgatccgccagcctcggcctcctgaggtgccgggattgcagacggagtctcgttcactcagtgctcaatgttgcccaggctggagtgcagtggcgtgatctcagctggctacaacctccacctcccagccgcctgccttggcctcccaaagtaccgagattgcagcctctgcccggccgccaccccgtctgggaagtgaggagcgtctctgcctggccgcccatcgtctgggatgtgaggggcccctctgcctggctgcccagtctgaaagtgaggagggtctctgcccggccgccatcccatctaggaagtgacgagcacctcttcccagccaccatcccatctaggaagcaaggagcgtctctgcccggccgcccatcgtatgagatgtggggagcgcctctgccccgctgccccgtctgggatatgaggagcgcctctgcccagccgcgaccccgtctgggaggtgaggagcgtctctgcctggccgccccatctgagaggtgaggagaccctctgcctggcagccgccccatctgggaagtgagtagcatctccgcccggcagccaccccgtccg

SEQ ID NO: 1887 - DNA, 5819 bp, Homo sapiens
agataaccacctttcactgtaactttccactgcttaccccagtcctgtaaaactgccccacccctatctccctttgctgactctcttttcagactaagcccacttttacccaagtgaaataaacagccttgctgctcacacaaagtctattggtggactctcttcacatggacacgcttgacatttggtgccttgactcagatcaggggacctcccttgggagatcaatcccctgtcctgctgctgtttgctctgtcagaatatccacctatgaccttgggtcctcagaccagcccaagaaacacctcaccaattttaaatcggcatatttaacacatcatttgactacctctggattccatttttttatgaaaagcaacctattaataacgctgttgttaccctaaacataatgattcctttttctcttgctgacttcaagatttttctttttctttgaatttcaaccatttgttcaaaaacttctgaagaatcttgtgaactgtgtctcaagattacctactggggaatggaagacagaagtatttgtcctttaacctttggctgtcattgatccaaggtgattccattggacatttctttcccaatacttttgggtgcacatgcataagggctggcatgttcaaaagagcaggaagtgagaagtatgttttaaaatcccaaagaaggtattgatgcacctgtatcaagccaatcaaaactttataacttgtcaccacaacaatggctggagtaagaggtaaaatctgaaagacttgaaaagctgcacaagagtcttctgatataaagacataatgaaaacttaaacagaataatataccatattcatggataggaatatcacaaatatgttatttttttccaaatgaattcatagatttgaataaaataccataacacttctatagtatgctttgctgaattgacaagctgactttttttatttataagaaggaaaaaatatcaccacaaagaaaaggaattctcctaaagaaaaacaacaaactggagagactataggcataaagaataagtaaaagtctttggggaattcatatatggataaattcaatacttgaacaaaattaatggcccaaaaagtagactcatacatgtagaggttataatataatttgtttacaacataattggcatttcaggcccattaatataacataacgtctacgttagtgtataataaacacagtacagtcacctgtacataaatggtgtggggacaatagattttccatatgaaagcaatgaaatgagatcttataccctaaataattaaattataattggattagagactcaaatattaaaggaaaaattaaaaatcatgtcattataagaaaatatatggttgacagtgacaaaagaaagaattatgtaaactgaatttaaaaacaacagcaacgacatagaccatcaagaaaaatatacgtatgtatgcaattacattaaaattaaggagttctgtttattaaaaggcttcataaaaaagtggaaagtcaagccacagacctgaagggaaaccttagaaaacagatgaattaccaaaagactactatacagaattcgtaactcccatggatcaataagaaaaaggcaaacaaaccaatagaaacattgtcaaaaaacatgaaggaaacaaaaatggtccattatattgacttaaaaatctactaacaaattttgattcagagtttgaaaaacactagtctagaccagataactcacagatttgaagaattagtgtcaacagaaacatgctgtttctttatactgtatattgtttatttgcaatgccagaatatagatagcatttccaaaatatttttttagtttcaaaaatcacaaaattgatagatgtatttaagaaattcaaacaataaaaatatatgtaataaaatgttcaccccttgctttattcttttttgccttcaccccctccccagaagtaactttggtatatttattgaggtgtgtttcttaaatacttttctactcacttacaaacacatatgtagtgtgttttaaaaaataattataatatcatgattgctattctgcaaccttctttactcacttactgacacattaccaacctcttttaacagtagtatatttactgatgtcatcaaacctgaggtgttttgatggtattgcattcatattttactggaaagggtcagcacaagatttacccaattgcatcattttttaaagtgagtctttatcttatttgtatttgcatattcaaatctttatgcaaatctattagatatctgtctcagcaataatttgaggcatatgttccagcgaattctgcaataccctagaaagcaggttttccaaagctggaaaattttcagacggtattgttagagaaagacagcattttctagaggtgtatttgattatttgattttctttttcttaaacaacaactattcaaattaaattcacagatacataatttgtcatgcagatgataaaaactatattgcctagagcttggatatgtgaatcaggagctaaaccaatatgtgaaaacacattagagaggctatttgatggacttctgaactgcgaaattcaacaactgtgctgaactattagcttgaaacatgcacttattcaattttgccttgaaatgaataaagagccatctccttatatatgtacaataagagactgaagctacttgtacttatttctaaaacttaatttcacttgagaaggaaaataaagaatgaatcaactctttcaacaagaacacatctgcttttgtggtacttactaaatgtataacctaccttttctataaatttgaatatttcactttttgcaacttcctgaaaaatagcaatctgatctatctatgctgactttaatgttgcctcttgacacttgatactttgtcaaaattcagctaatatgtataataaaaatacttttagacctggatagcgataaagggttacaaaactgcctagcataagagttgaaaccacctctcccatcctttcatttggcagatgtggatgatgacagctgagtgcagatatgcctcaaattcttctcaaggcagcacttcaggaggccccaactgatccatcagagttagcctgtgagataagatttactggccatccccgaagctgctaaaactctgctatcaagtgacctgtgaccttgggaaaatatattttttgtacttttatttttcttcaaagagcaatgtagctaattatagctacctcccatgattgatgtgaagaacacatgaaataaattgcaagaaacagcccaatttgttataccatagttggaaaaggcttgtggaatgaatccattgaaacatgcctaaatggtacttgaatttaaaaacaaaaaacttttaaattttaacttaaaacttgataatattataattttaggatttctctttttcttttaattgtggcaaaatatgcatataaaatttactgtcttaaccatctttaagtacacagttcagtgacattaactatatttacattgctaagtaaccaatctctaggaatttttcatcttgaaaaactaaaactctatattcattaaacaaacctgtattaacccctcttttcagcccctggaaactagcattctactttctatttctgtgaattagattactttagacacttatgtaactggagtcatacagtatgtgtcttttcatgactgacttatttcacttagcataatgtcttcgggttttatccatgttgtagtaggtgacgggatttccttcccttttaaggctgaataacattccactgaatgtacataccatattttctttatctttattccactgaatatacatcccacattttctttatctttattccactgattaatattctactgaatgtacataccacattttcttcatctttattcattagtcagtgaatatttgtgctgcttctacctcttcactattgtgaataatgctgctattaacatggctgtacaaatatctctttgagaccctgctttcaagtattttggatgtatacctggaagtggaattgctaaatcatttggtaattctacttttaattttttaaggaaacaccacactttttttatctctagtagctgcactattttacattcctaccagtagtacataaagataccaatgtttccacatcctcaccaacacgtgttatattctgagatttttctcattttttttgttttgttttgtttgataataaccatcctgttaagtacaaagtcatatctaattatgggcttgatttgcatttccacaaagattagtgatgttgagcatctttcatacgtattcaggccactcatatatcctctttgaagaaacgtctatattaagttcttgtcccattttttatttgggttgttttattgttgttgagttgttgaagttctttatacatgatattttggtttttaaccctttatcagatatataattgcaaatattgtctcccaccccataggttgccttttcacagtgttaattgtgatcttggatgaacagaaagttttaattttgatgtggttaaatttacctagttttacttctgctgcctgtgcttccaaaaaatcattgcccagaccaatgtcatggagattttcccatatgttttcttctagtagttttaaagtttcatgtctcatagttaactctcaaatggattttgagttgatttgcatatatagtatgagataaggttctaatctcattcttctgcatgtggatatccagttttcccaacaccatttgttggacaaactacactttcccccttgaatgatcttggcacccttgtcaaaaataagttgactgtatacgcaagggcttattcctgatatctattatattctactggtctagatgtctatctttatgccagtatcacactgttttgattattgtagctttgttataagttttgaaataaggaaatatgagacctgcaaatgtgttccttttctttaagactgctttggctattcagggtctcttgcaaacttacataaatttttgagtgaatattttctggaatttttatttgaattataaatttccaaaacaaaaatcaaaacaaaagcaaaaggtttttttggttttttggtctcaattaaggaattagttggggtggcttgtaattctcaaagtaaaaagatatacattttaattactgtataaacattttttaaaatccaaatgttaaatacaattaaactattaggaagatttgttctctttcccaggtttctgatttttttccttttcctgtacctcaagctctatattatgacacaaaaatatgtaatgctaactgcatcctttctgcttcattaaaaaagaaaagagagaaatgtaaatgttctaaagtactgtcaattcagatgtatcaattaggtttggaaatgtgaaaggagttaaatcttaaaatagaggaaaaaataaaaataaggaaacccctttaataataaaaatctaaaagctaaattttctcagtgaaagatttacttaaagtaaaatatgtatgtgttactaagatgaactctgatttattactgaatgctgtatatgatttccctttgcattttaccattgtatatatattagcattgttttctatgcattatttatgtatcacctgtgtgattacttaaaatattaaagaggaaggacatgagagatcctggcaatgtaacattatgcttcagtatcatcttaacagagcgga

SEQ ID NO: 1888 - DNA, 3619 bp, Homo sapiens
atctcacactgacacatgctggcatcatgagccagactttcaagaaggtatcagggcagttcctcgaaaagatcccagatgggaacaccagacaggttcgccaggtatagctaagcgagattatatgatttcctgcctagttgaagggcttaaaaaggcagcttacaaaactgttaattatgacagacttaaagaaactacccaaggtaaagatgaaaacccagcccagttcatggctcatttggcagcaaccctgagacgctttacagccccagacctgaaagggcagaaggccgtctcattctcaatatgcattttatcatccagtcagctcttgacattagaaaaaagcttcggacattggaatctggccctcaaaccccacaacaggaattaatcaacctcgccttcaaggcgtacaataatagagagaaggcagccaagcggcaatgcatttctgagttacaattacttgcctctgctgtgagacaaaacccagctgcacctccagcacacaagaacttcaaaacgcctaaaccgcagtggtcaggcattcctacaggacctcctccctcaggatcttgcttcaagtgtcagaaatatggccactggaccaaggaatgcccacagcctgggattcctcccaagccatgtcccatctgtgcagggacccactggaaatcagactgcccagctcgcctggcagccactcctatagcccctaaaactctggcccaaggctctctgaatgactccttcccagatctgctcggcttagcggctcaaggctgatgctgcccaatcgctttagaagccccctggaccatcatggatgccgagcttccagtaactctcacagtggaggatgtggatgatgacagctgagtgcagatatgcctcaaattcttctcaaggcagcacttcaggaggccccaactgatccatcagagttagcctgtgagataagatttactggccatccccgaagctgctaaaactctgctatcaagtgacctgtgaccttgggaaaatatattttttgtacttttatttttcttcaaagagcaatgtagctaattatagctacctcccatgattgatgtgaagaacacatgaaataaattgcaagaaacagcccaatttgttataccatagttggaaaaggcttgtggaatgaatccattgaaacatgcctaaatggtacttgaatttaaaaacaaaaaacttttaaattttaacttaaaacttgataatattataattttaggatttctctttttcttttaattgtggcaaaatatgcatataaaatttactgtcttaaccatctttaagtacacagttcagtgacattaactatatttacattgctaagtaaccaatctctaggaatttttcatcttgaaaaactaaaactctatattcattaaacaaacctgtattaacccctcttttcagcccctggaaactagcattctactttctatttctgtgaattagattactttagacacttatgtaactggagtcatacagtatgtgtcttttcatgactgacttatttcacttagcataatgtcttcgggttttatccatgttgtagtaggtgacgggatttccttcccttttaaggctgaataacattccactgaatgtacataccatattttctttatctttattccactgaatatacatcccacattttctttatctttattccactgattaatattctactgaatgtacataccacattttcttcatctttattcattagtcagtgaatatttgtgctgcttctacctcttcactattgtgaataatgctgctattaacatggctgtacaaatatctctttgagaccctgctttcaagtattttggatgtatacctggaagtggaattgctaaatcatttggtaattctacttttaattttttaaggaaacaccacactttttttatctctagtagctgcactattttacattcctaccagtagtacataaagataccaatgtttccacatcctcaccaacacgtgttatattctgagatttttctcattttttttgttttgttttgtttgataataaccatcctgttaagtacaaagtcatatctaattatgggcttgatttgcatttccacaaagattagtgatgttgagcatctttcatacgtattcaggccactcatatatcctctttgaagaaacgtctatattaagttcttgtcccattttttatttgggttgttttattgttgttgagttgttgaagttctttatacatgatattttggtttttaaccctttatcagatatataattgcaaatattgtctcccaccccataggttgccttttcacagtgttaattgtgatcttggatgaacagaaagttttaattttgatgtggttaaatttacctagttttacttctgctgcctgtgcttccaaaaaatcattgcccagaccaatgtcatggagattttcccatatgttttcttctagtagttttaaagtttcatgtctcatagttaactctcaaatggattttgagttgatttgcatatatagtatgagataaggttctaatctcattcttctgcatgtggatatccagttttcccaacaccatttgttggacaaactacactttcccccttgaatgatcttggcacccttgtcaaaaataagttgactgtatacgcaagggcttattcctgatatctattatattctactggtctagatgtctatctttatgccagtatcacactgttttgattattgtagctttgttataagttttgaaataaggaaatatgagacctgcaaatgtgttccttttctttaagactgctttggctattcagggtctcttgcaaacttacataaatttttgagtgaatattttctggaatttttatttgaattataaatttccaaaacaaaaatcaaaacaaaagcaaaaggtttttttggttttttggtctcaattaaggaattagttggggtggcttgtaattctcaaagtaaaaagatatacattttaattactgtataaacattttttaaaatccaaatgttaaatacaattaaactattaggaagatttgttctctttcccaggtttctgatttttttccttttcctgtacctcaagctctatattatgacacaaaaatatgtaatgctaactgcatcctttctgcttcattaaaaaagaaaagagagaaatgtaaatgttctaaagtactgtcaattcagatgtatcaattaggtttggaaatgtgaaaggagttaaatcttaaaatagaggaaaaaataaaaataaggaaacccctttaataataaaaatctaaaagctaaattttctcagtgaaagatttacttaaagtaaaatatgtatgtgttactaagatgaactctgatttattactgaatgctgtatatgatttccctttgcattttaccattgtatatatattagcattgttttctatgcattatttatgtatcacctgtgtgattacttaaaatattaaagaggaaggacatgagagatcctggcaatgtaacattatgcttcagtatcatcttaacagagcgga

SEQ ID NO: 1889 - DNA, 8783 bp, Homo sapiens
atctcacactgacacatgctggcatcatgagccagactttcaagaaggtatcagggcagttcctcgaaaagatcccagatgggaacaccagacaggttcgccaggtatagctaagcgagattatatgatttcctgcctagttgaagggcttaaaaaggcagcttacaaaactgttaattatgacagacttaaagaaactacccaaggtaaagatgaaaacccagcccagttcatggctcatttggcagcaaccctgagacgctttacagccccagacctgaaagggcagaaggccgtctcattctcaatatgcattttatcatccagtcagctcttgacattagaaaaaagcttcggacattggaatctggccctcaaaccccacaacaggaattaatcaacctcgccttcaaggcgtacaataatagagagaaggcagccaagcggcaatgcatttctgagttacaattacttgcctctgctgtgagacaaaacccagctgcacctccagcacacaagaacttcaaaacgcctaaaccgcagtggtcaggcattcctacaggacctcctccctcaggatcttgcttcaagtgtcagaaatatggccactggaccaaggaatgcccacagcctgggattcctcccaagccatgtcccatctgtgcagggacccactggaaatcagactgcccagctcgcctggcagccactcctatagcccctaaaactctggcccaaggctctctgaatgactccttcccagatctgctcggcttagcggctcaaggctgatgctgcccaatcgctttagaagccccctggaccatcatggatgccgagcttccagtaactctcacagtggagggggtcagctggcaagcagccatcaaaattaagaagagagaactgcaacttatagctaatagcagctagttgcattgcccttgaaaatggaccctgaggatcagcaaaattaaagggagtggaaggtttcaagccgtcagcaatttatacacttctctatccagcttgttgggttactgtatttctacctgtcattaaaaatacgctattaagccacatccctcaaagtgacaaaccttcccaaacaacctggggtatcagaacaatggaagagaagcgatgcacttaattgaaagaggtttactgtagccaataatcccaaggattgatgtgatgcctgttctcagcagacagttcccagaaggtactggcgttggcatttaaccccaaatttacaggcaggctcttcatctggatctcaacatttcctcatgtacaattgagactcatgtgacatctgtggaatatgtaacttgccaagaacagggagagggacagcttcatgagcatgcgacaggtgcagttgcacagtgtaccacgtttggtttaaagttctactgtcaccgtcttaaagatctgaatacattttgaacaagaggcaccacatttttattttgtactgggcccccaaaattatgtagctgatcctggacagggaaaagagccaaccatcttgacttttttttggaagactattcaagctccttagtatctggtcagtaagggttaaaggtcctaacagcaaataattcaaacctgagacattgtgctggtctcagaaaggaaactaacctcagcaaacttctggatgagctgcaggggactttcacaaactctcctcttgtactctgctcctgtactctccccctgggaaaactgcatttattaggatggctaatactgtaaccttgggatggttgcttttggtcactagggtttgttagttcactattgcattcagaacacttaaaggcaaagttgtgatattgatagggtgtgtttggatccccacttctcttcctatgccctgccatcccactactccaccaaatccctattcttccttctattccttttactctaattgtccactgttctcaacttctttagccatccaagtcaaagtgtgctttcagtaaagggtctgattatttcaaacagaatcagttaattagttaatacatgcaaagtacatataatagtgcctgaaatacagtcaccatttcgtaagtgttagctgttgtttttattgtcattactatattatgttagtcttataaggaatacacattgtttctagaagtgtagtgagtataaggtagcagaaaaagtgatggaaatcaggcagtacttgtttagatcatgtatcagtaaattcacacctaagcctcggttttttcaactgtacaaaagaggatagtaaccaccttgtggaatttccatgaagtttaaatgaagactatgaacaaggtgggtagcacactttgactcatgggaggtgctcaactaaagtacatttctatgaagaattgctaccatctacaagcattagcacttttacaagggtcagaattataaacttcaaggttatgagtagaaatatatcccaatgatgaagaaaccattaaaacatttttccgtcactgaagtggccacattttctggggtatgtaccctggggttcgttgtcacgtgccaggaaaatttaggacacagacacacacgaggagtttagaagcggaggtttaataggtagaagagaagagaaagagaaacaattctctccgtaaacaaaggggtctccgatgggaaaagaccagctcctggtgaatgctccaaattttatagtccagtttgaggcggaggcgtctgatttacatagggctcatagattggttccatcaggtatgacgtttagatagccttcagggaaggctggtcaccccaccctaatcttattatgcaaatggactttccagttgattggaccatcttctccatcccttatagtaaacgtggctagcggagaaggaaagatggagctgccatcttgaaaatatccagtccttagttcctgccacatttacttgtgcaagctcccagcttgcttgtctgtctgcagctccactttacaggctgttctttgttagaaaatgatttggggctacttttcgttaaaaagaaaagtcttaccaaggactcccatacccttactatctgcctaagtaatttcttcttaactcttgtatcatcgacactcaaacctggacttctcctgacttgtactcatcctttagatcccagtttggcaggcacttcccccaggaagtcttcagtgctaggagtccatggaaccctgttgtactcctgccatagaagagcacagcattgtgggtgatttttcacttgcctaacaccctttttgataattagctcttggagttagaaaatgttcctgcctctgtagtacatatagtcacagcaatgtttcctatcccacatgttcttcaagaatgtttccatctcctcatccagaagtcaagtctttgtcttcctttcttaatgggtgagcttttttgactgctccaactaatagaatacaatggaacttacttctatgtggatgagaggaaggggaaagaggatggagggagaaaaggaaaggggaaggaagagaggaaggaagggaggaaggaagggaggaagggagggagggtaaatgtttttggagacctagaaacttcaccatttactgaccataatgtcagcactgttggtttcaaatggattgaggcaatacatacggccttcaggtagtttctatattttgactattgtgaataatgctgcaatgaacatgggagtacaaatatctcttcaatatagtggtttcatgtcttttcaatgtaaacccagaaggagcattgctggattatatggtagttctattttttgtgtctgggaactctatattgttttccataatggttgcccaaatttacattcctaccaacagtgtgcaagggtacccttttctccacaccttcgccaactcttgctatctcttgtcttttttgataacagctatcctaacacgggtggttttaatttgcatttctctgatgattagtgatcctgagcaccttttcatatacctgttagccatttgtacatcttctttgttttttcttagcctacacatcatgtgtgttcaagataccacccctatagtaggaatgaggatctgcagcaaaatgagcagagagtttagggaaagagcaaaggcagtttatagagtgaggtgacctttagatctcagtctcagacaacctagaggtgttacaaagcaaacagaagcaaatatgagcctccaaatacttttcattccctcttactctctcaatctttttggtgctactatcagagacaacaggcctgttgaggaaatgttaactgttaagcaggcatgaatttctgtgaagggctgattcattttgtcatgggatcttttatccatgaatatgtttatggttcctgcctgcttccattaaaatacttacatgctgtcctctttataggcaaagaggaggaacctgctataattttaattgttgtttttgtttttctcagagttctgatttttttgtttgtttgttttggaaaatgtgttgtggtatttaatactcacgtagctaatatttttaggtatctgagaaatttaaggagaaaattaatggattgagtaaactgtctcctgggctgtgagtttctggaagtcccaggaaggcctggaacattcattcagctttatatttctgtgagctttctactttctagatacttcataaatgcttattgaattattgggaaaaaagacatttagaatgatatcaacagctagtatcttggacaaaagatattttggaaactttattcatatggagtaaggagatacctatttctctaaaactgtacaacataatgaaagactatgttttccatagtctgagatttccagagcaattccaagactgagatttccagagcaatctcagcttcttgactgtgtaggcttatgctctataggtgatcaatcaagggtgtcagtggaattaacacaaatttaaatatataaatccatcttttttttttttgcatacccgaaccttatcattgcaatagcaacagcagtaaatcagaacttattaattactattatttgcagttctttagtctgtttttaacaatgtattttattttgtattttcatactaaaaattaaaatatgagaaaagtattcagaggataatttcacttgcttttttctagttttaagaaaactatatatgtgactataaacatacaaattttaagtataaataaatatgtatgattatatatgtaatatatgtatataatctttgggtagaagaggatagaaaatatcatttatcatgtcagtgtttatcatgttaaacactgacaaacatatgcttctaaacctaccagttctagaacatactgtttcttcccttgaagtcactccaggctcttggctagacgtatattcacaagatatttttagacttacccttgcttcaaaatgaggtgtaatttcagactggctttcagggtaagcatgctgaatatcaaaacatgcctttttgcttatctactaaacaagtgagcattttttctaccctggttgaagttcactttcatagcctgcttaacacggctatttacatgaacattttggtggcctttattttttcttaagaaattttatttcataagggtctaatacagcatatttagaaaacatgaaattaacaatcactaaaacactgtgcactgagatatagacagttccaccagaatacaggctgttaagccagagaaaaataagtttgcccaagacagcaattaagtagaaatgaatttaaacaactctagtttttgttgttgctgttttttgagttttttagcagggggagggaacattatgaatcaattaactgtggaaagactacttggagacctgacacaggagacatatttctgaggtactcctggaagattattccatcacacagccctgaaatttcctagaacattcttcagatgcctcacagagtggccttaaagttgatgcttacggcagcttaactgtcccctcatgaccgaatctcagatacttcttgggtaaagcaaaaattttaatgataatttatagattttggttaaagaaactggatgagtggttctttcccggatttattagcattatcacatgcttgagctaataaaataattctgggaaacagcttctaccctgaccctttccccaccctgaccctttcccagtactatagaacaacaactctggattctttccagtagtgaaacatcacagtgtggtggatcaggaacaaggacctatctccaagagaactgcatggcccctggtttgcatcttcgatggcagtaattgctttactactttatgaaaatcttcctctcctcacatccttaggtgatatagagtattggaaaaaacaaaacaaaggtcaagttgtgtaatgttttaacacaaatgtaattttgttttattaaatgtaagttagctgataattgaactaagaatattgttctcacagataaaacaagataaataacagggatattcataattgaaaaactcacataatatagtcaagaaatgtataaaatactgaccccaaacaatatttccaactttaactcaataactaacgataaattatctgatattttgtcagcaaaattaatattgctgagattacactttaaaattctatgttctctgttatacttttcttaataaaagaaacaatgaacacacagatatacatctattactatattcatgtggccagtttcttgagctgtctaaactatgcagtgtaaacatgaaatccttttttaatttttaatttttgtgggtacatagtaggtgtatgtatttatggggtatatgaaatgttttgatacaggcatgtaatgcataataatcatgtcatggaaaaggtcctaggtctctatgatcagtggttagcaaatcaatccaggttttgtgcccttccctttagggtagcaagttcgcccaagtcccaggtgggtctgaagatcctatctgaaagccagggactggagtcaaaagccttataaatttaccggtattctattctgctgcaactaagctggcactcaaaccaaaatacaaagtcctttcagccctctatagttgttttcatcaactataatctcttttggtcaagtacccaaatctttagtcaatttttcaaattggtttgtttcgtttttattattgaattttgaaagttctgtattgttctgaatgtaagttctctatcagatatgtaatttttaaacatttttttccaaatctgtggcttgccttttcgttctgttaaaagtatatttcaaggagcagatgttcttaactctgatgaaacccagtttatcaaatttttcttttttggtttatgcatttggtggtgtatctaaggaattttttttctaactgaacatatttcctgtgcttttctgtttgccattttatgtttgtaatttaggtttatggttcattttgagttaatttttatatatagtatgacatgtagattgaaatgcttttggagggattttgttactgtttttgttgtgttatttggttaggtttggatttttctgcagacagtacacaattatttcacaatttcttgaaaatgtcatcctttttccattgaattacgttggaatctctgtagaaagattagaccatgtatggccgagtctatttctgaattctcagttctttgctgttgacctatttttctgtcttgacactaatatcacgccatcttgattggtgtagtttataataagtctccgagtcaggtagtgcaagtcctccaattttgctcttttttcaaagttatttgggtgattctaagtatttgcatttccatttgcattttagaatgagattgctaagttttgctggaatttttattgggattacattcaatctactgatgaatttgagggaaatcaacacattaacaatattaattctttcaacccatggacaagtcatatgtctcccttatttagtctttaatttttctcatttgaaataagcatttcatcattttcatgcagttgtagcttttaattttatttctgatcattttttgctattggatagaaatacaattgaattttgtatattaatctcatatcttgcaactttgctaaattcactagttctagtagcttttgaatatattctatagtattttctatgtagactattatgtcatctgcaaataaagacacttttatttcttattaatatgaaaaagagataggatatactattatacatgttagattagacatagggattttccctccgaaatcccattaaaatgagaattaagaagtaaaatatgcatgacccacaagaacaaggaagccactagaagtgacagtcaataaaaaaatcagccaactaagagaagatgggaatgtgatgtgatgtaaggccttacattaatattatatgctgtcttggcatctggtaaaatcaagaggacctcaaatggcctaactgcaagtccctgtttccacgctgcttcctcagaatgccctcctaagatgccagaaccttgatattgaactttccagcctccagaactgggtgacaatacattcctattcattataaattacccagtcttggatactctgctatagcagcacgaaacagactaaaggagtatacacaataaaagtctcacaaaacttcaaataacacaaagaggcaagacaactgagtcaacccaaaacat

SEQ ID NO: 1890 - DNA, 22722 bp, Homo sapiens
atttctcattggcaatactatcaccagctcaacatttgccactgagccccctcttggagaaaagtgacagcatgtgtccagcctcttcccctgaggttatgagggaagtgggacttgctcagcaaaagtagatgatgaatcagaccgaggaagaggagccactgtgatgggtatttttagaatcctgcattgaaatggctataaacgaccagatcaaaggactgaagaaaaaaaaaaaacagactgtggaacttcccctaaagtgaaatgaaaccctctagggtgttcacttcatgtttataagaagaatggttctcttaggtaacttcctaaattctgtgctctgatccaagatagaaacaaaactgccaaaatcccccaagaaatccaccattgctcacatggcctaagaacaggttcacattgtataatatagtgtttcccaatcgtgggtaagcatactgtgggaggtacacaagatgactgcaggaagtgacatctgtggacacattttgtattaagagtcatgtgttttaacatacatttggaataatgcacttaatacatcaaacctgtgatttatagactcctgtctggaaaggaagctgcagtagggcaggatttttgcctgtccctccagtacgcttgtctacgtggctgtatcttcttgtcttagagaatgcttgccatggactagggtctaagacagttttataaatgaattattgcttagaataagaatagatagttgggaggcagaggcaggtggatcacttgaggtcaggagttcgagaccagcctggccaacatggtgaaacgctgtctttactaaaaatacgaaaattagctgagtgtggtggcgcatgcctgtaatcctagctactcgggaagctgagacaggaaaatcgcttgaacccgggaggcggaggttgcagtgagccgagatgacaccactgcactccagcctgggtgacagagcaagactacatctaaataaataaaaaataataataagtaaataggaaacaataaactttaaaatgtcctttaaaaattttttttcaagtaaacagtagtatccttttataataacaaattcacttggacagggcgagtgttgtagagagggcagctgttgagttgggaaatgctggtataacagaagctctaaatgggcctgggagcttcaggtattcccttgttcttcctggctgacctccctacccgctgcctaacagcgctctatagatgtctatgaactgaaatcaatctagaatctgctcagggcagcctcccttacaggaagaagagatggggagcttttcttacaaagtagtagaaggcatcagggttgtccaggaaagggttttcagcagttccatccactgcactcttggacatgtctccagcaggctgcagatacccctcattgagcagcgatgaagcaatcatgaggccttcctggcgattcctaacagactggttggataccagccaatcaatgacgcagttacctagatgggaccagcacagggaaggttaactctccttaccgaagaacaagcccctgacaatcacccctgaactgactccagctcacccacaggtctgacttgtctcgtctcccctgttatttcaagaaagagaaaacaaaataagtgggatagatacccactagaaacaaacaaacaaacaaaaaactatgtaaagggtttttaagaacatctacatgctgcttaagaagaaacacatgaccaggtatggtggcacacctgttgtcccagctactctggaagctgaggcagtaggatagttgagcccaggagttcaagaccagcccaggcaacataacaagactccatctcaaaaaatatgtaccctaaaacttaaagtataataaaaaataaataaataaaaacaaaaataaaataaaaaaataataactttaaaaataaaaaaataaagtctttgtcttaaaaaaaagcaacacatgcatcaaagaaataggttttactaacccactcacttatcccattgatgaacaaacatttactgagcacctactcgatgctaggtactctactgggtgttggagaaattccctcaaggagtgtaaaagggcatgatgggtgtaataaataagtcttgtaacaagtgctctgctataagtcagttgcgagactactgggtcaaatctgaaggtgtgaaagaggtgaaggaggtgagagaagagggctgtgcatcaccatcaggaaaagattcatagaggaagtgacactgggcagaggcttaaaatatgagtaggcgtttgccaagcatatgaagcaggatgcagaggaaccagcacaagctgagggggcagcagtgtgaacagatgcactcaggcataaagcagccccatggggcaggggaggagttggtggaaagaaggcaaaaggaaataagaggaggagggaggtgaagggtgggtggggagagctttgatggcacagtaagaaatttggctaatgggaaatcattttaagtttttaaataggaaataatgtgatggatatatgtcctaaattaaaatttgatgacatcacctgcactgattgtcatgactttgcagagtctagcagggaccttgagaagtcatttaagcaatcttctggtcaagagatgattgcaaagagaagaaaatgaaattgacccatacattggattattagcaggttacaatgaagctttgtattaaaaacagcatgtttgttcttacaacaaaaaaagatagatatttgaggtgatggatacactagttaccacgatttgatcactgcacaatgtatatgtgtatcagaacattaattgtgccccataaatacgtactattatgtgtcaattaaaaaagataaaaataaaaagcagtgtgttccttacaaatgtagccaacaagggagtcaacatgacagcctgcctgtcctgtcatccgggcaaaagcagtagggatgccaccctcaaaacaggagtgacagcagttggatagcgagccttccatgaatttcatgtatgaaaggcttttgctcacttttctttctctacaaagataaactaagtgacactgcatttcttctttttatcttcatagcagcctgtgaaagaggcagggtggtaattgcagtcctcattttaaggataagaaaattaaggctcagggaatctgagtgatcttaggccaaagttacaactgctctgggctgtcacttttaagtgttctaacccttgcatccacgctcactcagtgaggcatgctgaagcttgaaagacaagtttggtctagtctgcctgtcatcggacatttaaggtcttccatcatgtgtcagtactgctgggtcccagtctctgctacagccttcatctcccagccgaggccacctgactcccccatgaaggctctacccatagaaatgtccaaaacccaccctggccttcaacaagaaggatttaagaagtactagcccacctgtaatcttagggattacaggccactttgagaggccaaggcaggcagatcacctgaggttggaagtttgagaccagtctggccaacatggtgaaaccccgaatctactaaaaatacaaaaattagccaggcatggtggtgcacatctgtaatcccagctcctcaggaggctgaggcacgagaatcacgcttgaacccgggcggcagaggttgcagtgagcctgaacaacaaaagtgaaactccgtctcaaataaaaagaagaggaagaggaaaaaggagaaaagaagaataagaacaagaggaagaaggaggagaaggagaaggagaaggagaaggagaaggagaaggagaaggagaacaagaagaaaaaaaccagcccaatagtctgggactcagtaacacattacagtggaaatcagtctgacctggattgggtgcccaagtctacattgaaatgccctcctgttccctttgcccaaggctgttgcagtgacctcggtcctgatagagttgggaacttcccttgttcttgtcactttctcataccaccacccacagcttggtgtcttgatcccaaatctcagccctgccttgtctgatgctgggctgctgccttgactctgaggcttattcccacgggggactatctcatcgtcagtgatcaaagccttttccccttagccttgctgatcctgacctggaccaatttcatggattatctgttgatggcacatcctcttagattccacatttgctgtatcagctcagagttttcttcctttgatctctcctgtcaccataagaaagccaggcctggtatctgacaaacttagtaccaaattgtacatcccattttgctccccctgatgaaccgtcagccctactaggctggtcagtttctttttctagatgcatattctgcacatgtctgcctcataactttgtcctcaccatcctttgcccatcctctgctcatcctctgccctggcccatcctctgctcatcctctgccctggcccatcctctgctcatcctctgccctggctcctcattaaaaatcctcctgtaaatatttaatgaaattctacccatctttcagggtcaaatttgggtaccacctcctattcatcccatcaacccctgagttctttctctttttttgaacccctggaattggttgtacagacatgtgaccacttaaaacacaataaccacttgagcttgcaccatatagcactgagtgtgtgccaggcactactctacacacataatggcaagcctatgaggtaggtgcactgtgattatccccactaaatagacagagaaagtgaagcacagagaggctaagttattgagccaaggttttataactagtaagttgcagagccagaatttgaaccaaggtggtctggctctaaaggacatgtttttaaccactacaccatactacctaaactcataacacttaatacctgaccctgtgcagcctctgatagccctaatattgtcatttaaaacttacattgtatgccttaatccctgtttattgtagtaagggttgcatcttatccaattctgtgtctatttctagcaagtctcaacataatgccatttattgagaaaaaaaatcctttgattggaacgttagcttgaacaaatgttaacttgaacaaataaagcttgaacaaaatcgttagcttgaacaacaaacttctttctattttcactctgtaggagcttcatcctcaggctcaccaggctgcattctgggaccccttccaacccccatacttcatacccccacctcacagacgaggccgaaggaggactccatatcgccttcccagtcgccctatttcaggcctgcaagtgcttttacctgtgaagcagtgattaaaaatcttcttgtccttctctagattcagttcttttattcctttttcagtgtctttcatggacaaatataaggcactgcacagagataaaaaagcaaacaaacaaacaaacaaaaaaaaacccagttggatgagtggggaacatttcagaatggtaagttctctctgggaggtgagcacaagctcccccaccccaggtatcccctgagcttaatctccctccatcagatcataagtagtggaggggcaacattcatatctgcataactctgtagcctgcacagcgtttagcaatgctggaaggtacttaacgtctcctaaattctcttaaattcattcagctgtttgttgatttaattattggttcctgggatggaaatttgccccaatttagaggtcaaagatgaaaggttcctagggtccattttctacacattctacatctttaatgtccctcaatcctcatatcccaattctttaatgctcttcaagggaccatctgtggtagacattggcctttaagaaagtgaatgcttccactaagcatatgtcttatctttaaaatgatgagatataaggcaaaatggtgagaagttctcatttttgtccttgaagtaatacatcaaagatagccttacgagagaagctctaagcaacaaaacagaaggccccttccatgtagcctgtggctccctatagcccgagcatttttcccacttagttctgacagcactggccaggactgtggtcactcgatggcccccatcagcagctgcagctgcactaggtgcctcgttggagctctttgccaaaaagcttttgtggtgaaggaggctgctgagtctcactcagctcagttcacaaactttgtcaaactcctgtgccatgccaagtcttgtgtcgtcatgcagaagtgcagaagggatgtctttaggctcctctcagtgcttctccccaccccaccctccataaaaacaaaattcttgttggacattttaagcagctggcatgggattcttctcaacagggctcctgcttcagggaatgctcaacaaaaaagcaaaactaccaagaagaaagtgactcctagagaaaggggctcatgtgaccaaagatgtgagatactcaggaaggaagaaatcccattcccaacctctgtcaggagctagatcttcctgttggcctctgaccacctttagtctacaactatcacctgcaattccaagccaaccaacatcagcggccattaaactgggtcaggacataaatggcttccaccaggatgggtgtttaccctggctggcccttcctgagtgtgtaaatgaatgaacttgaacttgaaaccttgcttgcttggatgcatagcccctgctttttcctttctacctaaagatcctaaagctttatttcaagactgacttattatggctatgttataaatgcaatgatgatgtttctttctctctctctctctctctctctctggtacccagtatgagggaatttgtactccattcgcctcctctcctcagctagtaggccttggatcactccttcagacccaggtaaacattttagtacaccaagtgccagtattgacctggcagagtggatacaacatcagaggtggtcaaagcaagccttggagcaggatctgctatgtttgtgtctttcagaaggaatgggtaaagagaagtaaacacagaaaatcaccctaagtcaatggtttctggcagtcgaatggacctcctggtagatttcctggcaaatttctggcctccttcaatgcatttaatggccttcttgatatcccgaacccaggcatctctctcctccaggaaggctgcctggaagaagtggtcctgctgtttggtcgtagtgatcttaaacacaaactgaaaatcaaaacacatcccattagaaatggcttatttcaagggcttggggcccctcatgaagcagaggccattggcctaaacctcttctagccaagagaaacccaaatgccagggtggggtgtgggtggtggtgagagggaccagcccaaggagcaccacccacattgtaggcaatgcttgcaccaaaagttgagtgcctgaccaggggttcacggcagctcatgatgtcaacttaccatccttttgccaaagtcttgacaagggctagtcagagtgctccctttcagcgggatcattcctttggggctgttgtcacttttcttcttatagaattcaattccatcttctaacaatacaacccacatgggtttccacgtattgaacacgctcccctgtaatgacaaccaaaagagctgagatggacagggctctttgcaaactgtattttcctcctaacaggaaagattctatatttacttacagttggtttttaaaatgtttggtgacatcatctctgttccttcaacacaaatcctctcaaatcagtggctacttggggagccattctcatttctactcccggctctttgctcaagccaaccccattctctggaatactcctccccaactctgccctctcctctttctcaccttgcctaacctctccatatccttcaaggctcagcttagccacctcattgatgaggcttcccgaactgcacagacccaccgtgatctcaggggtgcctcctgcttttctcactgattgtgccatacaacctggaactttgttatatatttcctcatgtagttctttaattgtcttcagtatggttatctttccttctccatggcaattacattatcaggtactttccttggttcatgatactgagcacacaggggatgttcattaaaataatacaaaagaagatcatttcccaaactgccaaatgctagcagctatcacacttcattgaaaagagcaaccaatccttcttattatctacttcatccccacccaaaccctttcctgctatgatttcccctgcacctcccttttcatgtcgggttcacaccattaagaaccacaaaggacccacctcacagaaacattctcacccccgctatgtgtaagaactgccggcagatcttgcttctgaaactacatctgacacatgatcttagagtatagttctttctttttttgaagtctttatttatttttacatgtttaattgcctattttgaggagaaaaatacaaaaatgataattattggtgttcggttggaagggttttcatttttcagggttttagaacatttcaattcttgggagggttagtcagaattggagaaagaattaaatattctaaagcctagtggttttcaaaatatggcctgcaaaccaactaatctgactcactgaagacacatataaataaaagctggttttaccccaaatctgccttcacttacaagctctggtaacactgctgagatggttggctgaatcttagatgatctagctcaagcactctctctctgtctctttttttaaattttatttttatttttatttttttgagacaggttctccctctgtcacccaggctggagtgcaattgcatgatctcagctcactgcaagctccgcctgtcaggttcaagcaattctcccacctcagcctcccaggtagctgggattacaggtgtgcacaaccacacccagctaatatttatgttatttttttcagtaaagacggggtttcaccgtgttggccaggctggtcttgaactcctgatctcgtgttccttctgcctcagcctcccagagtgctgggattacaggtgtgagccatcgcgcccagctggttctatgactttcttactgcccacacttgtgtaagccacttgccctctctaaggctcagttcccagcactaaaatgataagaatgactacctcagagatttctagaacatatgaaatgaaataatttggataagattttataagttcgaatgtgctctacaaatgagaggttgtattattaagtatcttgacagatggccatgtatgaatgtcttccatgctttgagttttcatcctctctattcttggaaaaatgacaatgaactggtatcagtatcatcccaatgaggaagagtcaaaaatatttagccagttgccatgtggagtaatgaatgggaaagctgaaggccctgaggatctgcatgaatgtatttgtgaggaaacacacttccctttggtttctcttctggtggaataaggtttgggattgtgaagaatccggcctgcctcagacttgcaggcctcctccattattgtatgacatgtcatccaatgatgcttgaagtatttaggatacttcagtgtatgctatgatttggggtcaaaactcgaacctacatttgagcctcatgtcaaccacttattagttgtacatgtctttgggtaaaatgtttaatatttctgagccatggctttttgtttgctaagagagagataataattccatcttaaagcatagtttagatttagatcatgtataaaatatgtatatataagtgtataatgcatgccatatgcttatatgtgaataatgtacatatacattatacagtgtatatatctttaaatacatatgtatacacatgttttatatataaagtgtgtaaaatcactctgtcaactattgccacccaactatatgttccaggggggcaagaacttacttcaccatcatattgtcaggtgttcaatcaataatttgtggaatgaacggtggtaattaaaatcacattatgactgtaagaaaatattggggaaaatctacaagacattggtctggccaaaaatttcttgagcaataccctataagcacagacaaccaaagcaaaaataagcaaatgtgatcacatcaaggtaaaaagcttttgcacagcaaaggaaacaggcaacgaagtgaagagacaacccacagaatgacagaaaatatttgcaaactacccatctgacaaaggattgatagccagaatatatcaggagctcagacaactctagaggaaaaaaatctaataaaccattcaaaaaatggtcaaaatatttgaatagacatgtctcaaaggcagacatacaaatggcaagtgtgcatatgaaaaggtgctcaacatcactgatcatcagagaaatgcaaatcaaaactacaatgagataacagctcatctcagtcaaaatggcttttaaccaaaaaacaggcaataagaaatgtttttgaggatgtggagaaaaggcaatacttgtacactgttggtgggaatgtaaattagtacaaacactatgaagaacagtttggaggttcctcaaaaaactaaaaacagaactacgatttgacccagcaatctcactggggggtatatactgtaaagaaaggaaatcggtatatggatgagatatctgcactcccatgttggttgcagcactgttcacaatagacaagatttggaagcaacctaagtgtccctcaacagatgagtggataaagaaagtgtagtacatatacacaatggagggctactttgccataaaaaagaaggtcctgtcatttgcaacaacatggatggacccgaagatcattatgttgagtgaaatgagccaggcacagaaagacagacatcacatgttctcacatatctgtgagatctaaaaatcaaaacaactgaactcatggacacagagagtagaaggatggttaccagaggccaggaagggaagtgggggactgcagggaggtggggatggttaatgggtaccaaaaacaagaaaacagaaagaataaatgagacctatgatttcatagcacaacagtgtgactattgccaacttaattgtatattttaaaataactaaaagagcgtaattggattgtttgtaacacaaaggataaatgcttagtggggatggataccccattctccatggtgttattattactcattgcatgcctgtatcaaaacatctcatgtaccctataaatacatatacctactatgcacccacaaaaatttaaattttaaaaattaaaaattaaaaataagatcacattattaatagataagactgaataaataagacataatgaaatgattaacataagaatagacacaataagtgtgacaatatttcctaaaatgatcctatagacctctgcaggacaatatgtaactcagctttggccagtgtggaggcaggtggtccacatttgcacaaggctgcgcaggaaggatgccttcaggggaaaggaggactgtcattctactggaattttttttaattaagataaaatgtatatacagtgacagtcaacccataagctcccctggtacatttcaggctgactttatgtggtttgttttctgctcccaaacctgcccattgagttcagttcaactcaagaatggcaagtagaatctatctcaagtgtcaattcagactgagtagtagtggatgcttgaggctggactcagtggaaaagtgttgtgatccaacagccgtgtctcccatagacaaagcagtcataagtggtggcatgcaccctgcagttgcttccatctcttgggctaatcagattttatctgaatatgaatgtcaaaaagaaactcagacagcagccttgtgtgcaggcatggctaagttgtatgaaaatcacttgcaaaaggtctataatgccagaatgaggctatccacattaatgtagcccttaaaaaaatccttacttaaaatgttttcagtttgggttcatgccagctgcccctttagcaataagttgaccattctgattaaaacagggaagtctctatttctggtctatattttggaagaatttggcaaaggtctattctttaacccatgatatcaccctgtcatgactaccacaaaatagaattatcatccagttcccaagagaccctgctgcttatctcaaaatacaaagggcctctatataaaggtccagttgaccaaaaggaagactatttatgcaaagataaatacttgtgggactatcactttgcttgtccaaacatttcctttgttctagttactaaaataattttctaaattaaaataccctatctcttttctgcatgggcagaataactattccagacgaacactggattatttccccttttaaaaatgagcaagatcagacactgtgccaacacatgaaataattccagtaaaatgcctttctgttttacaactgaaacatatctagaatacaaagaactcctgcaaatcaataagaaaagtacaaataatcctatttttaaatgagcaaaaagtatcgagcaggcactttagtaaagaaaacatccaaatgcttatgaaaaagtgttcaacatcattatttatcaggaaaatgcagattcaaatcacaatgagatacctctacacacctgctagagtacctagcattttcaaagtcagagaagaataagacttgacaaggaggtagaataactggaagtaccaaacatagctggcaggagtgcagaatatcacatccagtgcagaaaaaatatctggtggttttatgctaaagctaaacacatatatgtcctttgcaccagcaatttcactcctgggcaaagatctgagagaaatgaatgcatattgtcataaaggtttcatcaagaatgttcatgacacctttattcatcatagccagaaacaaagactaacccaaatgcccatcaacaggagaaggaataagtaaactgtataatataatatataaatccattattaacacagtaaatgtatactatggaaaacaacctagcaatttttaaaaaatgaaccgctagtacctggaacattataaataaatctcatagatgttgagtgaaaagcaaacaggcaaaacatgtgcttagagtatgattacattcatatgacgttcaacaacaggcatagcttatgagaaaatattacaataatggttaccgacgatgggagtatagactaggaagggaacaatggaactttatagcatactagaaatgtctctgtctttatctgtgtgttgattacatgaggtataggtatgtaaaaaattatgacacccttcatgtaccttattgtaagttatccttcaattaaaaaacaaagttgttaactccaggtcctgttagttaactccatggaggggtatacagtgattatagtaacaccacccttcaagttgcttctatagaaggaaactattccacattagttacttctctcacttaatcactggaaaaacagcatattcatgcaatgaattgtcctcgattgaatcatggattcttttcaaagccgctatgcagaatattattgagtgatctggcatcatttgaatgtaaaaggtgtattagataaggtcattttattagtaataaatttcttagatgtgataatggcattgtgattatataggaaaatgtcctttttcttggaagatgtatgttgaagtattttggagtgaggtagcgtgatgtctgcaaattactctcaactatctcaacctaatatgatatgtgtgtttatttatacagaaattcagagatagggagagacaaagcaaatgtgcccatccattatcaattgattaatctaggtaaaggctatatgaataatggtactagtttcctcatttttctgtgggcttaacttttaaaataacttgggaaaattattaaatgaatgagtaacatatgactctgctatgtattaaaatttagaatatacttttagtgaaatacatagacaaatctatttaataaaaaattttaaaaatacctggaaataagaaaagaaagacatgttctcagagctagaaatgaaaagttgcactagatgattgccagaatcccttttaaacctaacatttaatattcaacctcaggaatagctgagattattaactgccatcatcactcagggcttttgactttgaaattgggatgcatcagtagcgataagctggcattgcatgccttcagtagacaaagcctctggagccaactgtccaatatgagtttgtgcttttctttttttttttttattttctttattatactttaagttttagggtacatgtgcacaacgtgaaggttagttacctatgtatacacgtgccatgttgggatagcattaggagatatacctaatgttaaatgacgagttaatgggtgcagcacaacaacatggcacatgtatacatatgtaactaaccttcacgttgtgcttttctaaatcaagtgcagcctccggggtctgactctgaggaggatgtgtcatttgggattcagggtcattatgcacaatgaagaggctgatactttatgaaacaagagaaatctgaccacttacaaagcttaaacatccttccaggcctgatagtgctgagttaggtcaggatgatggaatttgaggaggtttttctctcctcttcaccactactgcagctaccagtttctcactcgggtaacctggcagcacctctccttgaccattcctaaatttttccttttctggccccaacccacttgatgctcacccaagagcaaacctggaagtgtgattatggaatgtccaaatgacagagaaatttaggatcatctaccaacactgtcaccatattgataaaaaaaagtggaggcccagttaagtgattggcctaccacatctgaacaattaatgttaagtgattggcctagtacatctgaccagttaatgtagaatccatgtctcctgattctcaattttatgttttttcccttcccctcagatgtcattttcattttggttcttgtataacactgagtcattctggaatctgtatcgatttctttagaccacttagctagctatttcacttcaatggagatatatatacacacacacacatatatatccatatgctgtgtgtatgtgtgtctgtgtgtgtgtgtgcatgtgtgtgtgtagcatatatgtgttttcacccattatatgccaaaacctgtacatgtccacaatgggatgctgagtcagatttgaagttttctggtaaatacctgttcatcatcatgggactggtataatttagcacctaagagtctgacattgcatgacatcaaaagaagaaatcataaagaacggcagatttgaccatattaaaaataaacttctcggctgggcgcagtggctcatgcctgtaatcccagcactttaagaggctgaggtgggtggatcacttgaggccaggagtttgagaccagcctggccaacatgatgaaagccagtctctactaaaaatatacaaaaattagctgggtgtggtgatgcacacctacggtcccagctacttgggaggctgaggcaggagaatcacttgaacccaagaggtggagattgcagtgagcctagatcacaccactgcactccagcctgggcaacagagcaagacttcatctcaagaaaaaaaaaaatgaacttctctatatttaaaaaactgcaacaactgaaaagcaaatgaaaatgcatagatatttgtatcatcatatgattaaaaattaatatccttaattctttaaacactttagaaccaataagaaatatatcaacactcccaattttttaaatgagcaaataatataaataagcaattctcaaacgaataaaagctgggtccaataaaacataattgattgcttcaactgcaatcaaagaaatgcaaattgaaattaaataagatacagcctttctctttaataatattttgtaaagacttataaggtgtgggaaatgagcatgtgggaaaaaaggagctctatgagtcagcaatttgatgtgggctgtcaaaaaaaaactaaactcgttgtggttgtatacagagaagtgtaagatcgaaagcaaggaaaatgataattctgtctttaaacgaagcatagcctgcaggtgaccatgggctctggagctggatggctcaggctcaaatcccaactctgccactttctagtaatgtggccttgagaaagtttttaaacttcattctctccttctggcaagcagatatgatgatatctacttctcagctttgttgggagatgaaaacaatccatgtaaattgcttaaatcagtaattggcatatagtaatcactcattaaatagtacctattccttacagttctatgcttatcaggtgctcctggagaactatactaagttcaagtgacctcaaagctgcaggtaaaccagagcctgttcaaagcagaacaccaagatggtatcatctctctaactgttggaggaactaactaggttttagcccataaaggaacaggtagagcaggtgtgaatgcctggattgttttgaggtcccagccggtggaggtttcaggaaaacagttttctgcataacttaagggagaaaatgtaattagtgagttccctaacaagagaagtattcaagcatgcttgttaacagatgaataaaagaaatgcaagctgcagatgagaagctgtattaaatctgtaacatctctttctaccctgagatcctacacatctattccaaggtgcctgctgtccctcttttccccctttagtcttctatttccaggtgtccctgctaacccttgggcttgcttgaaagccaaaaaataataataaatctttgaaatatattctacatgatcatctaaaaatgactacccccgttgaaattactttttcttaagacttaagaagttactttggtctctatgaagtctattttaggcaagtttctttatttgggacacgttcattcaacaaataatgatagaatggctcctatgctttcaacactggcctggttgttgggatgtaaaattaagcaactctgagcgcagtactcacacctgtaatcctagcactttgggaggccaaggcgggtggatcacttgaggttaagagttcaagacaagcctggccaacatggtgaaaccccatctcttctaaaaatataaaaattagctgggcttggtggcacatgcctgtagtcccagttacttgggaggctgatgtaagagaatcacttgaaccctggaggtggaggttacagtgagccaagattgtaccattccactccagccaagactacagagcaatactctgtctcaaaatacataaataaataaaataaaaataaaaacaaaaataaacaagaccctatctctgctctcgaatagttcacaatctcacatgggagagagtgacctccaggtcagtgtgatgaatgcacaaattgaggtgtgccttcttgtgtacacccagcatcacagaaagaagctacaaccaatggctgagggttggggcaatcggatatttgtgtttagaacccctctcagacactccctacaaagtgaaggcatctcttttaacttcccctttccctcaaatttctcttttcacatacaatgtatggctggaattcaaaggaaaattacactgtgatcaaaactgcatatctaaagcagaactgtcagttactattatctattcttgcacacccatgggacatgttattttaagttgatgctgcattcaattaagcccttatgttggctacaacataaatcacatcatctagttttccaatctgatccatcaaatcactgacataacatcccaaacaaatggttgtgttgtgcctatacaaactcactgaaggcaaaggaactagtctattcagtagcatattttttacataagtgaactcttccaggttggaaaatttatcagtgaaaacatattaaataagtaatacagaaatggcacagagagtgcttaacagcatgacttctggagccttagatttaaattcagatctcaattttgcctcttccaggctctgtaaccttaggtaacttatttaatttttccaagcatgagtctcctcacctgtaaaatgaaggtaacaaagcacctgtttcacattgtggtgaagattaaatgagataatatacataaagcattcaccacagtggccagcatgtagtatacatttgaaaaatggcgaccatagaaacaggtaaaagtacggttttgggggcggaggttgcagtgagccgagatcgtaccattgcactccagcctgggcaacaagagcaaaactccatctcaaaaaaaaaaaaaaaaaagagtacggttttgtaggcaacactgtggagtcgctctggcataatgttcccctgggtacccctcatcatggtgacagtgctttggaaaagaatgtcactgcagtacgagcccacgagggccacatagaaagtggttaggctctgcgtgatactggggccacactgctgggttgcaaaccagctctgccacttattaactgtgtgactttggacaaggccatttgcctctctgtacttcaatctccttatctgttaagtaaggataataattgtccccattttgttgagttgtcttaagtatgctgtataaatgcattaaggcatgaaatgcttggaactgttcctgcttcagggtaaacaccacatgcgttagctgttacagtgatgatgaatcagtaggcacaaatcgcttcagattatttcatgctgcctagaagacaaggtagatccaggaaagaactcctgggccaggaccctgactctcgggctctcttccacttctaccacagctttctgcagccctttcctttcctgtccctgctgcttgcccttccctttcccatcaccctgattcctatgctttctcccagcctcaaaggacatccaaatccctcagccactttctgagtcagcgctgctgcgccaagtgcttgtgaggttggttgtcctggaaacaacagcttgctccataaacctctaggaattaggctggtttgagacatgacttggaggagtctaggttatgcagagcatataatttgctcttctctcattttttccagttatgatgatgaacatatctaattcagtagtaggtattcgagtaccttccaaacatgtttattggccagaaagaaaccccctaaacagagaggaaaggaggctgaggtttttaaacttaatcttgcccacaaaacaatttgttcgtgccttgctctggctctagtgagttcttttgcaggccagggcaagcctgcctttcagaatgctgcctgggatcaatgagatggtaggctttgctgttaggcaggccgggatttgaatcccaggtcatcctcttgccacatgtttcactgtggacgaatcacttattctctgtgaacctcagttttcttatctgtaagatgaggatcacatagggtggttaggattaaatgaagtcatgttcgtatagcagcttgctgctccatggttggctagaagtgctcttttttaaaacaaaaaagtaaggtgaaagactctgaggcaaagagacatgggtgttacttggaatgaaaaagctggaaaatgacagaatcttgtattttccctccccctcttaaccactgtcttcatttggagatcttattcaggaggcaaaagaggaaacctggattgtgaaatgtcaacagtcatcttgcacagaagaaaagcagaaacgttttacagttaacactattgaccccaagatttctgacctgacaaaattcctgcaccagcattttctaatgctatattttttccacccaaaacaacttatctgcaataaaattatttcataaaacaagacacaggacaaagatgttctctgttactacccaggtatcttgaactgcataagagaaaaaggtgaatggaggaagattcactatattatttttcatgctttaatatcaaaaaccatagccaaggcttctaagagccttttcaaagatttttatggcccttccttcataattaatttggcaaccaacccaggaaccagtacatagccccattaacatctaggggaggccccactatctactgaagcatatattgatgctgatacaaataatcagtgtcttatgcagcttatgtacaccaattatatgtcagattcttgacatatacagtttttaacccacacgtgaggtaactgaaggaaacttaatgtctaaagtagttaagaactttaataccttctcaggaaactctgtctttaggtttagttctgcagctgaaaaagggaatatttctggaccaaacatttctttaaaatatcaaatgagacgctggaagctatgtgagagtggagggttggagaagggagaggatcagaaaaaataactattggatactaggcatagtacttaggtaacaaaatgatctgtacaacaaacgcctgtcacaggagtttacctatataacaagcctgtacctatactcctgaacctaaaattaaagttttagaagaataaaaaaaaaaaagagaatcttaatgcattatatcagagtgttcaaaaggtcccagagaaaaatgcagtaattatggaagatgtaacttgtaaacatgaaaattatggaagatataaattgtaaaactatcaatacaaaatttcactatttaattccaggcacattttctagattggcttttacaatctgagagaactactctcactaattaaaaactatttattaatttaaatccacatgcttgacaaccctgactctatcatccccaatttttagtgagacagcttcacttattagaaatttagtcttcatatttttgtaatttagggagattaaaatatgagcatacaaactttataacagcaattttcattgcaagatgtttttaattgtttaaaaaaacaaacaaaaacttgcagaaatgttcctattcacttgctcttctcaggatactagcacaagtgatcaggaaaggaataagtcaatattaattattaccaggtctcgccaattattattggtgcctattgcaagtaatcttttacacttctatgtataagtgtgtcttttccaaaggatgtttcgaagcacagctggctacagagattagcagctgagggcccacttattctccagtaccaactcatagctctcaccatcacaaatacactacaaatcctaacttggaataaatctgctttaagaaaatgctggagtaatgaacaaagttcagtgccatgaatcagaaacctaagcatcagagaaggagtggctggtcacaactgtcatagccatgtgacttggggcaatcaccgagccttctgggtctgtctcctcttctgcaaatgaaggaattaggccagatgacctagggtccctccagcctgaagtcaaaatggaagcaggcagcaatgtgtgctatttaaccccccttacaggtagaacattgtaggttaaaacgtgaaacaaatgagtagcctaaaacagactcacattcactgttcattcaactaaaaagctaagcacctgaaggaaggcactacgttcagctcatttctgaaacaatccactcactaaggttagtgtgagcatatctgtgtatataggtgttgcccacaggacaccaagtcctatgtgtgaattcacatcccggggagctttcacaaccacacagcacacactcagcatccgaagaaagacaaacagcactaagaaaattcaattttcatgatgcacaccagggaggctaagcctttttcagtaccctaatctttaaaatggtgcatctaccacctcgatgccacattatgcaaatttactaagaattgtgagtgaagagatttcagcccaattaaaaaaagataaggttttttttaaacgtgtcaattccaagaagatggcccaagaaataagccgtaattactctatcattatatcaactctttaatcacttttttccccttgcctcccaaaaaaagaactgaggggaagtggaatttaaataaaaaatgaatagtccctccaagaaacctccatagaagaggagtatatcttctgacagaacacatctgtgtgcctcttaaaaaggatattctaaatctggagggagttagcttagatccccaccttccaggccctgccatctggaattctcagacccgtaatatcaaactgtaaggaagccggggctggatgagtatccccactcccctaaccccactccaacattctatgtgctaccacgctcccctatttcaacccaactggttgaacaggaaacattcctaagatgagcaggtagccggtggagctgaacccaagtctccccagcccatgtccactgacaccctggtaagtggcaccttcgctcaccttcttcacaaggtagccctctctgatccgctttggttccatgctggctggacaggcagatgcaaaggtcactctcaggcaactcctctcagcagctggg

SEQ ID NO: 1891 - DNA, 22722 bp, Homo sapiens; identical to SEQ ID NO: 1890

SEQ ID NO: 1892 - DNA, 22722 bp, Homo sapiens; identical to SEQ ID NO: 1890

SEQ ID NO: 1893 - DNA, 8430 bp, Homo sapiens
ccaagttgattaacattatacctgtacccatcttgatggtgaaaatagtcatcagtgctgaacacaatgccatcacgattctgaccaagcagaattctgttaataaaagaaatcataaaggtgccatttacaaaatctataaccatcagaaataaactatcagaaataaatataaccaagtgaaataaatcacacaggaaaggttattaaatggatttctgatacttacctgaaagtatatcacgaacagaccagcacaagagctgaataatcttacaaagatttcagatttcaaatcactttacacttaaatctacacaattacagatgctaacagaaactctttttttttttttttttagatggtctctgtcgcccaggctggagtgcagtggcacgatcttggctcactgcaacctccgcctcccgggttcaagtgattctcctgcctcagcctcctgagtagctgggattacaagcatgtgccaccatgcctggctaatttttgcatttttagtacagacagggtttcaccatgttggtcaggctggtgttgaactcctgacctcttgatccacctgcctcggcctcccaaagtgctgggattacaggcatgagccaccgtgcctggccataacaaaaactttttgaagcagcatttgtattgcaactttttaaaacattatttacccaatctcaaaattatatcaactattatccatgttttcactttagtatatttttatttgcctcaatctagtgcaacaggtaacctaaaaagcaagtaagcctaagcaagcaattcatttagaaaaaaccatatgtgactctagacagctttaataaactcatttccatgaagcatatatgatcctctagtgaaagtcggaaatagttggaggcttaaggttatggaacaatctgtgatcctccaaagtataatcaaactttaaatttttaagaacttaagtcgttaaatgaaattattaaacactaaataaaaaactctcagttcaggtcaatgataatcaagctttgttttgaaaacgatactgccttaaattgacaagtacagcaagattaacaagtactcagaactctcattaccaatgactcatgaaagaaattgggagtgtgctatgatagggaaaatgcagcaagataatgatttggatccaagaacaacaacgagagtattttgttgtttctctcctctccttgaaccattaggcatttggatatcactgtataattttgaggggattggtgggatggaaggtggtatattaatagaaggaattgagagtaaaagaatattggcctggaatgattcaagcttacttacctctcactaaaaaaatagtaggaagggtttaaactattaagatgacaagtgtcatctctccatccctcagcttataatggtatcatatacagttctctccctcaatatccatgggagattggttccaggaccacacttgctgctcaagcccttgatataaaaatggctgtttgcatataaactatgcacatcctcccatacactttaactcatctctggattatttataatacctaatactctacaatgtgaatattatgtaaatagttgttatactgtattgtttaggaaataacaaggaaaaaagtctgtacatttcaatacagatgcaatattttttctcaaatactttcagtccaaagttcgttgaattcactgatgtggaatcaacaaatatggagggccagtggtgtattttataaaatcacttgtatcaaaagaaaacaatttaagtatgtataggttggtgtgaacgtaattgcagtttttgccattaaaatgccaattaaaaactgtgattacttttgcacaaacctctatttccacttacagaattacagttcaaatcacttcagacaaaccaaatgtaaattaatgggttgggttgtgtgtttgctttttgggagactggagttggatttctttttcaagcagccatgatttatccaaaacatgtctatctgacatatttggcatcttactgcttatacagataacctagaatatgaaaatgccatgatattagcattctaaagcaaaactcaatcacccaaaaagagattttgattgtaactgatcatgtgacatctaattatgttcaacagtaccagaaatccagataacaccttgtctagatactttatgcttccttttttgtttttttttttgtttcgttttgttttgttttttccattctattactttattagcaggtcatttcttttcttttcttttttttttttagacaagagtccgactctattgcccaggctggagtgcagtggtgtgatctcggctcactgcaacctccacctcccaagttcaagtggttctcctgcctcagcctcctgagtagctgtgactacaggcacgtgccatcacgcccggctaatttttgtatttttattagagatggggtttcaccatgttggccaggctagtcttgaactcctgacctcaggtgatcctcccacctcagcctcctaaagtgctgggattacaggcgtgagccaccgtgcccggcacaggtgatttttaagatgttaataatatcattctacatgacaatcatattttttgtatctaaaaaacggtttaaattttctcaaaataaaaggtgggggagcaatacaccaatttatatcattaaaacaagtcaacaatacatatgaacaaatctctataaagaacattttcttaaatatataaatcataactatagtaaataagtttaacttgaaaagacttttcctcccaggcagcatagactgtttatgcatatttttcaaattccgtgaattacttcaaaccatgaagctttattttatggacttaaaaaaacacctatatgaatctaggaatatctgaatgtcttatcaagcctctaaagcaaaaataaattatttaagaacatcagtattttcaaaattcttagactgtcagaactctcaagtcaggtactaaaatggattctcagaatgtcaaaatttagaaatgtgagtaagtcaaatatctaatttaaaaaaatcaaatctgggctcattggccacttgatttctattttttcaaaacaatagctatctttttgagagcctattttatgtcaaacattttacataaatctatgacctcatttaatcctcataaaagcctgccaatttgataataaactaatccaggagaagaaataattttggcaagttagatggtagtgggagaactaagataaagcacctccttgaccccaaaaccaaaggcctccaatgatccctgcctcctggtactcacaaccttgcatcctcttatcctgcagtatgcttggatttagtccctagcttctaaggaacagaatatgatacaggtgatgggatgtcacttcggagattactaaaaaaaaaaaaaaaaaagtagcttctgtcttagacttgagcttgcatgctttctctttcactttgaaagaaatcagctgtcttgtgaatggacagaggccaagtagcaaagaaatgagagaagcctccagtctctagccagcaaggaactgaagtcttcaatccaacatagctcacaaggaactcagtcctgtcaacaatcttgagagagctcttagaaccagatccttcccaaatcaagccttcagaccagaaacagtcctagccaacatcttgatcacagcattcttagagacactgaaccaaaggcacccaggtaactataaccagagtccagacctacagaaactacgaggcaatatatgtttgttgctttaaacaactaagttttagggtaacctgttatacagccttgagtaatcaatgtactctatacttataatttctcacgtaagaaacaagtaaaccaagagaatctgttcccaaaacaaggcctacaagagagtccattttcatggtttggtttttaaatttctaagaactgagcattactttaatactttcatgtgcatttacaagtgattttcaagaaaaatacaaaatctaagtaaaactgacacatcatgaacacttttcctccttatctactgagtgcctttatatacttcctatcctgagactactttactggggtaattcaatctctaaacactccctgaattaagaatcaagggacctatatgaagaaagacaagtctttcctctggagttaaggagacctacctccttcaaaagaagggagaaaaaaaagtctcctcccatctctctctaaactacggtaagtatattcatttctgtaacttctataacaccacaaacgtaaaacaacaggaatttatcttacagttctgaaggtcagtagtccaaaatcagtttcactgagctaaaaacaaagtgtgtgcagacgtgtgttccttctggaggctctacagaatatgtttccttgccttttccagcttctaaaggttagctgcacacctgggcttatgggatgttccatcatcttcaaaaccagcagtgcagcatcttctctcttgacctttgcttttggtcttaacccttctctgactaattcctcctgcctccctcttattaagaacctttgtgatcacactgggccaatccagttatccaggacagcctccccattgcaagatccttaatcaaatttgcaaaatccaatttaccatctaacgcaacatatgcacaggttttagggattaaaacatgagtatctttggaggggtacattattcagcctaccattgcaaatatccacaataatctgtaaaacagatgataacaacaaaaaactaatttcttaaattccctcacttttcatttattagggggtaagaaagatcccactgttttactcattctctcaaattacttttaaaaacctctattttcttccagtttccttgctggttttgtttttactcttagtcctttatccatctagaagttatttttgtgaatgatttaagataggggctttaaatatttttccagactgacaatcaaatatcctattaccatgtattgaatattttgccctactaatataaaatgtcatttcatcaaatattaaattcttttatatgtaggttatgtttctggattctcttttcttttttcttttttttttttttttttaagacagagtcttgcactgttgcccaggctggagtgcagtggtgtgatctcggctcactgcaacctctgcctcccgggttcaagcgattctcctgcctcagcctcccaagtagctgggactacaggcacatgccaccacgcccagctcatttttgtatttttagtagagatggggtttcacaatgttggccaggatggtctcgatctcttgacctcatgatccacctgcctcagcctcccaaagtgctgggatcacaggggtgagccaccggcacccggcctttttttaaaaaaaaaaaaatagagacagggtctatgttgcccaaactgatctcacacttctggcctcaagtgatgctccccacctcagcctcccaaagtgctgggattacaggtgtaagccaccacacctagcctgtttctgggttctctaattttatctatttgttcttttgctaataattgcaaaattttaactatagtagtttctaaattttaatagctggtgggataagtctcgtttttttaaactgtccttgttatagttacataccaaacaaactttataggcttctcaaattcatacaaaaattcctttgggattttggttaaagtttcactgaatttataaatcaattagggggaaaagtgacatctttatcgggctatcctacccataaacaccctatgggccaaaactatggccaaggctattatggcctactgtctctctctctcagaatatcatccgacatcttgaatacttacaatgttagagacatgctgattgagatgtgggcaaagaccaaattaagtaagaaggggacttgaacactacctccaaagaatatgaattctatccaactgcctacactcattaccacataccaaacataagcattactaattttttttttttttttttttttttgagacagggtctcaatctgtcacccaggctagaaagcaatggcacgatcatggctcactgtagcctcggcagctcagcctcccaagtagctgggatacccaggttatctaggctggtcttgaattcctgggctcaaacaatctgcctgccttggcctcccaaagtgctgggttttcaggtgtgagccatcatgcccagccagtcttttaatttggtcctccaatcagctcaactctgatctaccaattttcactctattattttgtcaaagcttgttttgaatgtgaactcctatatgaagccattcctcaccaaagaatatatgactttatatctaattccaaataaccaacaccagttcactcaaaacgtgttgacctaaagaggtacagaccaggatccttgaagtcaggagtcacgtataagactacacaaccattaagcattacagtgaaggcaagggaaaaacatactataattttattgctagtttgagctcttactagtttttgtaacttccaaatcacttaacctcaacttcctttagcctctgctccttctataaaatgaaaaaacaacccattgcacaagatttttatatatgaaaatactctgtaaattgtgaatcataatacgaatggtacttgttggtactacatacaactttcattcttatatatctatttttcaaataaatatacatattatatctaatcacctctaccatctcccactacaatgtctcctttaaattctatcgaatttccactactttattcacctttaatttcaacatactccaatatgttgtctcaaatctaacttttcttccttaggtttcttctatacccactcttagtcaagtggtcctaactagcagactcttttatccagtttccaaatttcagttatttattgtctctgatggtatatcccaaatctagaagacagcccatgtttgtgagacctcactcctaacttctattattatagaggtgaaatttcatcttctctacaaaatcctcactaaagtaaaaggaatcaaaatacaaagaccaaaatttaattctggaatgaattaattcattcacaaagatcacagtttataatctagcttgaaatatcacaaattaaatctttctctagtgtcttttctctgaaaaagatgtttatttaggtttagattgtcttgttagtaatataaaacatttgcaaaatggtttcttggacctctccatcctcacccaaagatatcaacaaattttctttttctccttgtccggcacaaatcttgaatcatcttatataaactcaagataatttgtactgctttctttacactattttttcacaactgcataaacatattcaagtgcatcaatagtttaaaaatgtaaacaaaaaaaggaatttgaaatatcttgtaatacaataaaccaccaacagttctaacaccaattcagatattactcacttcaaactcctgaattttaagaaatcaaaaaagggttccttctgccaatcaatggtatgaacatggcacagtgctcaacacattcaaaattcctttccttgggtcatctcatttgattcccaattccagaaaaagtaagtatcatttattccattaacagagagcaaaacttgcccaaggtgaaaaagggaaataactgagtcaatacccaaattttctctttttctcacctccaactgaacttgaaaaactcaaattttctaacactgagtccaactttccttgaacagctgactcaaaagggtaggccaggacagttctcaagtagcatttgctttcatcactgccataattatacgtagtgttatctatttttaaagcccttagcagaatctaaatataaacatatgccaattctcctttcttctatcagaaaagatttttaaatagttacactgtcagatgctattctcaagtgtagcaaattaaagattttcttctactagaaacataaaagcacttgtcagtgattacaagtatcattatagttctaacatttttatttcattttttagagacagggtctcactatgttgcccaggctggtctcaaactcctgagctcaagtgactggtccaccctggcctcccaaagtgttgggattacatgcatgagtcactgcagccggcgacaaatatcatttataatttttaaataatgaattaccaagtattcagttggtatcctttacttaccgagacaatgttgttttcccagaaccaggcagacctcttaaaagaataagtaacttctgcaatttatttaacttttcctcttgaaactgctggttcac

SEQ ID NO: 1894 - DNA, 8430 bp, Homo sapiens; identical to SEQ ID NO: 1893

SEQ ID NO: 1895 - DNA, 3376 bp, Homo sapiens
ggggatggtgctaaaccattagaaaccacccccatgatccaatcacctcccaccaggccccacctccatcactgcgaattataattcgacatgagatttgggagatgacacaaaaccaaaccatatcagtctttaaagagttaagttaaaataagctctttaaagtgggccctaatccagtatgactggtgttcttataagaagaggagatttggtcacagacatggttgcatgcagaataaagacttttcgaggacacactgagaaggcagccatctgcaaaacaaggaaagagtcctcagcagaaaccagtcctgcagactccttgatcttggacttccagccactgcaattgatgtcaagcttcagcacccttgcatctctggataaatgaaatgtcaccccagctgccgtccttgttcagatctgtgcaataaagagcaaagcataaaaccaagtcaaggctttgagggagtgacctacaaaatgcataatgtgaaacaatgcaaaagcgaaaggtgcaaaatccccatcaaagagctggaggctgacagatgcgccagtgataattcccatcttccaacacaggagcacagcttccattttccataacagaacaacagccagagcagctggaaggcagggccgcatcccagacttccaccaacaatgggatgagacttgacatctggaatcacaaccacaacagacctgagagacccaccagcttgatgacaagcttcttctttcaaagaaaggtatcagtctgggggacctagtgctgcaaaccatgacaaattaagtgtggcatccctcacttgcataatggaactcagtgatattttttaattaacaagagttatttttatgtaagcttctctcattcctccactgtgcgtgctcgggggctggtggtgaggaaaaagaaaacagctgtgcgggaagcatcaagaaaaggcaagtcatgaagtcttagagatcagtgacatgtaagaaaaagagtgaggagaaaaatattcctactaaagttttccatttgtttaccttccttgtcacatagacttccaagagttagaagtctaggatttgatctccaaatcttcctggcagattactcatcttcatttcattcatatagtccaggggtttgtacaaaggaagatgccagttcttccccaatcataactaagatatcaagagatattcttttgaaatgtaacaaaggagatctgaagttcatctgaaaaaaataaatggcacatttttacctaataaaggaaggtggtatggagcaagcgaatgtgactgtcagtcaagcaagcttgatgcatcattccccgcttccacacctccatgccccaacacaatccctgaccttcctctgcccactggagcaccccacctggactgtgtgtgccacagttcccttcattagctccccccacacactagctttcacatggacactccctgagcaagtagcgctgagctgagcccagccctcttcctccccatttccggtaagttttaggcggtcatgaccatgggatgctggaccaggatggtaagcttcaggaaacagaatctggagaatgcccagctgctcccacaggaagcatcagggaagaagaagaagaggtgtgaagtctgccttctgctctgctgggatccctttcacatctcctttgcctccaggcagttttggttcctggccatttccaggtgtgactcactcaggatggtaagcatcttctctcctacccagagtagaggatgaagacctcatctcagaggttgaagggagctccagagagaggtctcaaacttccagcattaactgctaaagaagcttcatgagctgctggagaacctgggaaatgaccaattatagggacagagctcaaatactctgggacactctagtagctgagaaagttccaactccagggtgatagaggactgcctggcaaaccatcatcaaagcagaagacctgatactaacatcacaggctatggtttattactgaagatcagtgcttacaccctgccagaggttcagaagcaaacttatcattgttctccctggagatgttggcccacattctgaaaagtgtggtcagtagtagcaacagaaagcaattgtgcttgccaagcacaatgtcactgtccccagcccttcccccaacacaacccagtaggtgcttcctggctgcaaacttgggaaagtcacttgacctgtctgaggttccacttcctaatctggcctggcgaagataagaaaaacagtttatttaaagtgtctagcaaagtgcttggaccaaaataggacctctgaaatggttatggtagtgctgttaaggtgatgttttaagtgctgatgagcacaaagatgggtaagatattccttctgttaaaatctacagtctaatgagagagaacaagatgaatgcacaataactgtcattcagaacaggattatgagaaggtgtgaatttctgtgaaaaatcagaacagggagtaatatgatcccaggtgattggcagggggtgggggtctggattcaactggagagggagctggcagggaaggcttcctggaggatgagagttcaacaaggggcaggtgtaggatgtgggtggccaagtgactgggcagaaggagctgcagaagtaagaccccaaatcaggaagacaagggcctgctgagaaacacgagctacaaagtgcaagtgcaggaagagttgggatgagattagaagggggtctggggccagactgtggaaggcccaaatgccgggctaaggagtttgtacttaattcagtggtcaacggggagtcattggaggctgttgagcaggagagttgctttctttacagctgtgccagactaaattaaacctaaacagtactttatagctggaaagggaaggcccaggaatagctcttgactcagaaacaggcattggggaaggtaatgagaaacagccgtgactgatcaaagcagagaggttaattaaatttgtaattattgtgaaaggccattaaaaaccctagttcactagagataactgctctagtggggcttcaaagacaaacgcttcttttaaccttgaatagggggatgtttgcttctctgtggaggagatatgattaagatacttaataaatggtagataaacatgcacacgtgtgtgttctctgtaaacccactcttcgtccctgcatatatctgtgtagctatgtagggtgctccacaagaggggtccccagcccccaggccatagagcgttatgggtccatgacctattaggaaccaggccacacagcaggagttgagcagagggcaagcaagcaaagcttcatctgtatttacagtc

SEQ ID NO: 1896 - DNA, 3304 bp, Homo sapiens
ggggatggtgctaaaccattagaaaccacccccatgatccaatcacctcccaccaggccccacctccatcactgcgaattataattcgacatgagatttgggagatgacacaaaaccaaaccatatcagtctttaaagagttaagttaaaataagctctttaaagtgggccctaatccagtatgactggtgttcttataagaagaggagatttggtcacagacatggttgcatgcagaataaagacttttcgaggacacactgagaaggcagccatctgcaaaacaaggaaagagtcctcagcagaaaccagtcctgcagactccttgatcttggacttccagccactgcaattgatgtcaagcttcagcacccttgcatctctggataaatgaaatgtcaccccagctgccgtccttgttcagatctgtgcaataaagagcaaagcataaaaccaagtcaaggctttgagggagtgacctacaaaatgcataatgtgaaacaatgcaaaagcgaaaggtgcaaaatccccatcaaagagctggaggctgacagatgcgccagtgataattcccatcttccaacacaggagcacagcttccattttccataacagaacaacagccagagcagctggaaggcagggccgcatcccagacttccaccaacaatgggatgagacttgacatctggaatcacaaccacaacagacctgagagacccaccagcttgatgacaagcttcttctttcaaagaaaggtatcagtctgggggacctagtgctgcaaaccatgacaaattaagtgtggcatccctcacttgcataatggaactcagtgatattttttaattaacaagagttatttttatgtaagcttctctcattcctccactgtgcgtgctcgggggctggtggtgaggaaaaagaaaacagctgtgcgggaagcatcaagaaaaggcaagtcatgaagtcttagagatcagtgacatgtaagaaaaagagtgaggagaaaaatattcctactaaagttttccatttgtttaccttccttgtcacatagacttccaagagttagaagtctaggatttgatctccaaatcttcctggcagattactcatcttcatttcattcatatagtccaggggtttgtacaaaggaagatgccagttcttccccaatcataactaagatatcaagagatattcttttgaaatgtaacaaaggagatctgaagttcatctgaaaaaaataaatgggtaagtatactgacaaatattttggcaaaataaaagtaatgaggagatactagcattagcctcatcaggcattaaaatatattataaagttataatatgtaaaacagcatgggactggcactgaaactgacagttcaactgaagagaatagacaagttagaagtaagtcttgatgtatgtaagaatttaataaatttgaaagatggtaaggaaagataggattgcttaaaaaatggttttggtgcaattgattaacttttcataaactgggtcagctcttactagatattgctctgagacactcacccaccccaagtgtcccccagctctctgagcttcccagctatatgacatcagagctcaggaaactctggtcctctccatcctggtctcccaccattttctctgcagcccccaatcttcctgagatcacagctcccatgggcaccattaccctctactgccagcatcactcttgggcaaggaaaactccaccctcccatgagcttcttacgacaaagtgtggtcacaggcctccataactcccatagaacacccgagatcaggaaatctgcaagtatctgggatgtctttattatagtcagtggttgccagaggttagtggggagggagggatgaataagcagagcatagaggaattttagggcagttgaaactaccctgtatgatactataacggtgactatatgacattttatatagtccaaacccatagattatattgttaaagaagaaattattctgccacttgttaaaacaataatgaagattttattcaggactattacgatgggtgttgaaacttactacaacaggctagagaattcaggctcaattccaatataacaaagacagctgaggactcatagcccatgaatagaatgagggaatcagtgggtggaaaattcctaagaggagaaatcaagagcagagagattcttgttaaaccaacttagggttcttgctaaaggcaagccagggtgaccagatatcaagagtgggggaagcagaaattgatcatacatccagagtgatcagatttcaaagatgtagcgtttctcactaaactgaccgagcaagattttttttagacagagtctccctctgtcacccaggtggaagtgcagtggtgtgatctcagctcactgcaacctctgccttccgggttcaagcgactgtccttcctcagccttcagataggtgggattacaggtatgcaccaccatgcctggctaattttttcgtattttagtagagacggggtttcatcatgtggcccagggtggttgcaaactcctgagctcaggcaatcctcctgccttggcctcccaaaatgctgggattacaggcgtgagccaccgcgcccagccacaagatacttactgagtgatgcaagcccagcaaggacaggccggaggcccaggtcgaggcctagtcaagaagaggactcagaggagcataacaacagcttggtcaaggatcaggagtctttgtcagtgtaacacccagagtgagctgtaatgtaaactatggattttgggtgagaatgacatgtcaatgtagggtcatcaattgtaacaaatgtcccactctggtgcagaatgtcaatagtgaaggagactctgcaggtgtgcggtcaggataacagaacagaactctgtattttctgctcaattctgctatggatctaaaacttctctaaaaattaaagtccattaaaatatttttaaattaaattggtttaaaaaaggaaatgaaattggatcattcctgactatggcacaggtagcaagaccagccctatgcccttccctagacaggaagtttcaagccagatcactagctctggtgccaatcgatccctagagatttgataatctttgccatgcccaatagtaggagtgctggttctttcatgcatggctccctgttctatcatctctctccacttatcctctgttctgttgaaaacacttcggattggctacccaagagctactcataaccccttcccgcttgctttaat

SEQ ID NO: 1897 - DNA, 842 bp, Homo sapiens
cagggtctcactctgccaaccaagctggagtgcagtgatgtgattgtagctcactgctgcctcaaattcctggactcaagccaccctcccgcctcagcctcccaagtagctggattacagatgcacaccaccatgcctggttaactttcaattttttgtagatcagggtcttgctgtatgacccagactgtcttaaactcctgggctcaagagatcctcccaccttggccccccaaagcactgggtttataagcataagccaccacactcagcccctatactacttcttacaactgcaggtaaatctgcaattatctcaaaatgaaaaggcacttctccttgctgctgccatgtgaagaagaacatgtttgctccctcttccaccatgattgtaaattttgtgtggcctccccagccatggagaactgtgagtcaactaaactgctttcctttacaaattacccagtctccagtatgtctctattagcagtgtaaaaatggactaatacaccttgagagctgatatttaaaaagagcctccctctctactctctcttgcgtcttttgccatgtgatctctgcacaagttgctcccctttcccttgcaccatgagtgaaagcagtttgaggctctcactagatgtagatgtgggcaccatgcttcttatacagcctgtggaacatgagccagataaatctttcttcataaattatccatcctcaagtgttcgtttatagcaatgcaaataggccaaaacagtgatataaagataaggaggttttttgttgttgttgtcttcaaagttactgacaaggaatacaatggggtgttaagatttgac

SEQ ID NO: 1898 - DNA, 3261 bp, Homo sapiens
ttctcacgcgcgcctccaggagagacgcctccttcttaagtccccggcccctcccgccaacggtcaccgggattcctggaagagacggggatttgggggaaacggagagggttctgcgaggagacgggaccagtgagacaggggctattctgggcctgtccgagttgggaattccccagagacctggaacttgctctccacagccacagccttggccccgccctgtatctgtgctgccgccagtaaggctgcccctggggagggcggagccagaacctcacagcctcacagggcagagcaaggctggattgacggacaccaggccgagaagaaacccttggggttggcggcagttcttagtgagggcaattcattcaatccagagccagaaacaggattttatttaaaatttattgtaatggggtccgcgcaaaaggaaggggtggagggtggggtacatgcaggggacacaggaacacgatgacatggccagggccacaacttcttctgtcgtggggaagagggatgaaaagacaagaccagggctggagctggggtggaagaggggagggggacactggctgcattcccccgcccccaggaagcacctctaggccctggacccctcgctcaccctggcccctaagactccatctcttctctgcctctggccctcctggctcttcctcctgctccccttgactttttcccctgacagattctcaagtaggacgatgttcagggcctgaccccaaccccccataccaccttatgaaggtacaacctttgccggccctgcttctgcccctcctcaaacctcaccgctttccctctttgggacagctctgatccccctccttcctctcctccctccccctggaaaaaaaaaaaaaaggaaaagaaagcaccaactccccggggaggggctgcagacagcagggggagaggactggaaggagagaagaggaccgtcgagggaagaggctcacaagtccctgggaagacagggcatgggcttacagagaggagagggggtacgggcagtggctgctcgtgtcctctgccacccctgcccactgtccaggggacttcaacacaaccgaggggacaggtttgtgtggggtcaggtctgacagaagaggagcaggagaaacaaatcgttaaaacctagcgaattcccctaagaaaacatttcttcctcctttccttctggaggctccttggttggtagggaaataggagttggtgggaaaagaggggggagaggagcttgtaccaagggactctactccattctcccctctcccccgcaaccaacttggagctcaccagggttgggagggaagtggctgagagctcacaggcaccccctccgcccccgagagggagcccacagctgtgggaggggctgctactgctgccgctgctgccgctgccgccgctgccgctgccgccgccattggacaaacctcaccagtacctgcacaggagaaacaccacggatcacagcgcgatctgaatggcaagagccttgccctcaccccacaccttcccagcctgcttcccctgggacacagccgttgctcacttcctatctggaccccagaggcctcagcctgcatcctcacccagacagagcagttctcaaggatcctccctgtgcccagaagtctccctagcctgagtggtacatgggcatccctcgccttcctgagatcccctattgggccctttgagccccgttgtcccccacaccccccatcccgccccccagccatgccccacgccttgcctggtgggtgcgggggtccccctcagcaggtgggctgtggctggggggcgtctcccgggacagggggggcggccccccccagatgggtctgcatgtggccggccagctgggcaggggtcttgcagtgcacgctgcacagcttgcacaggatgcggtcagcccgcggggcctggagcccgtggtccttcaccgcgtggatgcgcaggtatgctgccgtggtgaagcctattggggggtggattgggatggggcgggggtcagccaggcggagaccccagagacggggctgatctcctaggcgggggatgccctcctcagatggccctgtcctcctcccacggtatccttggtagcctggggccaactgctctgttggggctggtagacacagcccctccctgagcctggggcctggcttgtgtggtgcccgcttctcagccttggtacctacagaactcattctccatggccgggagacctctcccaggatgacgagacactgactcctagccacttgcagggttgaccctcagcagagacggctgtgtccccttccctccagtgccccgcggtctcaacccagttaaccggtgagtctgactgaaggcagctttctctgctacccgtgcagggtgcgtgctggtaaagcccggcccgtgtactccacctgccccaggagctggagacaagaccttgtggctgcgcagcggaaaccttgccttgtgacccctggaactggctttcttgactactccttccccagagcagccaagttccactcccgctttccccacacattaccaggaggttcaacctctctggcagatcatctcttccaaccaggacttcttagagtctaatgatgttcattcaggtgtccccccgctgctcccttgacctcttgtaggaatctagacgccacgagctcttggctacagcacccttaacccgtatccgtggcaaggcgtctggccaggcgcccaccctctgcccctggccctcccggcagccctcggcatgtacctttgttgcagagctcacagacatggtgaggaccctggctgtgcaccttcatgtggtccgaaatataagccgagctcagcatcttgccacacacgtgacatggcactttctcctcgtgtcgtactgtgtgcgcccgcagccgatccttcgtggcgaaagctgcctcacatttctgaggaggggggaggggcgtggggggtgtcacaggagagttaaagcttggtgggctggggaggggggagcaagagattaaaggaatcagagccttggggatctttgatctgtaggaaatgggagtgacatgatgaggccttgaagaagggatgagaaaatggagcaaaaaggcaaaaagaagagagagaaaaagggggtctgagagactgactcagacagctaccatgaggatcaaaatcatgaaaaccaagacaggaggaggcgggcttcct

SEQ ID NO: 1899 - DNA, 2718 bp, Homo sapiens
cgaggagacgggaccagtgagacaggggctattctgggcctgtccgagttgggaattccccagagacctggaacttgctctccacagccacagccttggccccgccctgtatctgtgctgccgccagtaaggctgcccctggggagggcggagccagaacctcacagcctcacagggcagagcaaggctggattgacggacaccaggccgagaagaaacccttggggttggcggcagttcttagtgagggcaattcattcaatccagagccagaaacaggattttatttaaaatttattgtaatggggtccgcgcaaaaggaaggggtggagggtggggtacatgcaggggacacaggaacacgatgacatggccagggccacaacttcttctgtcgtggggaagagggatgaaaagacaagaccagggctggagctggggtggaagaggggagggggacactggctgcattcccccgcccccaggaagcacctctaggccctggacccctcgctcaccctggcccctaagactccatctcttctctgcctctggccctcctggctcttcctcctgctccccttgactttttcccctgacagattctcaagtaggacgatgttcagggcctgaccccaaccccccataccaccttatgaaggtacaacctttgccggccctgcttctgcccctcctcaaacctcaccgctttccctctttgggacagctctgatccccctccttcctctcctccctccccctggaaaaaaaaaaaaaaggaaaagaaagcaccaactccccggggaggggctgcagacagcagggggagaggactggaaggagagaagaggaccgtcgagggaagaggctcacaagtccctgggaagacagggcatgggcttacagagaggagagggggtacgggcagtggctgctcgtgtcctctgccacccctgcccactgtccaggggacttcaacacaaccgaggggacaggtttgtgtggggtcaggtctgacagaagaggagcaggagaaacaaatcgttaaaacctagcgaattcccctaagaaaacatttcttcctcctttccttctggaggctccttggttggtagggaaataggagttggtgggaaaagaggggggagaggagcttgtaccaagggactctactccattctcccctctcccccgcaaccaacttggagctcaccagggttgggagggaagtggctgagagctcacaggcaccccctccgcccccgagagggagcccacagctgtgggaggggctgctactgctgccgctgctgccgctgccgccgctgccgctgccgccgccattggacaaacctcaccagtacctgcacaggagaaacaccacggatcacagcgcgatctgaatggcaagagccttgccctcaccccacaccttcccagcctgcttcccctgggacacagccgttgctcacttcctatctggaccccagaggcctcagcctgcatcctcacccagacagagcagttctcaaggatcctccctgtgcccagaagtctccctagcctgagtggtacatgggcatccctcgccttcctgagatcccctattgggccctttgagccccgttgtcccccacaccccccatcccgccccccagccatgccccacgccttgcctggtgggtgcgggggtccccctcagcaggtgggctgtggctggggggcgtctcccgggacagggggggcggccccccccagatgggtctgcatgtggccggccagctgggcaggggtcttgcagtgcacgctgcacagcttgcacaggatgcggtcagcccgcggggcctggagcccgtggtccttcaccgcgtggatgcgcaggtgcgtgctggtaaagcccggcccgtgtactccacctgccccaggagctggagacaagaccttgtggctgcgcagcggaaaccttgccttgtgacccctggaactggctttcttgactactccttccccagagcagccaagttccactcccgctttccccacacattaccaggaggttcaacctctctggcagatcatctcttccaaccaggacttcttagagtctaatgatgttcattcaggtgtccccccgctgctcccttgacctcttgtaggaatctagacgccacgagctcttggctacagcacccttaacccgtatccgtggcaaggcgtctggccaggcgcccaccctctgcccctggccctcccggcagccctcggcatgtacctttgttgcagagctcacagacatggtgaggaccctggctgtgcaccttcatgtggtccgaaatataagccgagctcagcatcttgccacacacgtgacatggcactttctcctcgtgtcgtactgtgtgcgcccgcagccgatccttcgtggcgaaagctgcctcacatttctgaggaggggggaggggcgtggggggtgtcacaggagagttaaagcttggtgggctggggaggggggagcaagagattaaaggaatcagagccttggggatctttgatctgtaggaaatgggagtgacatgatgaggccttgaagaagggatgagaaaatggagcaaaaaggcaaaaagaagagagagaaaaagggggtctgagagactgactcagacagctaccatgaggatcaaaatcatgaaaaccaagacaggaggaggcgggcttcct

SEQ ID NO: 1900 - DNA, 2718 bp, Homo sapiens; identical to SEQ ID NO: 1899

SEQ ID NO: 1901 - DNA, 2718 bp, Homo sapiens; identical to SEQ ID NO: 1899

SEQ ID NO: 1902 - DNA, 2718 bp, Homo sapiens; identical to SEQ ID NO: 1899

SEQ ID NO: 1903 - DNA, 2433 bp, Homo sapiens
ttctgggcctgtccgagttgggaattccccagagacctggaacttgctctccacagccacagccttggccccgccctgtatctgtgctgccgccagtaaggctgcccctggggagggcggagccagaacctcacagcctcacagggcagagcaaggctggattgacggacaccaggccgagaagaaacccttggggttggcggcagttcttagtgagggcaattcattcaatccagagccagaaacaggattttatttaaaatttattgtaatggggtccgcgcaaaaggaaggggtggagggtggggtacatgcaggggacacaggaacacgatgacatggccagggccacaacttcttctgtcgtggggaagagggatgaaaagacaagaccagggctggagctggggtggaagaggggagggggacactggctgcattcccccgcccccaggaagcacctctaggccctggacccctcgctcaccctggcccctaagactccatctcttctctgcctctggccctcctggctcttcctcctgctccccttgactttttcccctgacagattctcaagtaggacgatgttcagggcctgaccccaaccccccataccaccttatgaaggtacaacctttgccggccctgcttctgcccctcctcaaacctcaccgctttccctctttgggacagctctgatccccctccttcctctcctccctccccctggaaaaaaaaaaaaaaggaaaagaaagcaccaactccccggggaggggctgcagacagcagggggagaggactggaaggagagaagaggaccgtcgagggaagaggctcacaagtccctgggaagacagggcatgggcttacagagaggagagggggtacgggcagtggctgctcgtgtcctctgccacccctgcccactgtccaggggacttcaacacaaccgaggggacaggtttgtgtggggtcaggtctgacagaagaggagcaggagaaacaaatcgttaaaacctagcgaattcccctaagaaaacatttcttcctcctttccttctggaggctccttggttggtagggaaataggagttggtgggaaaagaggggggagaggagcttgtaccaagggactctactccattctcccctctcccccgcaaccaacttggagctcaccagggttgggagggaagtggctgagagctcacaggcaccccctccgcccccgagagggagcccacagctgtgggaggggctgctactgctgccgctgctgccgctgccgccgctgccgctgccgccgccattggacaaacctcaccagtacctgcacaggagaaacaccacggatcacagcgcgatctgaatggcaagagccttgccctcaccccacaccttcccagcctgcttcccctgggacacagccgttgctcacttcctatctggaccccagaggcctcagcctgcatcctcacccagacagagcagttctcaaggatcctccctgtgcccagaagtctccctagcctgagtggtacatgggcatccctcgccttcctgagatcccctattgggccctttgagccccgggtgcgtgctggtaaagcccggcccgtgtactccacctgccccaggagctggagacaagaccttgtggctgcgcagcggaaaccttgccttgtgacccctggaactggctttcttgactactccttccccagagcagccaagttccactcccgctttccccacacattaccaggaggttcaacctctctggcagatcatctcttccaaccaggacttcttagagtctaatgatgttcattcaggtgtccccccgctgctcccttgacctcttgtaggaatctagacgccacgagctcttggctacagcacccttaacccgtatccgtggcaaggcgtctggccaggcgcccaccctctgcccctggccctcccggcagccctcggcatgtacctttgttgcagagctcacagacatggtgaggaccctggctgtgcaccttcatgtggtccgaaatataagccgagctcagcatcttgccacacacgtgacatggcactttctcctcgtgtcgtactgtgtgcgcccgcagccgatccttcgtggcgaaagctgcctcacatttctgaggaggggggaggggcgtggggggtgtcacaggagagttaaagcttggtgggctggggaggggggagcaagagattaaaggaatcagagccttggggatctttgatctgtaggaaatgggagtgacatgatgaggccttgaagaagggatgagaaaatggagcaaaaaggcaaaaagaagagagagaaaaagggggtctgagagactgactcagacagctaccatgaggatcaaaatcatgaaaaccaagacaggaggaggcgggcttcct

SEQ ID NO: 1904 - DNA, 2433 bp, Homo sapiens; identical to SEQ ID NO: 1903

SEQ ID NO: 1905 - DNA, 2433 bp, Homo sapiens; identical to SEQ ID NO: 1903

SEQ ID NO: 1906 - DNA, 2433 bp, Homo sapiens; identical to SEQ ID NO: 1903

SEQ ID NO: 1907 - DNA, 2433 bp, Homo sapiens; identical to SEQ ID NO: 1903

SEQ ID NO: 1908 - DNA, 2433 bp, Homo sapiens; identical to SEQ ID NO: 1903

SEQ ID NO: 1909 - DNA, 2433 bp, Homo sapiens; identical to SEQ ID NO: 1903

SEQ ID NO: 1910 - DNA, 1230 bp, Homo sapiens
ctgagagcgacgggccatgttggggccaggggcctggaggggcagggagacacatgactaggggtgggggcactgggaccactcctaccctcgagcatggacacactgtggaaagggccgtcagtgacttgggtaggctggagtttagcccatgcccaggaggccttccagggcaccagccgaaccaggctcacagagagcaacccagaccctaggatgcccctagctgaggggacactggcagagggctggggcacaggtatcccagccctgtctctcctttctctgggaggctgaggcaggaggactgcttgaagccaggagtttgaaaccagcctgggcaacacagcaagaccccatctctacaaaaaattttaaacattaggcaggcatggtggcgtgcacacatagtcccaggcacttgggaagctgagacagaaggattgtttgagcccaggagttggaggctgctgtgaattatgattgtgacactgcactcctgcctgggtgacagagtgagaccacatcactacaaaaaataaaaataaaacgaacccccccccccaaatatttcatgactgttggcttaaagacaaacaatccaggctgcattcatcattataatattcacttttttcttattttaagacattcacggacccctggcactgtgcctactggacaagctggtgccgcccatgctgcccatgtgtccgtctctgactgcctgggagactgtgggtaggtcactgcacctctctggcctacctctactgcacaacacagctgagggtccacatgacaccacgcctagcccaagtgtccaggctccaggctgtgtgtaatgggggcagggaccatccagacagtggaagcccccgtggccaggagccctcccagcagacatgcctcgtcctcacagggtgatgcccagacctccaactgcttcattcctcacgtcgtctcctttcatgggaagtggggttcctgagtatctggaaggaggaccccatggaaggatctggagttcctacacaaagtggggtgaacctgtgccaagttccgatgggcgcaggagggcgcggaggctctaggcggcggaaaggtggggtgcggaggacggggctcacagaccggaagtcgctcagtgataacttgcggagtgggcaccccagcccccaacggggtcagtgcaccctacgagctcgcggctgcggccgctgggtgccc

SEQ ID NO: 1911 - DNA, 1496 bp, Homo sapiens
cagggggcagtcagagctctttccatttcccacaattgcctggccacctaggtctaaaatgcagagagaggacgtgcagggggtggctctggagttacaaagctgcccctgaagcctgctggacgggacacgggtcgagggaaggacatttctccattcagaccctgtgtgagaaacgcaccacacggaggagaggtcttgaggaaaggccctgtcgcgtttcacgtggcacgccctggatctcttgccgtaacagtggctcaaaagaaaatgcaccagagtaatgatgctgtgggctctaagggtctccgcaaagacgcacccccctcataagcggattctagtctctgggtttcactgccagcctgccccagagcagtgcttggcccaacaccctgccaacggggtgagcgggcttacaaaccgctcatgcgtgaaggttacgtaaaaacaagccgcccagctcccctgcaggcaggcggatggacaaacggcactgctgggaccctgcttggccatgggggaaggacacacacagcctgggtgagtccccgaatcactgtaccgagtggaagatgtcagaggaaaccacgtacgcactgcaggaggccattatgcaaagctctagaagatgcaaattaacctacagtgactgaaggcagaaagaaaacaaaaagcagcccaaggcgaaaaagtcgatcctgtgccctgagcacaggcagtcctgaggtgcgagcggtttcccaccaggctcttcttggcctttcgagaacttcagcccctctctgctgtttcctgttgctggcatccactttcccatctcacaatattttctcctgtctggtctcctgtatctgaaacccactgctacgggatctcccctctttctggaaaatgttcattaaacaggaaacaaacccaccctttaagcatcttcctttcttgcatgaagctgagtaactcaccatctgcccttgcttccaggcagctcagctagactgcccacagccacactgtccagtatggaagccctggccacatgtttacattaattaaaataaaacacagccgggcatggtggcacgagcctgtagtcccagctattcgggaggctgagatgggaggattgcttcggtccagaagtttgagaccagcctgggcaacgtggcgagacctcatctccgaaacaagtaaatacaactaaaaatccagttcctcagttccatgagtcatgcctaaaatgctcaacggccctatgtggccagcagctactgaagtggacagcaccaaatacaacatttccatcatcccagaacgttctgtcagaaaggctgctccaaagagacagtccttgaccttccggaactgcacagtttggtgagatgtgtgcagagacagaggaaagccggcttccctttatccacacacacagatggccagcatctccgggtgtgccgagaaaaggaaacaacaggctcaggctgaatgaaccaaag

SEQ ID NO: 1912 - DNA, 1496 bp, Homo sapiens; identical to SEQ ID NO: 1911

SEQ ID NO: 1913 - DNA, 1496 bp, Homo sapiens; identical to SEQ ID NO: 1911

SEQ ID NO: 1914 - DNA, 1496 bp, Homo sapiens; identical to SEQ ID NO: 1911

SEQ ID NO: 1915 - DNA, 1902 bp, Homo sapiens
gccccggccagaaacaggtcaccacccactgccctggctgggccccagccaccctggcatgtgcttggggatggggtgccagaggcctctgacttcccacagtgcagggtgaggagcccaaggggcactgcgggagttgggccaagaagcggggtccatgctcctggtcacccccagctgggcccaggaccgccgctgccctcccccactcactgcccttccccactgccctgtgtgtaggtgtgggcgtgtgcatgtgggagctggtcccaggatggctcggctcccagcaggaccagctcagagaggacaggatgtcatactcaactcagtcaggtgccagggcccaggggcatcggagcaacctgccagctccagaaacgctgcttagctgaggcccatcccttaaggaacagaagcagcctgtccagcccctccccacctgcagttgcctcctaacttggggcactcccctgggggccaactggggccctggagccctgggtcagcctttccctgccagtttgcttagctctgccgggcagggtcaggtgggggcccaggtgcctgatctgcggcgctcccaagcaggaacagccatacctcagggcacctgccacaagccaaggcccagcgcccagggctggccagtagcacaaaaactacttacccaggtaagtgcctaccagagcggtggacagcagagggaagaaacacatgctttaggttagtgagccacacgcagccatctgcaggccccgcaggtggggacagcgcaacaggctgcacgggcaaatggccgggttagagcgctggggccccgtgctgtgggcaggcagggccctcactcgagctcagctcatgcctacccaggctggacagagaccccacctcgtgtgcgccagtgcccccgggagccgtcttcacccagctggcccctctccagcgcccaggtcctggccgctacacgtcaggacaggcgcttcctctgtggctgacccctctgagcccagggccccgcccagccaggcggcaaggggtgatgctccctcacaagcactgcatggctgggactcacgtgtgaggtgtggaaaattcagtgggaacaaataagcttttatgtaacttgctggttaaccgctttttacaaaacaaaacaaaaagctcgaagatgcctgctgacaaggactccctcctgtttctaccagctcttatggggctgttcctgggacgccctgccattaggaacagacaagtaaagccagcccagagtgggctggccctgggcccaggactaggcaatgggggcagccccaataccagatggctgggagggtgccccaggaaaggagggctggggctggggccgagacacagacaccgccaagggatgtcgggaggaagctgcaaggacaggccaggggtgcgtgtccagacaggtggagatggggggcccggcacccgatctcaggcccaccctgcgctgcagccggcgtgctgaccccacaggacgtgcctgccaggacacccagcagcctcgagagaatgccccaaggggacagggttggctgggctgggcagccactacccatatccacctccaggtcgccaaaccggccctgctgccctggccagcaccgtcagtgaaagccgcctggcgaaggggctccaggcacatccacactggcaggcccagcacttgcacacccgggccccacacacctggcctcctcatgctaggcttggtcctatctgctcttccccaaggggcctggggtcccgcagcccctgctccaagcaaccggcacagagcacctgagccagtcctccgacagaaggcacccatgtgtacaagctcagttgcccacggcccacacagacacccccgaccaccctccccac

SEQ ID NO: 1916 - DNA, 8189 bp, Homo sapiens
gttcggagcagatatgctctgactcatattttaaaatctctctttggttgctgtgtaaacaacagactggagagaggccaagagcacaagcagaaaaaccagccagggtgctatttcagcagtctaggtggagagtcatggtgacttggacccatccaacagagacgaagacaactaaatggattcaggatatattctagagataacgagtcctaactctttgccaaggatatggcaaagactctgatggaaaaggcagtaatgtgtacacaaaggtgaacataaataaatgtgtgtatgataaacgctgggaatggacatagaaaaacgggtatgcaattggacagagacgacgggagacagaaggaaagatacttgctcagctgtatctaagtaagttcataggagtttcatggtctgaaaaatctgtgacagtggaatttctactaagaagcttaaaaaagtttcaccttctccttggacacttcagaataaggccttcttagaatataatgcattatatcacaaatatacttttatataaaatatttgggaccaaaacaagagtaaagaaccaggatccgaaagggtgaatgcctactaaatatctttgattatctaaagctgtttaaaagctattagattggcacctggaaccccaaaatatccacttttcactgggaaggagtggctgtgcctcttcaatcatcccctaaatgcaaagaagtttgacccccacgcaatggataaaagtcacccaaaaaatgaacaaaagaggtgtttggaaaaaccagaacaccattcatcccagctaacgacttgttcattatgagtgatgatggataaagacttctcatgctgagatgaaatcaagatttatatgcattgtttcctctcccaacttgtgggaagatcatcatcatttaattctatctctgcggccagtgatgggcatccagagagctggttatcaaacggcgcagtcagctggcaaaagccgaaacgtgcagttggcacatctggacggagccgccacagccgagggtgaacaatgactcctggcaagcatccaaattgcttgcagacgctagcaggtctcatctacaaccgcccctaccagcatctctctctctctctcttttttatgagaatcagattttcattgctccattcaattgctctcctctgccattttttacagctcttatcgttcccctggaatatggccttgagacagctcatccgtgtccttcactgtgttatctcttctaacttttattaaaacttcagctttcatctgaagatagctaattaaatctggaacagattatatgcctccccttaaaaagagcacaaaactattttcttcaaccccagcaatgctttttttcctttccaaaaggtaaaatcaaaggtgtttaagaagtctctttatttacagagctaagatattcaacacgtcatatatgagttgatttatattaaagttgtctgtgatatgacaaatctttgagctatttctcaagatgattatttctcaatcctggtatatatcctttaaatatcacagctaatactataagcatattttctatataaagttgggtaatgaggagttaagttattagtgcacatcaagtgatttgtctttttattcgtcttttttttttaaaggttgccctcatttgataaggatgaagagaaatttttcttttcttccccataccacaaatattagtaactaaaagttctcccatgggaaattatgtgaaaacatgaaattaatagcagtgattcaagtttaggactgattcggttttcaagacagctttatatcaactgatcatcagcacaagtagctctgtctgagtctaccacaaattattaatgaaggaacttccacaattgatatgaatacattcttctcacatatgccgctgacccagtccctttctgaggccgaggggcagtgtacaatcaccttttcttgcatagatcagctaaccaaaccttctagcaatgacatctgaaagaatctagccagccatcacacacacacaccccctatgcccttttaataagggttaagcttctactactgtgagaatatgatttaactatcccacctgaaactttctgggatccttttcttcgcttcactgccttcagtaagatttccttcatggtaacctttgtgttgtccacctgaataagggagaatccatgagcagcatttctgtaggaaaagacaaatattaaatcatcaccaacattcatccagagagatgttactgcaatcttcactgtgtttaagcaagttttttttgttgttgtttgttttgttttgtttttgaaatggagtctcgctctgtcacccaggctggagtgcagtggtgcaatctcggctcactgcaagatccgcctcctgggttcacaccattctcctgcctcagcctcccaagtagctgggactacaggcgcccgccactacatccggctaattttttgtatttttttttttttttagtagagacagggtttcaccatgttagccaggatggtctcgatctattgacctcgtgatctgcccgcctcggcctcccaaagtgctgggattacaggcatgagccaccgcgcccggccgtgtttaagcaagttttaaaaatacataaatccattgtggcacaatgtaatatgtatcaccatgctacacctgcggacgcttccgagcggctgccatgtctgtgcagtcaggaatgataagtgaaccacccgtgaatgttaacgatagtgatcattctgagaaaaagtttgctgagctagaagcggtggctgaagcctataatcccagcactttgggaagctgaggtcagcagatcacttgagtccaggagtttgagaccagcctgggcaacacagcaacactctatctctacaaaaaatacaaaaagtatttgggcatggtggtgcatgcctgtagtcccagctacttgggaggctgaggtgggacgattgctcgagcctgggaggcagaggttgcagtgagccaagatgatgtcactgcactccagcctgggtgacagagcaataccctatctcaaaaaaaaagtttgccaaccctaggataacgtggcgagatttggggggttatgtgttccagcagctagagttatttaacataactaacaaacttagtaaaagtcaaatggcattactgcaagctgcatacagaacttgtttgctgaacagagaaaaatggtgacagaattcagtgggcacaaagatctctatgaacagtcttgctggtctctgaaaaatctgtgctgtttggtgccaagtcacactatacacaagtatcagtcaggcagagcccacttatgtatagaccaagcaacagataaagtagagtgaccaatctggtttacctaggatggaggaaggggttggaggtgagcatcagggagtgctcatagattcaggactttcagttttgaaacagggagagtcctggacaaaccatcacaaactgatcatactaacagaaagcgtggtgggccaaacgtaaagtagagttttctaggttaggagcggtggctcatgcctgtaatcctaacactttgggaggccgaggcaggaggactgcttgagctcaggagttcaggaccagcctgggcaacacagtgagaccttgtctctactaaaaatagagttagttgggcatggtgacacatgcctgtagttccagctacttgggaggctgaggcaggagggtcctttgagcccaggagtttggggctgcagtgagccatgatcacatcactgcactccagactaggccacacagcaagacacttatcaaaaaaaaaaaaaaaaaaaaaaagcattttctagtaaagaacatttaaaatttatgtgtttgtgtggggggacacattataaatcaattggcccactaaaataatggacgagtagttaaaaatacactgtttaaaaggatgttaatcgtgatgtctcatatgaaaatcaaaagactcaagttgacaagtaaaacatttaacacccaattaaacccaacatcagcaatgtttaatttcagcaaaacatcatctgttacattaaagttgttaatttgtattttattaacgttataattttatctgtatttagtttgtaattttgtttaggttgtgtaaaaacactgaatttatagctaaacattacagaactttgtatttgcatgtatctaagtagcattattaaaaaactcatttggataaacattgagactttaggagaatttatttccctttaaaagagttctgtacataacttacatttaagaaactccctcatgacaattccatgagatagttactgttacccaaattttaaagatgaagaaactgagacttaacaaaggtaagtaaaattgtctaaggtcatgcatgtagcaagatactattgaagctgaaacatgaacccaggtttgcctaaattcaaagtctgtgctgccgcacttagagggaaagatggtactggagccccgggaatagccggtgtgagggcctctaaaggtcagaaggcgacatgggcttcctggtatttgaaaggcaggaacgggtgtaaaaaaggggaagaggtcttagaaagcaaggtgggacacactgctgggtcaggtgtcctcctggcagcccacagacacctgaagtttcagtcattccttctccatgaagccctgtgctgggtgctcaggatacagagagacaataagactgtgccttcctagtcttcaagaagttaatggtcttgctactaactcagaggatgtgtgctcataagaggactcatttgaaagtatgtagatcctcgatgtttacccactgcccatgttcactgaaagttattccaattcagctttttcagtccagctgagcaatgtccacctaaacactacccctcctctgctataaaacaaagtcggagaagaaaaatgtagaagtggcagagatctactcagtaacccattcaagaaatacgtgtgacagatctatcacagtaatggagtgatggtgagtattgtgggcacagataattcagttcttgctctccaagggttgtttattaatagtaacaataacagcagctaacactaagatgatgcgtacatatgctaaacactgttctaagtgcttcagatctattaactcatttaatcctcataactgatctgtgaggtaggtattattatctccatttcactgagccacagaaaagttaaatattcatccaggaccacacacactagtaagggcaaggctaggatcggcatccaagcgatctggctcacagcccaccatgctgtcacctactgcactatagcagtggctgaatgtcagccttaagacagtgagattcacaggttaaaccaacaccagattccccagcctcaatctttcagcagagggttggaaagggcatggactttaaagtcagggatggcgtcaaatccaggcctaagaacaatattgctcaccctcaggttccacgcctctaaattgttcataaaaactgggctattttgggattaagtgagatagcatatgcatagttggcccttagtaagtattagttcactccctatgtcaaacctacttgcctctttctgtttcagcttagtgtcttcccagccacttcttgtccctcctctactgggagacaaatggaaggaggaaaggggggaaatgacgaggaggagtagttacggctttatttattttgctgggatttccttctctgaaactttagacacatccctacagactcctgaaggtctgctctgttctgcatctgtaggagaagctttactaacttagaatatagaccagaaaggcgagtaagaggttgctgaaccaagaaaatacacacagggcaaacggtcagtaatctgtactatttcatcagacgactgagaaaaagaaaatttattgacacttttgttcttaatgctcacatataaagatttcactttacctcgtgttttcagaaacactccagacacatcaaataaactctcttgaattttaaaatagaaaaaggattgactgggctatgtgtgtgtctgggagtgggaacacagggatgggagtaattcaggatcaaaaaacagagtattaagtttaaagcagttgttactctctgccttccccctccttcctattctccagaaggcagggttcatagtgaaacactgtgtagtcttagatgcccctcctggaaaggcatatgaatcctagccccactccactctactgaaaactcagtgatttaaagcctcttgctttaaaaaaggacttctggttcaaaagactgctatgatcatgtgttaacattcatgtagaaaaagttctagtcatattaataatcaataaaaatgcaagtaaaaactatcgaaatgccactgtgtatatcttttagagtagaaaaaaaaacttctaataccttgtaatggtaaaactataaaaatgattttaggaattctgttggtaacattgtaaattaggacatctttcagagggctattgtcaataaaaagtgagtctaaagatgtttttactctgaccaataatcctacttacaaggcatgatcctaaggaagttgttcaacagaataaaaggtatatagataatgaccatcatcatcaaattacttattaaaaccacacaaggaagcaatctaaatattctgtgatcggcttccactacaacccatacacttttcttttatactgcttatcacattttaattatttgacaactgtctcactactagatagtaagctccatgagggtagtgctgtctctgcctagatctctggcacataaatacagactgtaggaattaagaacaaatactgaaacgtttataatttattatttttagatggagtctcactttgtcgcccaggctggagtgcaatggcgcgatctcagctaactgctacctccgcctcccgggttccagcgattctcctgcctcagactcccgagtagctgggattacaggtgcccaccactgcatccggttaatttttgtatttttagtagagacggggtttcaccatgttggccaagctggtttcgaactcttgaccctcctcggcctcccaaatcctggcctgcctcggtctcccaaagtgctgggattacaggcgtgagccactgcgcctgacctaatttaatgtcaagtaaaaataacacaaaaatatgtgtgctacaagtgaaactgagtaacatatacacacgattattatacaagattaaaaatagttaagatggaggcatcattggccaacttttcaattattttaaatatcctttaaagttattttagtacctctgaaatgaaaaagcaggaaaaaatttgctgttatttacaccaaacttgaccttgtagtagggatgaaacggccaccatgaaagcctgagggcccactccccagcttacccccaggtactcagttattctttctttgctcaagggtagaaagagccaaaatactcatatatcatatgtagcataaccctattttctgtaacaatctcaaacaaaggcagtatgttgagagagacagggaaatgtcttctaaagcaatcccttttgagcagtgaatttgctggttactaacagcagggggtgccaaagggatcgctattgttcccaggagacagccatgagaaggactgctgaggcctaggttgaaaaaaagcttaggtttgagagtaaaatccaaatgcagcaggttttcccttaacaactgggacatgtggataaaactcaggagctcataaacttgaatggataaaaactacattttaattttcactaacttctaatattttgcatttccttgatttataagtgtaggcaaacaatcacagcagaatcacagtgccagtgactctgtcatgaacagaagtcatagctaacactacagcacattacagctgttgcagatttctcaaataccatttatgctcatcaccgctttgaaacaacaggcttcaggagttactgttaggtatacagctggatattgtttaatctactagtaaagccacacatattactatatcatgaatttgttcaataatctgataactttaaataacagaatacttttatattccag

SEQ ID NO: 1917 - DNA, 8189 bp, Homo sapiens; identical to SEQ ID NO: 1916

SEQ ID NO: 1918 - DNA, 8189 bp, Homo sapiens; identical to SEQ ID NO: 1916

SEQ ID NO: 1919 - DNA, 3661 bp, Homo sapiens
cagttttattttctggtttctttgtggggctgtggagaaacatcaaagggtggaaaatgccatttttacctgtaaaggagggccccacattgtgcaggaggaaataaaccagacccgggctcagatgaatggagtgagtacaagcatttgagagacagaacaattacgtggatttgattttctttggggaggctcttcacagtttcccatctgtaagggagcaaaagaggttacagctgaaactcaaagctgatctgttttcacattccgctcatgcgggcttcagagccacacaatttcactttcaattacttaccacacttcattgatctctgacttactttgcagccattggtagtcttcctattagacccagttccttggggacagagcccccatcttatacttttgttccccacatagagccggacctaggcagatcacatgctcttgctcagtacttggtcaaacaccttttcctcactgttgattcaaaatttattcaacgatgattgactaaatcccaggcaatggttatttttataataagatgctggtggtgaatccacatacagcaagtacagaatatggagattactgggagaggaaggatcatttcaaaacaggatttgtgcacagagacgttcactagagtgttgtttataacagcaaaaagtggagacaacttaagtgttcctcagtagggaaagttgggtaaattatggtacatgcatacagacagtgagatagtaagcagccatatatatatatatatatatatatattttttttttttttttttgagacagggtcttactcactctgtcacccaggctggagtgcagtggagtgatcacggctcgctgcagcctctgcctcccaggcacaagcaatcctcccaccccagcctccggagtagctgggattagaggtacacgccaccatgtctggctaatttatatattttttgtagagacaaggtttgccatgttgcccaggctggtctcaaactcctgggctcaagcgattttcctgccttggcctcccaaagtgctgggattataggtgtgagctaatgtactcggccagtaagcagctagtttaaagaataaggtagagccaaatgttcaaaaagataaccaagaagaattagtcggtatgatgccatttatgtaaaaaaggactaaaaggatgcatatatatatacatacatgtgacacatacacagaaaaattttggaaggatacaccaaaaacttcatattggttatctctggggagtggactaagaagtcagaagtgggaccgttagtctgttacttaattttcctgttagtacttgaattttaaaattatgactgtattattgcttttatgtttattttttaaacaacaaactagttaaacaagcaagctatttttggatggcaatgagaaaagttaactctaaaagatgcccttcccagggacaggggtggggcaaggcagagtggggcggagagggagggccctgttgaaggcacacattgcccttcactctgtgactcttggctccctctgctttcggtcgctggccaaaccaaacagccttccagctctgtcccgtgaggtggagatgagacggaccacgaaaatgttctgaatcacagccttggggtggcttgagttaagacttcctggacattcaccaaccactgccagctgccaccaaccctgctcgggaagccggccatgtaccctacagcacaggacatggatggcactgatcacatagataaggactccttagtttgggggtgaatcaagttactgtctcactcaaaacccgccaatggcccacctctgcttgttgtgaggtccaaatttaccttgtattagcattcaaggctttgcatggttcagccccactcttatcttttcaacctcatttgctacgacttctcagtatatgccaacatgtacaccaggactgcctgggttggaatctgggctgtgctacttaccactgtgacagtaggtaagtcagttgccccttcagtgcctgtttccttatctggaaagcagggaggataagaatagcacctacatcataggactgacatggaactgtgtgcattaacaaatgtgtgtgcggaacggtgcctgccatacagtaggtgcttcccaccctcactccatgcttctggctggaatgtctttcctggccacagtcctggtcatttttcagagtctctatctggcagcgccccaccatgaggccttccctaatcagcccaggtaccagtggttcttggacatccagaatcaggtggggaacttggtgaagtgcagattcttctacctaacttctcaggatcccactggagtctgtgacacggcccaggaagctgcccccaggtgacacccgtatgtgtagtgcagggtcacacttggaatagctcagtacttggaaggccaccttctgctgcctctcctagggaacaggcttggtcctattcattttcccatcttccacaatgtctcatgcacgttaggctcctgacaaatgcttgtggactattcatgacctgcttgggagaagggctcaccatcttatgccttcccaccctctctctgaggcttacggcactagcgtgaatgtgggtgccctcatgagaagcttgtggtgtagctgatgccacttagaccacagattccaagcaggctcattggcttttcccaggtctatctatcttccaatagatctgtagggaaagtagtccacttgggttttctttaactttccattaagaaagaaagtgagagggcttcctcagctaggggtaccatcagtcacttgggggaaatctttaaaaatcgagcctagcctgaccactccagactggattctgagcaccatgtaggttcaaggcggggtcggggcaatggaccaggttgtctgggtgattcggatgacacccttgatgatgaaccagagctccacccccaggttctcaacgggggctgtgcttcagccaggcatgcagaggggctagagcttttgaggatataaggcccttccccaacataaccagcctcttggcctaggggccaactctattcatttcacccttgttattttgcaaagcaagtgagcagttgctggggaaagtcaagcatccttgggaaagagactctggggaaagagggcagggttgtccttagtggaaaggccaaagtcccctagaggactcaaaatcctctatttaaaatacaatctctttctttaaaacccaaaagcttcctgttagttccagctcctatatttctcgctgacattagctctgtgaaataaggtcttaggctggaatccaccctacagccagctttcaaaggccctttctggagccctgcgggcagcacacaagttgcctcaaagacagggtagaaatgttctgttttgttattttttaaagtctcctgaaagtgtaagaataaaaagggagtgaaagcttctgctttgtcaataggaaatccacccccctgtccccaactctgccctgggagcctcacagatttcctgaagttaaaaacaaacagtgaccatttctactccttgcaagatttaattcttcctttaatataaataaggcagcatgaaacaccaagagccccactgcttt

SEQ ID NO: 1920 - DNA, 3661 bp, Homo sapiens; identical to SEQ ID NO: 1919

SEQ ID NO: 1921 - DNA, 3661 bp, Homo sapiens; identical to SEQ ID NO: 1919

SEQ ID NO: 1922 - DNA, 1758 bp, Homo sapiens
ctttctcaccacccacctcacccggaaatcccctgtctcgaaaaggcactctgtcacgtgtacacaggaaagggccctgacaagaggatgggactgcagttgtggctgccagggccccggccagggtgaaaacaaggaacattccagagaagatcacaaggatgcgaataaaatcggagctgcacagggatctttgggctgtaataggaggggacacacaggggttaggggagggtctagcccttggctccctcagcccagccctcctgtcaccttgcctctcccctttcccccaccttattctatcccacccgccaccgttggccaactcctctcctaaacagtggactctgctttttcccctcctcttatccctaatcctaggagctttctgtctggcttccctcctggcccctcgtgtatgcattctctctagcggtggggattaaggagaaaactcacgtggccagtgggtagagagagtccgggcaggcagctgcctgaagtcagccagagtctgcatgtgcccagctgtcctggcctccagcatctctggaaaaacagagacagaatgagtagcagcaggggaccccatagggcacatctgaaggcctgagaggttggagtgcagtggcacgatctcggctcagtgcaacctccgcctcctgagttcaagtgattctcctgcctcagcctccctagtagctgggattacaggacaaggagagggacaaattccttcttggcatccttatggccctgtgacctgctaatgaatgctgactctgagttgctactagaatttggtttccttgtggcttcccaggaattggtctcactctgctcactctgtctcccaagctggagtgcagtggtacagtcacggctcactgcagcctccacttcctggactcaagtgatcttctcacttcagccttctgagtagctgggactacagccccctctgcagctcttcatgggggtccactcaagtcagaagccacatttgggtgtgattcagagagctgtttatgcaaaaccagctttgtcaccatcaggcaaggcacctgaattcccaccgcagagagtgttgtggccgtgaggacttttctgtcaccagccatttccaggtagacccagtgtaatcacaagcatccttgtaagtggcaaagaggcagaggagacagcgccagagaggcagctgcatgagaaggatcaagatgttgctgactttgaagttggaagaagaaggccatgagcctcagtatgtgggcggcttctagaagctggaaggggcaaggagatggatttgacccttcagcctccaggggcagctgtacctgccatcactgattgtagcctggtgaggcctgttttagacttctgacctgtagagctgtaacataatacatttgggttgttttcaaccactaagtttgtggtaatttgttgtagcagctgtagaaaatgaatacatatgaatcctctggcatttgtttgagatttgctctatggcctagtatgtggttgtaaatgttccatctgtgcctgaaaaaatgtatatttctaattcagtagtctctgctttttttttttattttgtaccccatcaataaaatgattttcagcatgtatccccaaataaacaatattttatttattgattgattgataaacagacatgtttaatgatagcttgcttttcacagaggtgacttcggagacttctaatctataatccaggagtatataaccatg

SEQ ID NO: 1923 - DNA, 1758 bp, Homo sapiens; identical to SEQ ID NO: 1922

SEQ ID NO: 1924 - DNA, 821 bp, Homo sapiens
tcaggggaggtcaggaagggagcaggggtgcagggccagggtaaggaggagacagaagaaggagaactagcacagtgtcacgtaggggctgcagaactgattaacccaggctctctttatacgtttttaaatttcagagatttgttagaggactggctgcagagaagcataaacatttcaggcaaaaaggaaaagagcactgaagctgggaatacaccgcaacacagacaatgaatgcctcactgctgccggctccagggccagcagtggagaggcacaggctgttggaccttcatcccaccaggtgctctttccacatccttcctcgggccaacaaggggcaggaatggaaatacccgggacccacaggcagctgtgataactgatgttaagagaaccgcaacaggcagtgtgtgagctccggcacgtacttctcagcctcatgtaagtggcccataataactacagcttcagcagacaactaaagagactgcattaaggtgatttctctggctataaagagagcccggcctgcagagcagtgtgactgctgggacctctgggataggcaacactgccctctctcccccagggctactccccgggcaggtcggggcccaaggaatgacccagcaactgctccttacccagcacactctctttactgccacctgcaattatgctgtgaagatgactgggtgtggtcatcacgattcagagaaatcaagatctatgaccattttaggcaaagagagaaacttggagaattgctgaggactactgaaccttgttttgcttttttaaaaaatactaaatcctca

SEQ ID NO: 1925 - DNA, 821 bp, Homo sapiens; identical to SEQ ID NO: 1924

SEQ ID NO: 1926 - DNA, 821 bp, Homo sapiens; identical to SEQ ID NO: 1924

SEQ ID NO: 1927 - DNA, 821 bp, Homo sapiens; identical to SEQ ID NO: 1924

SEQ ID NO: 1928 - DNA, 821 bp, Homo sapiens; identical to SEQ ID NO: 1924

SEQ ID NO: 1929 - DNA, 821 bp, Homo sapiens; identical to SEQ ID NO: 1924

SEQ ID NO: 1930 - DNA, 7024 bp, Homo sapiens
tgttgaggggtgaagccagctggacatcctgggtcaagtggggacttggaggacttttctgtcttacaagaggattgtaaaatgcatgaatcagcagtctgtagctaggattgcaaaatgcctcaatcagcactctgtggctagctagagctttgtaaaattggaccgatcagcactctgtaaaatggaccaatcagtaggatgtgggcagagacaaataaggcaataaaagctggccaccccagtgagcagcagcaacctgcttggaccccctttcacgctgtggaaactttgttctttcgctcttcacaataaatctttctgctgctcactctttgggtctgtgtcatctttaagagctataacactcaccgcgaaggtctgcagctccattctggaagtcagtgagaccacgaacccaccagaaggaacaaactccggacacatcttggaaactatgaagggactatcgccaagtggattgatgccatcaagctacagatggtcttacaaatggaacaccaaatgagctctactaacaatttctactgtggaccactggactgacccactgaccctttggctggcctagagagatctgctctgtaggacactaccactgccactgcagggccccttctttgcctctatccaacaggaagtagctagagtggtcatcacccaattcccaacagcagttagggtgtcctgtttagaggggggattgagcgatgaagccagccggacttcctgggttgagtggggtcttggagaacttttctgtcatacaagaggtttgtaaaacacaccaatcagtgttctgtggctagctagaggtttgtaaagtgctccaatcagtgctctgtaaaaacgcaccaatcagcgctctgtggctagctagaggtttgtaaaatagaccaatcagcactctgtaaaatggaccaatcagcaggatgtgggcagggacaaatgagggaataaaagctggccaccccagccagcagtggtaagccactcgggtccccttccacgctgtggaagctttgttcttttgctcttcacaataaatcttgctgctgttctctctttgggtctgtgccatctttaagagctgtaacactcactgcgaaggtccacggtgcattcttgaagtcagtgagaccgcaaacccaccagaaggaacaaactccagacacactgtcatagaaaagtgatgcccctctggatttcagagagaagatatacagaataaaggaaacttatgcaaggttctacttggatgacaagaaagggagaaaggatggctaaaatgcaaattatgtagttggatcactcttgattcactttctggaggctttgtgcctcccgtggtgttcttcaccactataacacagtgatcacctcacaaggcactcttgattattacttccctgcatgcattcctcagtgatattttctactcttcctaatttgacaaagggaagtattccaaaaatcctgactagtcacctatcttcaccttgcctcctatgtcagctttctcacattgtgggcttttttgtttgtttgtttgttttctgtttttacttctgccctctaaatgtctggagactgagaagtagccttttcccttcccttcggttcccttcccttcccttcccttcccttcccttcccttcctttctctcccctcctcccctcccttcccttcctgtcttttcttttcttttttcttttctcttttcttttctttttttcttttctttattctcttttctcttttcttttcttttcttttcctacttttcctcttctcttctcttctctcctcttctctcctctcctctcttctcttctctttctcttttcttttcttttgtgagacagggtgtcactctgtcacccagactgaagtgcagtggtgcaatctctgctcaccacagcctccacctcccaggctcaagcgattctcctgccttagcctccagagtagctaagactacaggcatgtgccactactgcccagctatttttttttttagtaaagatggggttttatcatgttcaccaggctggtctcgaactcctgacctcaaatgatccacccaccttggcctcccaaagtgctaggattataggcatgagccaccatcaccagccagtattattttctacctgtaagatgtcttttccagtttggcacatgtattcattaagtgaaggtttagtctgacaactgtatgacagtgaaaacaactttagtctcattttgtccatgacatggtaggtctttgagtagcttactcttatcatgccatttgcagtagactgatttaccacactgttgcatgtgatatggtttggctgtgttcccacccaaatctcatatttaattgtagctcccataatccccatgtgtcatagaagagacccgattggagggaattaaatcatgggagtgggcttttcccatgctgttcccctgacagtcaataagtctcacatgagctgatggttttacaaagatcagttcccctgcacatgctctattgcctgctgccatgtaagatgtgcctttgctagacttttgccttctgccatgattgtgaagcctccttagccatgtggaactgtgaattcattaaacctctttctccttataaattacccagtctcaggtattttttcatagcagtatgtaaatggactaatactgtaagttggtactgggagtggggcactgcaattaagatacacaaaaatgtagaagcaactttggaactggataacagtcagaggttgaaacaatttggaggactcagaagaaaacaggaatatgtgggaaagtctggagcttcctagagacttgttgaaagttttttatcaaaaagtgcaggctgaggtggcctcagatagagatgaggaacttatgggacctggagcaaaggtattcttgctatgctttagcaaagagactgcaggcattttgcccctgccctagagatctttggaattttaaacttgatatagatgatttagggtatctggcagaaggaatttctaagcagcaaagcactcaagagatgacttgtgtgctcttaaaagcattcagttttattcattcataaagatatgttttggaattgggacttatgcttaaaagtaaagcagagcataaaagtttggaaaatttgtaatagaaaagaaaaacccattttctgaggagcaatttaagctggctacagaaatttgcataaggaacaaggagccaaatgttaatcaccaggacaactgggaaaatgtctccagggcatgccagaggtcttaatggcagcccctattatcacaagccaggaggtttaggaggaaaaaatggtttcatgggccaggcctaaggccttgctgccctttgtagttttgggacttggtgccctgcatcccagccatggataaaaggtataaatgaaagctcagggctgtggcttcaaagggtgcaagccccacgccttggtggtttacaaatggtgttgagcctgtgggtgcacagaagccaagaattgaggtttgagaacctctgcctagatttcagaggatgaatgggaatgtctggatgtccaggcagaggttgtgctgcaggaagtgagcccttatggagaacctctgctacagcagtgtgaaagcaaaatgtggagtgggaacccccatgcagaatctttactgggacactgtctgaagtcttgagaagaggaccatcatcctccagaccccaaaatgttagatccaccaaaaacttgcactaggtacctgaagaagccacagatactgaatgccagcccatgacagcagccagaggggggctgtaccctgcaaagccacaggggtggagctgtccaaggccatgggaacccaccttttgcatcagtatgaccaggatgtgagacatgtagtcaaaggagatcattttggagctttaagatttgactgccccactggattttggacttggacttgcatggagcctgtagcccatgttttggtcaatttctcccatttggaatgggtatatttacccaatgcctgtacccccattttatctaggaagtaactaacttgcttttgattttacaagatcataggcagaagggacttgccttgtctcagatgagactttgaactgtggacttttgagttaatgctgaaatgaattgtgactttgggggactgtaggtaaggcatgattggttttgaaatgtagggacatgagatttgtggggggcaggtgtgagatgatatggtttggctgtgttcctaccaagatctcatcttgcattgtagctgccataattcccaggtgttgtgggacagatcttgtgggaggcagtttaatcatgggggcaggtttttcccgtgctgttctcatgatagtcaaaaagtctcacaagatctgatggttttataaagggcagttcccttgcacatgctctcttgcttgccactgtgtaaaatgtgcctttgctcctccttcaccttctgccatgattgtgaggcctcctcagccatgtggaactttgagtccattaaacgtctttttctttataaattacccagtctagggtatttcttcatagcagtatgataatggactaatacaccatgtgttattattctgcagttcttccacaaaaaggttgatcattttttcctgtcctttttgttttttggtgggagagagtgcttggccatgtggcatttttttggccaatgaaatataagggagaaatgataccgagcctgtttcaagcttcagccttcttttcctcctgtcttctggacatcactgtaaatagaacatgccaaggtctaatggctcagggaggatggcccaaggaggatgagacacatcctccatggggatctacaacattgaatagctgtccctagataccacagtcaaagcagaattgccctagtcacccacctgtttatgagaatatgtgagtgttggttatggagttgtgaaaggatttgttatatagcaatatggcttcattaattgactaatgcacccctcttatgtgctcctgtatttccttcatttaacaatttgcactatatttaaattgcaaacttaattaatcatccatcatcttcttgacagcaatttcagagaaattagaggtttatatctgtctcaattcccaatatgtctgctgtgcctttcatggagctaggcataaaataaatgttcattacatatttgtttaatttaacttttaccagattgtaagatttttatggacaagtattttgttttatttacttctcatttactttcaatctgcaaccacaacacctatatcacctattaaataatatattgtatatacacatatatgtgtgtgtatatatatacccacatatacatatgtattatatctaaataaacaacatatgtgaataggtgtatagataaatgtgtagtgtaagtttaaggtaaatcggttataataaacatggccagattaacaggaagagtagaaagtgagaaactgaatacacaaataatgactagaccgcatacaaaaacggacatgtgaaacatagtctgcaacaacctgcccaggaaatcagcctattatttacataaccagctcaggaaagccaaattgctgtaagtgggtggtagtaggaagtcagtctgccatccctatgacagtccatgaagccaaacattaactcctataacaagtggcctaaaatgactagggcttgatctataactgacagcttttctaatttttgtccctgattcaaacttaggaccaaccaaagaaagccaaatatgaaaccttaatcaatcatataacatgaccgcttctagttagactacctactgtttcccatgctaacagccactgatcagggcacacctgaagccttcccttttgtccactgtaaaacttccccactcctctaccttctctgaaatctctgctaaaatgcaaataacagtggctgactcccttgctattgcaagctttgaataaacagtctttactttttctaattagcttggacttcatttatttccaatgagctatctgattttgtagtcaacatttttgtctggtcacctagttttgacctgctggatacaaaacagggctctaagctaaaatcgcttataacagagagaaagggcatgtagaatgtgtaggtctgggaggacaaaggctgatagatttttagctgtgtatatttcacagttaaggaacgcatgaaatatttaaaagggagaaagatcttgtatggattatgaaaaagtcatacgaaacatattgtaaaatattgctactgataatttatatgaaaatattttatttgaataatacttcttattgagttaagattggaatactggaattttgaattatactgaaaaatacacggtctgtgaaagtgacaggaatgagaagagtttagctccacacaagggcagcataacacttgtagaacaccatgctgaaagtgaatatgtgtatttcgtttgatatgtatatgtaatccttcttgaagagggtcatttacctaagcaaatattgaaaaggttttattttagcaataactacccccgacaatgatgtgttcaactcccatctttccactggaaaagcttgcttccttaacaatatcccagtttactttcagaacttttagtcactctttattaagcagtcacttttattatttagaattttatgaaacctcagtctcatattcattttgaacctcttatcttcacctgctgagtctagaccaataatatctgagtcttggagtggagcggtcatgtggtctgctctttagcagcaactttcctccccgcctctgccctgttcttgaccctcaggaagagtcctgggacagggaaaagacagactcctccctgactatataagctgatagctccccacctttttgggtgtcactagtaatataaaaaataaaaataaaaataaaaatc

SEQ ID NO: 1931 - DNA, 1409 bp, Homo sapiens
tgttgaggggtgaagccagctggacatcctgggtcaagtggggacttggaggacttttctgtcttacaagaggattgtaaaatgcatgaatcagcagtctgtagctaggattgcaaaatgcctcaatcagcactctgtggctagctagagctttgtaaaattggaccgatcagcactctgtaaaatggaccaatcagtaggatgtgggcagagacaaataaggcaataaaagctggccaccccagtgagcagcagcaacctgcttggaccccctttcacgctgtggaaactttgttctttcgctcttcacaataaatctttctgctgctcactctttgggtctgtgtcatctttaagagctataacactcaccgcgaaggtctgcagctccattctggaagtcagtgagaccacgaacccaccagaaggaacaaactccggacacatcttggaaactatgaagggactatcgccaagtggattgatgccatcaagctacagatggtcttacaaatggaacaccaaatgagctctactaacaatttctactgtggaccactggactgacccactgaccctttggctggcctagagagatctgctctgtaggacactaccactgccactgcagggccccttctttgcctctatccaacaggaagtagctagagtggtcatcacccaattcccaacagcagttagggtgtcctgtttagaggggggattgagcgatgaagccagccggacttcctgggttgagtggggtcttggagaacttttctgtcatacaagaggtttgtaaaacacaccaatcagtgttctgtggctagctagaggtttgtaaagtgctccaatcagtgctctgtaaaaacgcaccaatcagcgctctgtggctagctagaggtttgtaaaatagaccaatcagcactctgtaaaatggaccaatcagcaggatgtgggcagggacaaatgagggaataaaagctggccaccccagccagcagtggtaagccactcgggtccccttccacgctgtggaagctttgttcttttgctcttcacaataaatcttgctgctgttctctctttgggtctgtgccatctttaagagctgtaacactcactgcgaaggtccacggtgcattcttgaagtcagtgagaccgcaaacccaccagaaggaacaaactccagacacactgtcataggtcttagttccaaaggaaggaatgctttcactaggggacacaacaatgattctatataactcatgttaaaactgctgctctgccactttgttctcctcatgtctctgagtcagcaggcaaggaaaagaagagagttactgttttggctggggtaattgatcttgactaccaagaagaacatggatggatactccacaatggag

SEQ ID NO: 1932 - DNA, 13418 bp, Homo sapiens
tgttgaggggtgaagccagctggacatcctgggtcaagtggggacttggaggacttttctgtcttacaagaggattgtaaaatgcatgaatcagcagtctgtagctaggattgcaaaatgcctcaatcagcactctgtggctagctagagctttgtaaaattggaccgatcagcactctgtaaaatggaccaatcagtaggatgtgggcagagacaaataaggcaataaaagctggccaccccagtgagcagcagcaacctgcttggaccccctttcacgctgtggaaactttgttctttcgctcttcacaataaatctttctgctgctcactctttgggtctgtgtcatctttaagagctataacactcaccgcgaaggtctgcagctccattctggaagtcagtgagaccacgaacccaccagaaggaacaaactccggacacatcttggaaactatgaagggactatcgccaagtggtgagtaccattggacccctttcacttgctattctgtcctattattccttagaatttgggggctaaacaccgagcacctgtcagccagttaaaagcaactagcatggccgctggactaaagacatgggtgtcaggctttctgggaaagggctctctaacaacccccaactctttggagttgggagcgttggtttgcctggaaccagtttctgcttttcttgtacttctgggctgagccgagggttgacagagagaaaagccattcagctccggagtcccaacaaaaagttggttgaccctgtagccatgaggggaactctcaaagtcacgtcgcccaagtgagacttgaccatgtatcctatctatcctcatccttgcctcctgggtcctaatgcctgtcagacaaacttcctcctgtgtcttttctgaggctagtcctgcttctaaaaaccactcccttctctggtgattttctagtttctcttataagaatgatttctaatataaatgtcaggactctgttcccttccttaggcacccaagctcaccaatcagaaagacgtaatttttgcccaaagccccatcagggtagctggtggggggtttactatctggaattttaggatccctcttcagacttgcaggcctaacaaattatatccctgaagctaggatatggggagcctcagaaatcatatccttcctatccatatgatgagaaatgaggaaaaaaggtgtcactcttccaaccctggagatcccttccctccctcagggtatggccctccaaatttgagacataacgtctttataggacaagggtaagttctaagcagaaaatgcttagaacgctaacaagcttatgagaatgcatcagtaagggccactaaatctgatttttctcggacttctttgtggtctaaaaggaaaggcaagggtgcaggtttttgagaatgtgtcagtaagagccactaaatccgaccttccttggtcctcattctggactaggaggaaaactattgtttctgctgctgcatcggtgagcacaactattctgatcagcggggtccagggactgttgagggttcttgggcagggggtgggaaacaaaccaaaactgcaggcggttttttctttcacatgggaagcactcaggcctcaacaggctcaaccttgaaatgtatcctaagccactgggaccaattggacctgtgaaccctgacaaagaggcagctgatctttttctgccctatgacctggccccaatattctctctctgatagggaaaaatggtcacctcagggaagtataaatattaatactatcctgcagcttgatcttttctgtaagagggaaggcaaatggagtgaaataccctatgtccaagctttcttttcattgaaggataatccacaactatgcaaagcttgcaatttacattccacaggaggacatctcagcatacctccatatcctagctttcctatagctccccttcctattaatgataagcctcctctaatctcccctgcccagaaagaaacaagcaaagaaatctccagaggaccacaaaaactcccaggctatcagttttgtccccttcaagttgtagggagaaggaaatttggcacaacctgggtacatgtccccttctccctttctgatttaaagcagatcaaggtagacctggggaagttttcagatgtcctacagggtctagggcaaacctttgacctcacttggagatgtgtcttgctattgttagatcaaaccctcacctttaatgaaaagaatgtggctttagatgcagcccgagagtttggagatacttggtatcttagtcaagtaaacgatagaatgacagccaaagaaagggacaaattccctaacagtcagcaagccatccccagtatggatccccactgggacctcaactcaaatcatggggactggagtcgcaaacatctgctgacctctgttatagaaggagtaagaagaattaggaaaaagtccatgaattattcaatgatgtccaccataactcagggaaagaaagaaaatccttctgccttcctcgagcagctacaggagaccttaagaaaatatacttccttgtcacccaactctctcaaagggtcaattgatcctaaaagataagtttattacccaatcagccacagatatcaggagaaagctccaaaagtgagccctgggccctgaataaaatctggaggcattattaaacctggcaaccttggtgttttataataaggaccaagaggaacaggccgaaaaggaaaagtgagatcagagaaaggctgcagccttagtcatggccctcagacaaacaaaccttggtggttcagagaggacagaaaatggagcaggccaatcaaccagtagggcttgttatcagtgtggcttgcaaggacattttaaaaaagattgtccaacgagaaacaagctgccccctcacccatgtccactatgccaaggcaatcattggaaggtgcactgccccagaggacaaaatttctctgggccagaagcccacaaccagatgatccaacaacatgactgagggtgcccggggcaagcgccagctcatgtcatcaccctcactgaaccccaggtacgtttaaccattgagggccaggaaattgacttctcctggacactggtgtggcttcctcagtgttaatctcttgtcccagacagctgtcctcaaggtccgttaccatccaaggaatcctgagacagcctgtaacctggtatttctcccacctcctcagctgtaattgggagactttgctcttttcacatgattttcttgttatgcctggaagtcccatacccttattagggagggacatattagcgaaagctggagctattatctacatgaatatggggaacgagttgcccatttgttgtcccctgcttgaggagggaatcaaccctgaagtcggggcattggaaagacaatttggaaggccaaaaaatgcctgcccagtccaaatcaggctaaaagaccacaccacttttccttatcaaaggcaatatcccttaaggcctgaagctcataaaggattacaggatattgttagacatttaaaagctcaagtcttagtaagaaaatgcagcagtccctgcaacaccccaattctaggagtacaaaaaccgaatggtcagtggagactagtgcaagatcttagactcaccaatgagtcagtaattcctctatacacaattgtacccaacccttatacgctgctctctcaaataccagaggaagcagaatggttcgctgttctgggcctcaaggatgccttcttctgtattcccctccactctgactcccagtttctctttgcctttgaggatccaacagatcacacatcccaaattacatggacagtcttgccccatggctttagggatagccctcatctatttgatcaggcactagcccaagatctaggccacttctgaagtccaggcattctagtccttcagtatgtggatgatttacttttggctaccagtttggaagcctcatgccagcaggctacttgagatctcttgaactttctagctaatcaagggtgtatggcatctaaattgaaagtccagctctgcctacaacaagtcaaatatctaggcctaatcttagatagaagaaccagggccctcagcaaggaatgaataaagcctatgctggcttatcgtcaccctaagacattaaaacaattgtgggggttccttggaatcactggcttttgccgactatggatccctggatagagtgagatagccaggccccctctatactctaatcaaggagacccagagggcaaatacttatctagtataatgggaaccagaggcagaaacagccttcaaaaccttaaaggagaccctagtacaagctccagctttaagccttcccacaggacaaaacttctctttatatgtcacagagagagcaggaatagctcctggagtccttactcagacttttggacaaccccacagccagtggcatacctaagtaaggaaattgatatagtagcaaaaggctggcctcactgtttatgggtagttgcggctgtggcagtcttactgtcaaaggctatcaaaataatacaaggaaaggatttcactatctggactactcatgaggtaaatggcatattaggtgccaaaggaagtttatggctatcagacaaccacctgctcagataccaggcactactgcttgagagaccagtgctttaaatatgcatgtgtgtgtgtggccctcaaccctgccactgttctcccagaagatggagaaccaatgaagcatgactgtcaacaaattagagtccagagttatgctgcctgagaggatctcttagaagtccccttagctaatcctgaccttaacctatatgctgatggaagttcacttgtggagaatgggatacgaaaagcacattatgccatagttagtgaggtaacagtacttgaaagtaagcctattcccccatggaccagagcccagttagcagaactagtggcacttacccaagccttagaactaggaaagggaaaaataataaatgtgtatacagatagcaagtatgcttatctaatcctacatgcccatgctgcagtatggaaagaaagggagttcctaacctctgggggaacccccattaaataccagaaggaaatcatggagttattgcatgcagtgcaaaaactcaagtaggtggcagttttacactgctgaagctatggggaaggagagaggagaacagcagcataagtggctagcagaggcagtgaaagactagcagagaggagaggtaggggaaagacagaaagtcaaagaaaagaagtcaaagacagacagagaaagagacagagggagccagagagaaagaaaagagagaaagaaagagacagaaagtcaaagaaagagagagaggaagagacagagacaaagaaggagtcagagagaaagagatagaaagtcaaagagaaagaaagtgagaaagagagatggaaatagtaaagaaaaaacagtgtaccctattcctttaaaagccagggtaaatttaaaacgtataattttataattgaaggtcttctccataaccctataacattaaaataccaccttgttgtcagtgtaaacaagagcatagcccaaaagcactgaggccactgacaacccatagccttcctatcaaaaatccttaactctgcaggtttcctaacaggggatctaaatcttaactaatcaccatacaaaggtccgaccagacctaggagaaactcccttcaggacagaaggatggatggttcctcccaggccattaagggaaaaagacacaatgggtattcagtaagtgataagggaactcttgtagaagcagttaggaagattgcctaataattggtctgctcaaatgtgccagctgtttgcactcagctaaaccttaaattacttacagaattaggaaggagccatctataccaattctgagttaatatgaactgaacaagttcttattaatagcaaagaatcattgaaatctcaaacttgcaaagttttcaacaaaagtaaagtttgctgaaagttaacagtgtaacatgtattatcctaacttctaatcttgtggaaatcagaccctatcagtgcccctcaaagctgaagtccatcagcatatggccatacaactaatacccctatttatagggttaggaatggccactgctacaggaatgggagtaacaggtttatctacttcattatcctattaccacacactcttaaaggatttctcagacagtttacaagaaataacaaaatctatccttactctataatcccaaatagattctttggcagcagtgactctccaaaaccactgagacctagacctccttactgctgagaaaggaggattttgcaccttcttaggggaagagtgttgcttttacactacagtcagggatagtaagagatgccacctggtgtttacaggaaaaggcttctgaaatcaggcaatgcctttcaaactcttataccaactactggagtcaggcgacatggcttcccccctttctaggtcctgtgacagccatcttgctattactcatcttcaggccctgtgtttttagactccttgtcaaatttgtttcttccaggattgatgccatcaagctacagatggtcttacaaatggaacaccaaatgagctctactaacaatttctactgtggaccactggactgacccactgaccctttggctggcctagagagatctgctctgtaggacactaccactgccactgcagggccccttctttgcctctatccaacaggaagtagctagagtggtcatcacccaattcccaacagcagttagggtgtcctgtttagaggggggattgagcgatgaagccagccggacttcctgggttgagtggggtcttggagaacttttctgtcatacaagaggtttgtaaaacacaccaatcagtgttctgtggctagctagaggtttgtaaagtgctccaatcagtgctctgtaaaaacgcaccaatcagcgctctgtggctagctagaggtttgtaaaatagaccaatcagcactctgtaaaatggaccaatcagcaggatgtgggcagggacaaatgagggaataaaagctggccaccccagccagcagtggtaagccactcgggtccccttccacgctgtggaagctttgttcttttgctcttcacaataaatcttgctgctgttctctctttgggtctgtgccatctttaagagctgtaacactcactgcgaaggtccacggtgcattcttgaagtcagtgagaccgcaaacccaccagaaggaacaaactccagacacactgtcatagaaaagtgatgcccctctggatttcagagagaagatatacagaataaaggtatatttaaaaaaatatgatatgtgcagaataagcaagaagaaggaagagaaaaaaggaaatgaaaatttaaaaaaacctgacatggcataaaatatttaattgtttgttcctatttaagatgtatctattgtcctctgggtttgataattatgtgatactcatatcatttccttaaattttattttcttaggaaacttatgcaaggttctacttggatgacaagaaagggagaaaggatggctaaaatgcaaattatgtagttggatcactcttgattcactttctggaggctttgtgcctcccgtggtgttcttcaccactataacacagtgatcacctcacaaggcactcttgattattacttccctgcatgcattcctcagtgatattttctactcttcctaatttgacaaagggaagtattccaaaaatcctgactagtcacctatcttcaccttgcctcctatgtcagctttctcacattgtgggcttttttgtttgtttgtttgttttctgtttttacttctgccctctaaatgtctggagactgagaagtagccttttcccttcccttcggttcccttcccttcccttcccttcccttcccttcccttcctttctctcccctcctcccctcccttcccttcctgtcttttcttttcttttttcttttctcttttcttttctttttttcttttctttattctcttttctcttttcttttcttttcttttcctacttttcctcttctcttctcttctctcctcttctctcctctcctctcttctcttctctttctcttttcttttcttttgtgagacagggtgtcactctgtcacccagactgaagtgcagtggtgcaatctctgctcaccacagcctccacctcccaggctcaagcgattctcctgccttagcctccagagtagctaagactacaggcatgtgccactactgcccagctatttttttttttagtaaagatggggttttatcatgttcaccaggctggtctcgaactcctgacctcaaatgatccacccaccttggcctcccaaagtgctaggattataggcatgagccaccatcaccagccagtattattttctacctgtaagatgtcttttccagtttggcacatgtattcattaagtgaaggtttagtctgacaactgtatgacagtgaaaacaactttagtctcattttgtccatgacatggtaggtctttgagtagcttactcttatcatgccatttgcagtagactgatttaccacactgttgcatgtgatatggtttggctgtgttcccacccaaatctcatatttaattgtagctcccataatccccatgtgtcatagaagagacccgattggagggaattaaatcatgggagtgggcttttcccatgctgttcccctgacagtcaataagtctcacatgagctgatggttttacaaagatcagttcccctgcacatgctctattgcctgctgccatgtaagatgtgcctttgctagacttttgccttctgccatgattgtgaagcctccttagccatgtggaactgtgaattcattaaacctctttctccttataaattacccagtctcaggtattttttcatagcagtatgtaaatggactaatactgtaagttggtactgggagtggggcactgcaattaagatacacaaaaatgtagaagcaactttggaactggataacagtcagaggttgaaacaatttggaggactcagaagaaaacaggaatatgtgggaaagtctggagcttcctagagacttgttgaaagttttttatcaaaaagtgcaggctgaggtggcctcagatagagatgaggaacttatgggacctggagcaaaggtattcttgctatgctttagcaaagagactgcaggcattttgcccctgccctagagatctttggaattttaaacttgatatagatgatttagggtatctggcagaaggaatttctaagcagcaaagcactcaagagatgacttgtgtgctcttaaaagcattcagttttattcattcataaagatatgttttggaattgggacttatgcttaaaagtaaagcagagcataaaagtttggaaaatttgtaatagaaaagaaaaacccattttctgaggagcaatttaagctggctacagaaatttgcataaggaacaaggagccaaatgttaatcaccaggacaactgggaaaatgtctccagggcatgccagaggtcttaatggcagcccctattatcacaagccaggaggtttaggaggaaaaaatggtttcatgggccaggcctaaggccttgctgccctttgtagttttgggacttggtgccctgcatcccagccatggataaaaggtataaatgaaagctcagggctgtggcttcaaagggtgcaagccccacgccttggtggtttacaaatggtgttgagcctgtgggtgcacagaagccaagaattgaggtttgagaacctctgcctagatttcagaggatgaatgggaatgtctggatgtccaggcagaggttgtgctgcaggaagtgagcccttatggagaacctctgctacagcagtgtgaaagcaaaatgtggagtgggaacccccatgcagaatctttactgggacactgtctgaagtcttgagaagaggaccatcatcctccagaccccaaaatgttagatccaccaaaaacttgcactaggtacctgaagaagccacagatactgaatgccagcccatgacagcagccagaggggggctgtaccctgcaaagccacaggggtggagctgtccaaggccatgggaacccaccttttgcatcagtatgaccaggatgtgagacatgtagtcaaaggagatcattttggagctttaagatttgactgccccactggattttggacttggacttgcatggagcctgtagcccatgttttggtcaatttctcccatttggaatgggtatatttacccaatgcctgtacccccattttatctaggaagtaactaacttgcttttgattttacaagatcataggcagaagggacttgccttgtctcagatgagactttgaactgtggacttttgagttaatgctgaaatgaattgtgactttgggggactgtaggtaaggcatgattggttttgaaatgtagggacatgagatttgtggggggcaggtgtgagatgatatggtttggctgtgttcctaccaagatctcatcttgcattgtagctgccataattcccaggtgttgtgggacagatcttgtgggaggcagtttaatcatgggggcaggtttttcccgtgctgttctcatgatagtcaaaaagtctcacaagatctgatggttttataaagggcagttcccttgcacatgctctcttgcttgccactgtgtaaaatgtgcctttgctcctccttcaccttctgccatgattgtgaggcctcctcagccatgtggaactttgagtccattaaacgtctttttctttataaattacccagtctagggtatttcttcatagcagtatgataatggactaatacaccatgtgttattattctgcagttcttccacaaaaaggttgatcattttttcctgtcctttttgttttttggtgggagagagtgcttggccatgtggcatttttttggccaatgaaatataagggagaaatgataccgagcctgtttcaagcttcagccttcttttcctcctgtcttctggacatcactgtaaatagaacatgccaaggtctaatggctcagggaggatggcccaaggaggatgagacacatcctccatggggatctacaacattgaatagctgtccctagataccacagtcaaagcagaattgccctagtcacccacctgtttatgagaatatgtgagtgttggttatggagttgtgaaaggatttgttatatagcaatatggcttcattaattgactaatgcacccctcttatgtgctcctgtatttccttcatttaacaatttgcactatatttaaattgcaaacttaattaatcatccatcatcttcttgacagcaatttcagagaaattagaggtttatatctgtctcaattcccaatatgtctgctgtgcctttcatggagctaggcataaaataaatgttcattacatatttgtttaatttaacttttaccagattgtaagatttttatggacaagtattttgttttatttacttctcatttactttcaatctgcaaccacaacacctatatcacctattaaataatatattgtatatacacatatatgtgtgtgtatatatatacccacatatacatatgtattatatctaaataaacaacatatgtgaataggtgtatagataaatgtgtagtgtaagtttaaggtaaatcggttataataaacatggccagattaacaggaagagtagaaagtgagaaactgaatacacaaataatgactagaccgcatacaaaaacggacatgtgaaacatagtctgcaacaacctgcccaggaaatcagcctattatttacataaccagctcaggaaagccaaattgctgtaagtgggtggtagtaggaagtcagtctgccatccctatgacagtccatgaagccaaacattaactcctataacaagtggcctaaaatgactagggcttgatctataactgacagcttttctaatttttgtccctgattcaaacttaggaccaaccaaagaaagccaaatatgaaaccttaatcaatcatataacatgaccgcttctagttagactacctactgtttcccatgctaacagccactgatcagggcacacctgaagccttcccttttgtccactgtaaaacttccccactcctctaccttctctgaaatctctgctaaaatgcaaataacagtggctgactcccttgctattgcaagctttgaataaacagtctttactttttctaattagcttggacttcatttatttccaatgagctatctgattttgtagtcaacatttttgtctggtcacctagttttgacctgctggatacaaaacagggctctaagctaaaatcgcttataacagagagaaagggcatgtagaatgtgtaggtctgggaggacaaaggctgatagatttttagctgtgtatatttcacagttaaggaacgcatgaaatatttaaaagggagaaagatcttgtatggattatgaaaaagtcatacgaaacatattgtaaaatattgctactgataatttatatgaaaatattttatttgaataatacttcttattgagttaagattggaatactggaattttgaattatactgaaaaatacacggtctgtgaaagtgacaggaatgagaagagtttagctccacacaagggcagcataacacttgtagaacaccatgctgaaagtgaatatgtgtatttcgtttgatatgtatatgtaatccttcttgaagagggtcatttacctaagcaaatattgaaaaggttttattttagcaataactacccccgacaatgatgtgttcaactcccatctttccactggaaaagcttgcttccttaacaatatcccagtttactttcagaacttttagtcactctttattaagcagtcacttttattatttagaattttatgaaacctcagtctcatattcattttgaacctcttatcttcacctgctgagtctagaccaataatatctgagtcttggagtggagcggtcatgtggtctgctctttagcagcaactttcctccccgcctctgccctgttcttgaccctcaggaagagtcctgggacagggaaaagacagactcctccctgactatataagctgatagctccccacctttttgggtgtcactagtaatataaaaaataaaaataaaaataaaaatc

SEQ ID NO: 1933 - DNA, 13621 bp, Homo sapiens
tgttgaggggtgaagccagctggacatcctgggtcaagtggggacttggaggacttttctgtcttacaagaggattgtaaaatgcatgaatcagcagtctgtagctaggattgcaaaatgcctcaatcagcactctgtggctagctagagctttgtaaaattggaccgatcagcactctgtaaaatggaccaatcagtaggatgtgggcagagacaaataaggcaataaaagctggccaccccagtgagcagcagcaacctgcttggaccccctttcacgctgtggaaactttgttctttcgctcttcacaataaatctttctgctgctcactctttgggtctgtgtcatctttaagagctataacactcaccgcgaaggtctgcagctccattctggaagtcagtgagaccacgaacccaccagaaggaacaaactccggacacatcttggaaactatgaagggactatcgccaagtggtgagtaccattggacccctttcacttgctattctgtcctattattccttagaatttgggggctaaacaccgagcacctgtcagccagttaaaagcaactagcatggccgctggactaaagacatgggtgtcaggctttctgggaaagggctctctaacaacccccaactctttggagttgggagcgttggtttgcctggaaccagtttctgcttttcttgtacttctgggctgagccgagggttgacagagagaaaagccattcagctccggagtcccaacaaaaagttggttgaccctgtagccatgaggggaactctcaaagtcacgtcgcccaagtgagacttgaccatgtatcctatctatcctcatccttgcctcctgggtcctaatgcctgtcagacaaacttcctcctgtgtcttttctgaggctagtcctgcttctaaaaaccactcccttctctggtgattttctagtttctcttataagaatgatttctaatataaatgtcaggactctgttcccttccttaggcacccaagctcaccaatcagaaagacgtaatttttgcccaaagccccatcagggtagctggtggggggtttactatctggaattttaggatccctcttcagacttgcaggcctaacaaattatatccctgaagctaggatatggggagcctcagaaatcatatccttcctatccatatgatgagaaatgaggaaaaaaggtgtcactcttccaaccctggagatcccttccctccctcagggtatggccctccaaatttgagacataacgtctttataggacaagggtaagttctaagcagaaaatgcttagaacgctaacaagcttatgagaatgcatcagtaagggccactaaatctgatttttctcggacttctttgtggtctaaaaggaaaggcaagggtgcaggtttttgagaatgtgtcagtaagagccactaaatccgaccttccttggtcctcattctggactaggaggaaaactattgtttctgctgctgcatcggtgagcacaactattctgatcagcggggtccagggactgttgagggttcttgggcagggggtgggaaacaaaccaaaactgcaggcggttttttctttcacatgggaagcactcaggcctcaacaggctcaaccttgaaatgtatcctaagccactgggaccaattggacctgtgaaccctgacaaagaggcagctgatctttttctgccctatgacctggccccaatattctctctctgatagggaaaaatggtcacctcagggaagtataaatattaatactatcctgcagcttgatcttttctgtaagagggaaggcaaatggagtgaaataccctatgtccaagctttcttttcattgaaggataatccacaactatgcaaagcttgcaatttacattccacaggaggacatctcagcatacctccatatcctagctttcctatagctccccttcctattaatgataagcctcctctaatctcccctgcccagaaagaaacaagcaaagaaatctccagaggaccacaaaaactcccaggctatcagttttgtccccttcaagttgtagggagaaggaaatttggcacaacctgggtacatgtccccttctccctttctgatttaaagcagatcaaggtagacctggggaagttttcagatgtcctacagggtctagggcaaacctttgacctcacttggagatgtgtcttgctattgttagatcaaaccctcacctttaatgaaaagaatgtggctttagatgcagcccgagagtttggagatacttggtatcttagtcaagtaaacgatagaatgacagccaaagaaagggacaaattccctaacagtcagcaagccatccccagtatggatccccactgggacctcaactcaaatcatggggactggagtcgcaaacatctgctgacctctgttatagaaggagtaagaagaattaggaaaaagtccatgaattattcaatgatgtccaccataactcagggaaagaaagaaaatccttctgccttcctcgagcagctacaggagaccttaagaaaatatacttccttgtcacccaactctctcaaagggtcaattgatcctaaaagataagtttattacccaatcagccacagatatcaggagaaagctccaaaagtgagccctgggccctgaataaaatctggaggcattattaaacctggcaaccttggtgttttataataaggaccaagaggaacaggccgaaaaggaaaagtgagatcagagaaaggctgcagccttagtcatggccctcagacaaacaaaccttggtggttcagagaggacagaaaatggagcaggccaatcaaccagtagggcttgttatcagtgtggcttgcaaggacattttaaaaaagattgtccaacgagaaacaagctgccccctcacccatgtccactatgccaaggcaatcattggaaggtgcactgccccagaggacaaaatttctctgggccagaagcccacaaccagatgatccaacaacatgactgagggtgcccggggcaagcgccagctcatgtcatcaccctcactgaaccccaggtacgtttaaccattgagggccaggaaattgacttctcctggacactggtgtggcttcctcagtgttaatctcttgtcccagacagctgtcctcaaggtccgttaccatccaaggaatcctgagacagcctgtaacctggtatttctcccacctcctcagctgtaattgggagactttgctcttttcacatgattttcttgttatgcctggaagtcccatacccttattagggagggacatattagcgaaagctggagctattatctacatgaatatggggaacgagttgcccatttgttgtcccctgcttgaggagggaatcaaccctgaagtcggggcattggaaagacaatttggaaggccaaaaaatgcctgcccagtccaaatcaggctaaaagaccacaccacttttccttatcaaaggcaatatcccttaaggcctgaagctcataaaggattacaggatattgttagacatttaaaagctcaagtcttagtaagaaaatgcagcagtccctgcaacaccccaattctaggagtacaaaaaccgaatggtcagtggagactagtgcaagatcttagactcaccaatgagtcagtaattcctctatacacaattgtacccaacccttatacgctgctctctcaaataccagaggaagcagaatggttcgctgttctgggcctcaaggatgccttcttctgtattcccctccactctgactcccagtttctctttgcctttgaggatccaacagatcacacatcccaaattacatggacagtcttgccccatggctttagggatagccctcatctatttgatcaggcactagcccaagatctaggccacttctgaagtccaggcattctagtccttcagtatgtggatgatttacttttggctaccagtttggaagcctcatgccagcaggctacttgagatctcttgaactttctagctaatcaagggtgtatggcatctaaattgaaagtccagctctgcctacaacaagtcaaatatctaggcctaatcttagatagaagaaccagggccctcagcaaggaatgaataaagcctatgctggcttatcgtcaccctaagacattaaaacaattgtgggggttccttggaatcactggcttttgccgactatggatccctggatagagtgagatagccaggccccctctatactctaatcaaggagacccagagggcaaatacttatctagtataatgggaaccagaggcagaaacagccttcaaaaccttaaaggagaccctagtacaagctccagctttaagccttcccacaggacaaaacttctctttatatgtcacagagagagcaggaatagctcctggagtccttactcagacttttggacaaccccacagccagtggcatacctaagtaaggaaattgatatagtagcaaaaggctggcctcactgtttatgggtagttgcggctgtggcagtcttactgtcaaaggctatcaaaataatacaaggaaaggatttcactatctggactactcatgaggtaaatggcatattaggtgccaaaggaagtttatggctatcagacaaccacctgctcagataccaggcactactgcttgagagaccagtgctttaaatatgcatgtgtgtgtgtggccctcaaccctgccactgttctcccagaagatggagaaccaatgaagcatgactgtcaacaaattagagtccagagttatgctgcctgagaggatctcttagaagtccccttagctaatcctgaccttaacctatatgctgatggaagttcacttgtggagaatgggatacgaaaagcacattatgccatagttagtgaggtaacagtacttgaaagtaagcctattcccccatggaccagagcccagttagcagaactagtggcacttacccaagccttagaactaggaaagggaaaaataataaatgtgtatacagatagcaagtatgcttatctaatcctacatgcccatgctgcagtatggaaagaaagggagttcctaacctctgggggaacccccattaaataccagaaggaaatcatggagttattgcatgcagtgcaaaaactcaagtaggtggcagttttacactgctgaagctatggggaaggagagaggagaacagcagcataagtggctagcagaggcagtgaaagactagcagagaggagaggtaggggaaagacagaaagtcaaagaaaagaagtcaaagacagacagagaaagagacagagggagccagagagaaagaaaagagagaaagaaagagacagaaagtcaaagaaagagagagaggaagagacagagacaaagaaggagtcagagagaaagagatagaaagtcaaagagaaagaaagtgagaaagagagatggaaatagtaaagaaaaaacagtgtaccctattcctttaaaagccagggtaaatttaaaacgtataattttataattgaaggtcttctccataaccctataacattaaaataccaccttgttgtcagtgtaaacaagagcatagcccaaaagcactgaggccactgacaacccatagccttcctatcaaaaatccttaactctgcaggtttcctaacaggggatctaaatcttaactaatcaccatacaaaggtccgaccagacctaggagaaactcccttcaggacagaaggatggatggttcctcccaggccattaagggaaaaagacacaatgggtattcagtaagtgataagggaactcttgtagaagcagttaggaagattgcctaataattggtctgctcaaatgtgccagctgtttgcactcagctaaaccttaaattacttacagaattaggaaggagccatctataccaattctgagttaatatgaactgaacaagttcttattaatagcaaagaatcattgaaatctcaaacttgcaaagttttcaacaaaagtaaagtttgctgaaagttaacagtgtaacatgtattatcctaacttctaatcttgtggaaatcagaccctatcagtgcccctcaaagctgaagtccatcagcatatggccatacaactaatacccctatttatagggttaggaatggccactgctacaggaatgggagtaacaggtttatctacttcattatcctattaccacacactcttaaaggatttctcagacagtttacaagaaataacaaaatctatccttactctataatcccaaatagattctttggcagcagtgactctccaaaaccactgagacctagacctccttactgctgagaaaggaggattttgcaccttcttaggggaagagtgttgcttttacactacagtcagggatagtaagagatgccacctggtgtttacaggaaaaggcttctgaaatcaggcaatgcctttcaaactcttataccaactactggagtcaggcgacatggcttcccccctttctaggtcctgtgacagccatcttgctattactcatcttcaggccctgtgtttttagactccttgtcaaatttgtttcttccaggattgatgccatcaagctacagatggtcttacaaatggaacaccaaatgagctctactaacaatttctactgtggaccactggactgacccactgaccctttggctggcctagagagatctgctctgtaggacactaccactgccactgcagggccccttctttgcctctatccaacaggaagtagctagagtggtcatcacccaattcccaacagcagttagggtgtcctgtttagaggggggattgagcgatgaagccagccggacttcctgggttgagtggggtcttggagaacttttctgtcatacaagaggtttgtaaaacacaccaatcagtgttctgtggctagctagaggtttgtaaagtgctccaatcagtgctctgtaaaaacgcaccaatcagcgctctgtggctagctagaggtttgtaaaatagaccaatcagcactctgtaaaatggaccaatcagcaggatgtgggcagggacaaatgagggaataaaagctggccaccccagccagcagtggtaagccactcgggtccccttccacgctgtggaagctttgttcttttgctcttcacaataaatcttgctgctgttctctctttgggtctgtgccatctttaagagctgtaacactcactgcgaaggtccacggtgcattcttgaagtcagtgagaccgcaaacccaccagaaggaacaaactccagacacactgtcataggtcttagttccaaaggaaggaatgctttcactaggggacacaacaatgattctatataactcatgttaaaactgctgctctgccactttgttctcctcatgtctctgagtcagcaggcaaggaaaagaagagagttactgttttggctggggtaattgatcttgactaccaagaagaacatggatggatactccacaatggagaaaagtgatgcccctctggatttcagagagaagatatacagaataaaggtatatttaaaaaaatatgatatgtgcagaataagcaagaagaaggaagagaaaaaaggaaatgaaaatttaaaaaaacctgacatggcataaaatatttaattgtttgttcctatttaagatgtatctattgtcctctgggtttgataattatgtgatactcatatcatttccttaaattttattttcttaggaaacttatgcaaggttctacttggatgacaagaaagggagaaaggatggctaaaatgcaaattatgtagttggatcactcttgattcactttctggaggctttgtgcctcccgtggtgttcttcaccactataacacagtgatcacctcacaaggcactcttgattattacttccctgcatgcattcctcagtgatattttctactcttcctaatttgacaaagggaagtattccaaaaatcctgactagtcacctatcttcaccttgcctcctatgtcagctttctcacattgtgggcttttttgtttgtttgtttgttttctgtttttacttctgccctctaaatgtctggagactgagaagtagccttttcccttcccttcggttcccttcccttcccttcccttcccttcccttcccttcctttctctcccctcctcccctcccttcccttcctgtcttttcttttcttttttcttttctcttttcttttctttttttcttttctttattctcttttctcttttcttttcttttcttttcctacttttcctcttctcttctcttctctcctcttctctcctctcctctcttctcttctctttctcttttcttttcttttgtgagacagggtgtcactctgtcacccagactgaagtgcagtggtgcaatctctgctcaccacagcctccacctcccaggctcaagcgattctcctgccttagcctccagagtagctaagactacaggcatgtgccactactgcccagctatttttttttttagtaaagatggggttttatcatgttcaccaggctggtctcgaactcctgacctcaaatgatccacccaccttggcctcccaaagtgctaggattataggcatgagccaccatcaccagccagtattattttctacctgtaagatgtcttttccagtttggcacatgtattcattaagtgaaggtttagtctgacaactgtatgacagtgaaaacaactttagtctcattttgtccatgacatggtaggtctttgagtagcttactcttatcatgccatttgcagtagactgatttaccacactgttgcatgtgatatggtttggctgtgttcccacccaaatctcatatttaattgtagctcccataatccccatgtgtcatagaagagacccgattggagggaattaaatcatgggagtgggcttttcccatgctgttcccctgacagtcaataagtctcacatgagctgatggttttacaaagatcagttcccctgcacatgctctattgcctgctgccatgtaagatgtgcctttgctagacttttgccttctgccatgattgtgaagcctccttagccatgtggaactgtgaattcattaaacctctttctccttataaattacccagtctcaggtattttttcatagcagtatgtaaatggactaatactgtaagttggtactgggagtggggcactgcaattaagatacacaaaaatgtagaagcaactttggaactggataacagtcagaggttgaaacaatttggaggactcagaagaaaacaggaatatgtgggaaagtctggagcttcctagagacttgttgaaagttttttatcaaaaagtgcaggctgaggtggcctcagatagagatgaggaacttatgggacctggagcaaaggtattcttgctatgctttagcaaagagactgcaggcattttgcccctgccctagagatctttggaattttaaacttgatatagatgatttagggtatctggcagaaggaatttctaagcagcaaagcactcaagagatgacttgtgtgctcttaaaagcattcagttttattcattcataaagatatgttttggaattgggacttatgcttaaaagtaaagcagagcataaaagtttggaaaatttgtaatagaaaagaaaaacccattttctgaggagcaatttaagctggctacagaaatttgcataaggaacaaggagccaaatgttaatcaccaggacaactgggaaaatgtctccagggcatgccagaggtcttaatggcagcccctattatcacaagccaggaggtttaggaggaaaaaatggtttcatgggccaggcctaaggccttgctgccctttgtagttttgggacttggtgccctgcatcccagccatggataaaaggtataaatgaaagctcagggctgtggcttcaaagggtgcaagccccacgccttggtggtttacaaatggtgttgagcctgtgggtgcacagaagccaagaattgaggtttgagaacctctgcctagatttcagaggatgaatgggaatgtctggatgtccaggcagaggttgtgctgcaggaagtgagcccttatggagaacctctgctacagcagtgtgaaagcaaaatgtggagtgggaacccccatgcagaatctttactgggacactgtctgaagtcttgagaagaggaccatcatcctccagaccccaaaatgttagatccaccaaaaacttgcactaggtacctgaagaagccacagatactgaatgccagcccatgacagcagccagaggggggctgtaccctgcaaagccacaggggtggagctgtccaaggccatgggaacccaccttttgcatcagtatgaccaggatgtgagacatgtagtcaaaggagatcattttggagctttaagatttgactgccccactggattttggacttggacttgcatggagcctgtagcccatgttttggtcaatttctcccatttggaatgggtatatttacccaatgcctgtacccccattttatctaggaagtaactaacttgcttttgattttacaagatcataggcagaagggacttgccttgtctcagatgagactttgaactgtggacttttgagttaatgctgaaatgaattgtgactttgggggactgtaggtaaggcatgattggttttgaaatgtagggacatgagatttgtggggggcaggtgtgagatgatatggtttggctgtgttcctaccaagatctcatcttgcattgtagctgccataattcccaggtgttgtgggacagatcttgtgggaggcagtttaatcatgggggcaggtttttcccgtgctgttctcatgatagtcaaaaagtctcacaagatctgatggttttataaagggcagttcccttgcacatgctctcttgcttgccactgtgtaaaatgtgcctttgctcctccttcaccttctgccatgattgtgaggcctcctcagccatgtggaactttgagtccattaaacgtctttttctttataaattacccagtctagggtatttcttcatagcagtatgataatggactaatacaccatgtgttattattctgcagttcttccacaaaaaggttgatcattttttcctgtcctttttgttttttggtgggagagagtgcttggccatgtggcatttttttggccaatgaaatataagggagaaatgataccgagcctgtttcaagcttcagccttcttttcctcctgtcttctggacatcactgtaaatagaacatgccaaggtctaatggctcagggaggatggcccaaggaggatgagacacatcctccatggggatctacaacattgaatagctgtccctagataccacagtcaaagcagaattgccctagtcacccacctgtttatgagaatatgtgagtgttggttatggagttgtgaaaggatttgttatatagcaatatggcttcattaattgactaatgcacccctcttatgtgctcctgtatttccttcatttaacaatttgcactatatttaaattgcaaacttaattaatcatccatcatcttcttgacagcaatttcagagaaattagaggtttatatctgtctcaattcccaatatgtctgctgtgcctttcatggagctaggcataaaataaatgttcattacatatttgtttaatttaacttttaccagattgtaagatttttatggacaagtattttgttttatttacttctcatttactttcaatctgcaaccacaacacctatatcacctattaaataatatattgtatatacacatatatgtgtgtgtatatatatacccacatatacatatgtattatatctaaataaacaacatatgtgaataggtgtatagataaatgtgtagtgtaagtttaaggtaaatcggttataataaacatggccagattaacaggaagagtagaaagtgagaaactgaatacacaaataatgactagaccgcatacaaaaacggacatgtgaaacatagtctgcaacaacctgcccaggaaatcagcctattatttacataaccagctcaggaaagccaaattgctgtaagtgggtggtagtaggaagtcagtctgccatccctatgacagtccatgaagccaaacattaactcctataacaagtggcctaaaatgactagggcttgatctataactgacagcttttctaatttttgtccctgattcaaacttaggaccaaccaaagaaagccaaatatgaaaccttaatcaatcatataacatgaccgcttctagttagactacctactgtttcccatgctaacagccactgatcagggcacacctgaagccttcccttttgtccactgtaaaacttccccactcctctaccttctctgaaatctctgctaaaatgcaaataacagtggctgactcccttgctattgcaagctttgaataaacagtctttactttttctaattagcttggacttcatttatttccaatgagctatctgattttgtagtcaacatttttgtctggtcacctagttttgacctgctggatacaaaacagggctctaagctaaaatcgcttataacagagagaaagggcatgtagaatgtgtaggtctgggaggacaaaggctgatagatttttagctgtgtatatttcacagttaaggaacgcatgaaatatttaaaagggagaaagatcttgtatggattatgaaaaagtcatacgaaacatattgtaaaatattgctactgataatttatatgaaaatattttatttgaataatacttcttattgagttaagattggaatactggaattttgaattatactgaaaaatacacggtctgtgaaagtgacaggaatgagaagagtttagctccacacaagggcagcataacacttgtagaacaccatgctgaaagtgaatatgtgtatttcgtttgatatgtatatgtaatccttcttgaagagggtcatttacctaagcaaatattgaaaaggttttattttagcaataactacccccgacaatgatgtgttcaactcccatctttccactggaaaagcttgcttccttaacaatatcccagtttactttcagaacttttagtcactctttattaagcagtcacttttattatttagaattttatgaaacctcagtctcatattcattttgaacctcttatcttcacctgctgagtctagaccaataatatctgagtcttggagtggagcggtcatgtggtctgctctttagcagcaactttcctccccgcctctgccctgttcttgaccctcaggaagagtcctgggacagggaaaagacagactcctccctgactatataagctgatagctccccacctttttgggtgtcactagtaatataaaaaataaaaataaaaataaaaatc

SEQ ID NO: 1934 - DNA, 1282 bp, Homo sapiens
gccagctggacatcctgggtcaagtggggacttggaggacttttctgtcttacaagaggattgtaaaatgcatgaatcagcagtctgtagctaggattgcaaaatgcctcaatcagcactctgtggctagctagagctttgtaaaattggaccgatcagcactctgtaaaatggaccaatcagtaggatgtgggcagagacaaataaggcaataaaagctggccaccccagtgagcagcagcaacctgcttggaccccctttcacgctgtggaaactttgttctttcgctcttcacaataaatctttctgctgctcactctttgggtctgtgtcatctttaagagctataacactcaccgcgaaggtctgcagctccattctggaagtcagtgagaccacgaacccaccagaaggaacaaactccggacacatcttggaaactatgaagggactatcgccaagtggattgatgccatcaagctacagatggtcttacaaatggaacaccaaatgagctctactaacaatttctactgtggaccactggactgacccactgaccctttggctggcctagagagatctgctctgtaggacactaccactgccactgcagggccccttctttgcctctatccaacaggaagtagctagagtggtcatcacccaattcccaacagcagttagggtgtcctgtttagaggggggattgagcgatgaagccagccggacttcctgggttgagtggggtcttggagaacttttctgtcatacaagaggtttgtaaaacacaccaatcagtgttctgtggctagctagaggtttgtaaagtgctccaatcagtgctctgtaaaaacgcaccaatcagcgctctgtggctagctagaggtttgtaaaatagaccaatcagcactctgtaaaatggaccaatcagcaggatgtgggcagggacaaatgagggaataaaagctggccaccccagccagcagtggtaagccactcgggtccccttccacgctgtggaagctttgttcttttgctcttcacaataaatcttgctgctgttctctctttgggtctgtgccatctttaagagctgtaacactcactgcgaaggtccacggtgcattcttgaagtcagtgagaccgcaaacccaccagaaggaacaaactccagacacactgtcatagcaggcaaggaaaagaagagagttactgttttggctggggtaattgatcttgactaccaagaagaacatggatggatactccacaatggag

SEQ ID NO: 1935 - DNA, 1055 bp, Homo sapiens
ttctctttaaacactgatgtgtagctagtaacttggataaaaaggtgccaccctacaaaatgtgctcagcatgttctgaggccaggatgggcttggccacctgggctggggcgaaaggagacctccatctgtcacagtggaaactgaagccgagtgccagtgccgcgtccggcttcaagatcaagagtcagagcctttgaaatggaaagggggcatctgaaagggcacccccactgggggctttcagagctaaggctccagaaggaagggggtcgccctgctagtgacggagctgggagtcaccctgagctacagcatgcccagatttcccctgtgggaagccccatctgaccttctacagcccacggctctgcaactgccacctgtactcaggtacatggcgtcgctgctgctggcttttaaaatcagctattagtttgagatgtgacagtcgccgacagggttctgtcctagaaagccatcccagtgccgtgttggctcaggggtcaccagctttgtgctgcctccgtaacagcaggagggttctcaaagcaatgttccactgatccctggatgccactgcagcattaaagacagggtcagtccccttgaggggaaaggtggcttcaaggctgttctctgggcctctgcccactcgggcaagaatcactgggtaccatgagcagcaggtgttcacccaacttcacgtgtacacccctagtgaccgggagcgcaccacctgaccgggcgacactccttcccaaagagcctcctggcaacacccacggcaggagcgccacaccatcccatcaccagcacccacttacccccctggggctaagatggggggcgtgagcctttcccctgagagcaaacgggcagcaagaactgctcagaatagagccgccagctagggagagggacagggcggccatctccctcctcttgcctgcatccccagccctgggcctgcatgagacctgctgggtaggaagacagcctctctggggctgcttacagtggcatgagcggatgtggggaagcggcctgtcccc

SEQ ID NO: 1936 - DNA, 1055 bp, Homo sapiens; identical to SEQ ID NO: 1935

SEQ ID NO: 1937 - DNA, 1055 bp, Homo sapiens; identical to SEQ ID NO: 1935

SEQ ID NO: 1938 - DNA, 1055 bp, Homo sapiens; identical to SEQ ID NO: 1935

SEQ ID NO: 1939 - DNA, 4192 bp, Homo sapiens
ccccgcccgagccgggcggagcggagcgcgcggagcctagacccgctgccgggccggggctgggccggagcggcggcgcctggatgccggcccggggctgggccggagactggcgcccgccccgaagcgactttcggtccccgacccgctccgcctgacccctatgatgaagagggcgtccactggagttcttgctgtcgacatctttgacaagttcaacttcacgggagccagagtcccatggttcgacgccattcatgaagaattccccagggagctggagtcctccatctccttcccagccaacttcttcaaaccacctgaagaaaaagaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcatgtgagggctttgccaagacacagagaacccgcagggttgttggctcagcggcagatcgtcccacggggacagtctcttgtggtctgtgtctcccccttcagccccctgtggggcagtgagcctcctgctctgcttctgtgggtgcatcagagcccccccagatgcccacacgcagacgcgcacaggcctgcacgtggaaacacagacatgcgcacacgcaggcccacacacagacgcacacagagctgcacgtggagacacgtgcgcacacgcaggcccacacgcaggcccacacacaggtgcacgcggacctgcacgtggagacacagatgtgtgcacatgcaggcccacacacaggtgagcgtggacctgtgtgaacagatgcgcgcagacctgcacgtggagacacagacatgcaggcgcacaaagagatccctcaaggctgacacccaggaaggggcctctcacttgtgggactcccgagatgcagtggccaacacgagtgtagtgcccagttcactgctggataagacagaggcctgttctggtcacacatgggaggcagaacccagagactgggcccaggagcccttctgctgacagtgggaactcccagctacgtgtgggggtccccataccagacaaaggtccctgaccttagtcttgcccgagaggccgacacagcccagctttggggtctggctttacccacaagaggccacaccttgccacagcactgtttatctggcctgtttcagaagcaccgtcagagtggcgaaggcaggaggtggtgcacgagagtctacgttctagcatccattcaagtgagggaaaggcgtttcgtacttagaaaaatgcaaaattaatgattctcacccacacatgagactgtggattcacccatgtatgagatagtggattcagagccatgctgtggctctcatctgctgggagccagtagtgtttgtgctttggttttgcttttttagctacatggtttatgtgaggtgcggacttacttgagttgctctgtctttacagggagcttgctttttctctgctggtttgttttcacttttgctgtctctgtttagaagaaaacattagaactggggtgtggtggaaggatgggagcacaatctgggaggggaagacctgctctctctccacataccaggagggagtggcaggaaggggagacactgtgccggactcagggagtcaagagcgtgagcacccccaggcttcaatctgctgaacgttgtgcatctgggggcgcccgtgcagcaggaacactctccccatcacaattcctctgggcacagtggagagccatgagtgggggctgtcctgggggctgcgctatggtgagtgagcccacgccaggagccagttcagcccagcctcattcttctcctgcttctttgctttccaagttctagttcataagcaaccagcacagtacctggaatgtaagaggcgcttggcttataaaagagagaagaaaggaacccctttcaccacgagggacgtcaggcccagctctctgtcccgggcattcatcttttttccggcaattagcttcagctctaatgacctgctgtctgctttatgttgcacctatgatttccagattgtaaagtttgtggcaaatgtattaacgttcacatcccatttacagattagcaaactaaggatctgagaggttatgtgattttcccagtctggcggagggcagggccctgtcagaagccgagacacacctcgtaacagcttgttatttggggcttcccatcagtgaggcaggagtcataatggggccctggcttctgggcaattcccataaaacattgtgccacctgaagatggaagtgtcagaggaaggcgagatgttatttctgaaagcatctaccctcagaaagagacagaggagtgcatcgcagctgtgtgaacccggggtggtggtggttccagcagcggggcacgtggtggacgcaagacggccccgtttgagttttgctgctaggtgacatgtagaacttgaacttcagagggtgctccttggaggccctgatgagagagacacagaagggaagggagactgttcccatggtcctgcctctgcggcagcgagcctgctgctcttgcagctgggtggctgttcggtgcagggggccggtgaggaacacggtggggagcagcctgcgagggcgccgggctttcagcactcactatacctgctgtttggtttggccaggatggcctgggagtccccagggccgggcaaagactgcccccaacagacatgggcggagggaaccgtctcacccctgcctcttctcccttctctacgcagtgtcagtgggacgggagggtggtctgcccggggcttcaagctcctgtccaggaaccggacccatgtcgtacgccagtgcagccacacggccagcttcgaggtgctcatggacgtctccagaccaagagcagtgatgaccttttagctggaatggccagaggggtaacggtgactaatggtgttaaagggaaggaaagctcctgcccatctgcagcaccttcggcatctgcccctgccatgaccactgtggagaacaaatccaagattagcacagggcaccaactggacagaggcctccggtcagcctcactctgactgcaaccccctctcactggacagcatcacctggacacagagcctcacctagtctgtgtcccatggacacaactttgctttggacagtgacaccaagaatactcacccctttacttagccagaccacaggcagccacctggacacaaacatctctccagagtcagcctccacacagactccacagcagaactcccagggaggcactggggcatggcttcagagcaccaggcagcgctccgcggtgcctagcacccgctcagccagggcagcctgcagcggagcttggagccagcagcttctcatctcttggcctcgggaaatgtagctggagtcatcatttagcagagcacggtgtccctgggttggccacccagcttagttttaaaataaaataatgtaatcttggcctaatggtggaatttctgactgctagatgttctccttccatctgaccaggggattcagacacaatgtataggatgagggtgggggcccttctccctctgagaggaacctggagaggcccgggttctgctgaggtaggagagggtcactcagagggctcccacggaacagacaggcacactgaggcctcagtgggattagggcaggaaatgcccctcttgcaatgggggaccacgccgggtcacgcacccaccccctccaggctacattaggctaaggtcactctgtgcattatttcattatttcacatggagggtcgcccacggttgacagaaccacaggctgagccccaggcccatcagagcgcagtgcacaac

SEQ ID NO: 1940 - DNA, 4192 bp, Homo sapiens; identical to SEQ ID NO: 1939

SEQ ID NO: 1941 - DNA, 4192 bp, Homo sapiens; identical to SEQ ID NO: 1939

SEQ ID NO: 1942 - DNA, 12465 bp, Homo sapiens
gcggagcggagcgcgcggagcctagacccgctgccgggccggggctgggccggagcggcggcgcctggatgccggcccggggctgggccggagactggcgcccgccccgaagcgactttcggtccccgacccgctccgcctgacccctatgatgaagagggcgtccactggagaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcatgtgagggctttgccaagacacagagaacccgcagggttgttggctcagcggcagatcgtcccacggggacagtctcttgtggtctgtgtctcccccttcagccccctgtggggcagtgagcctcctgctctgcttctgtgggtgcatcagagcccccccagatgcccacacgcagacgcgcacaggcctgcacgtggaaacacagacatgcgcacacgcaggcccacacacagacgcacacagagctgcacgtggagacacgtgcgcacacgcaggcccacacgcaggcccacacacaggtgcacgcggacctgcacgtggagacacagatgtgtgcacatgcaggcccacacacaggtgagcgtggacctgtgtgaacagatgcgcgcagacctgcacgtggagacacagacatgcaggcgcacaaagagatccctcaaggctgacacccaggaaggggcctctcacttgtgggactcccgagatgcagtggccaacacgagtgtagtgcccagttcactgctggataagacagaggcctgttctggtcacacatgggaggcagaacccagagactgggcccaggagcccttctgctgacagtgggaactcccagctacgtgtgggggtccccataccagacaaaggtccctgaccttagtcttgcccgagaggccgacacagcccagctttggggtctggctttacccacaagaggccacaccttgccacagcactgtttatctggcctgtttcagaagcaccgtcagagtggcgaaggcaggaggtggtgcacgagagtctacgttctagcatccattcaagtgagggaaaggcgtttcgtacttagaaaaatgcaaaattaatgattctcacccacacatgagactgtggattcacccatgtatgagatagtggattcagagccatgctgtggctctcatctgctgggagccagtagtgtttgtgctttggttttgcttttttagctacatggtttatgtgaggtgcggacttacttgagttgctctgtctttacagggagcttgctttttctctgctggtttgttttcacttttgctgtctctgtttagaagaaaacattagaactggggtgtggtggaaggatgggagcacaatctgggaggggaagacctgctctctctccacataccaggagggagtggcaggaaggggagacactgtgccggactcagggagtcaagagcgtgagcacccccaggcttcaatctgctgaacgttgtgcatctgggggcgcccgtgcagcaggaacactctccccatcacaattcctctgggcacagtggagagccatgagtgggggctgtcctgggggctgcgctatggtgagtgagcccacgccaggagccagttcagcccagcctcattcttctcctgcttctttgctttccaagttctagttcataagcaaccagcacagtacctggaatgtaagaggcgcttggcttataaaagagagaagaaaggaacccctttcaccacgagggacgtcaggcccagctctctgtcccgggcattcatcttttttccggcaattagcttcagctctaatgacctgctgtctgctttatgttgcacctatgatttccagattgtaaagtttgtggcaaatgtattaacgttcacatcccatttacagattagcaaactaaggatctgagaggttatgtgattttcccagtctggcggagggcagggccctgtcagaagccgagacacacctcgtaacagcttgttatttggggcttcccatcagtgaggcaggagtcataatggggccctggcttctgggcaattcccataaaacattgtgccacctgaagatggaagtgtcagaggaaggcgagatgttatttctgaaagcatctaccctcagaaagagacagaggagtgcatcgcagctgtgtgaacccggggtggtggtggttccagcagcggggcacgtggtggacgcaagacggccccgtttgagttttgctgctaggtgacatgtagaacttgaacttcagagggtgctccttggaggccctgatgagagagacacagaagggaagggagactgttcccatggtcctgcctctgcggcagcgagcctgctgctcttgcagctgggtggctgttcggtgcagggggccggtgaggaacacggtggggagcagcctgcgagggcgccgggctttcagcactcactatacctgctgtttggtttggccaggatggcctgggagtccccagggccgggcaaagactgcccccaacagacatgggcggagggaaccgtctcacccctgcctcttctcccttctctacgcagtgtcagtgggacgggagggtggtctgcccggggcttcaagctcctgtccaggaaccggacccatgtcgtacgccagtgcagccacacggccagcttcgaggtgctcatggacgtctccaggtgtgagatgggcatcttcttgtggccactatgcccgctgagcctacccccaaacctgcccctcctcaaactaaatcttccattctaagcgctttgaacgaagcaaatcaaccaattaaaaaaatatattccaggattggccagagtctgtgaagatttccataacaaatccccgttacaagggttttcagagagccctggttgtgcattaaaccccgcgatggcaaacccaaagctcaggctctgaggagctcttggagtctgcccctcgcttcagagatggtctgtgcgagggtgccgctctcctcccgctttgatcataaggaaggtgacagctgctggggacggtaggcactctccctcagggccacaagctgggctgcaggataaaagactgggcggctaatgtttaacctctggcattttaagcggcctgggagtgtgagccggccattgtgggcctgcagatgaactggggagtggcccgagtgctgtcctcggcaggacagtgctatccagccaggaagtgggtggcagccagcctgggagtggcctatgtgggaccctcctgtctaggagtcagagccagaggcctgggtggcctcccctggcccctccccagggctgcgctgtagctcaagggcccaggccaccatccttcccgagggctttctgatgtgaagtggccctggtttctgtcacagtcttggaagggtgagtcagccctggggcagggctggaggagggctgtggcttcctgtacaatgtgcgggggaagctgtcccacctgtgcccccatctcatgggcaaatggcactccccagcaggacccagcctggagaggggttcagtgattagtggactttgttcatagaagggcagggttgggggttgtctcgtggccaggacgccgggcaacatgtgggccaaggaagctgaaattgaggcggaaggaaggaggctggagtgggagtccgaggctcccatggcctgggtgccccaaagttagcggtctctgaacagccctgaaccagtggagggagactggggtgctgctcctggccccagggatgtccagggcccgggcattgaagggacctcagaaggggcagttccaggcccagggctgtgagcactcggcctccccaacccagccaggtcttggcttcccagctcctagttccacatggtaagcaacgccttccagaagttaccagagaaccagagcttgttgttccccaaatgcagaaactccccagggacctgggtcctgggcaagtgtcctggtttgtaaaagcacaggaaacacagcaatgtgaacctacacactgctgaactgtacgcttcaaagtgtccaagatgatatgttttatgtcatgtatattttagcacaattttcctttttttgttttttgacacagttttgctcttttcgcccaggctggagtgcagtggtgaaaccttggctcactgcaacctctgcctcctgtattcaagtgattctcttgtcttagccttccaagcagctgggattacaggctgcaaccaccatgccgagctaatttttggatctttagtagagacggggtctcaccatgttggccaggctggtctcaaactcctgacctcaggtgattgacctgcttcggcctcacaaagtgctgggattacaggtgtgagccactgtgcccagcctgttttttaaagacatgttcactgcctgtaagaaatgcataataaggtggggtgtggtggctcacacttgtaatcccggcactttgggaggccgaggtgggcagatcatttgagctcacaagttcgagaccagcctgggcaacatggcgaaaccctgtctctaccaaaaatacaaaacttagccaggcatggtggtgcatgcctgtagtgccagctacttggcaggctgaggtaggaggatgacttgagcctaggaggcagaggctgcagtgagccaagattgtgcctctgcaacagagccagaccctgtctcaaaaaaaaaaaaagcataataagggatctggaatttaaaaaataggtccatataacaagctataatagagacgtgcagctggcacaggacatccatccactggtgataatgatagaacacgtcatattgcacgatagtaggaaaaacaggacagatgggaagggtgcggatgaccagcgccgtagcaatctgaagcatcgagcctgccagtccacataactgaaacctgaagctctgcccctgcccagctctgtgacttccagcaagttgtttagcttctttaagcattgattttctcacctggaagatgagggttgcattcacactctcttcatagctgtgacctaaggatgatatgaaacgacgcccttggcagatctatcagaacccctaccacataataagtgctcagtaaaaggttttgctgaacaaaggaaattacattcatgttgtattaccacaattacccactttctttataaagcggtagtaagtctttcagccaaaagaataagtccatgatgggattaagtgaaagtccaagaggtactgcatgcacctaaggtggagatgtgtttatcttttgcataagctggggatgtatttggaaggtttctgctagcccagaatttgggtggacaggctgagcccctcccaacagcaggattcacctatggggttggttttgggtagacaggctgagcctgccccatggaactgtaggggcttacgaaggcatttcgtttggggaaggagctcatccaggaggactgggatctctggttatatgtgacttctgacctctgggcatggaggtctctctccagaggcccaggcctggacacgaagggagagaggcctccattgtcccacaggggccgaaatgcagacggtgcatccccggtgccctggggaacccttctctgatcatcaggattctcttggactccggggtccttgtcctgctcaggcatccctgccctgctgtccttcagggccctcaacacgatcttctctggacacgagtctggggatagccgggtgttgtgggctccaaagggttgactccttgctcctgggccccacagagagtccttgtgctcagtgcactggctgtgctgcaagatatcctggaattcgaagcacacagtgctggcttgctgtggtacctgtgcaatcaaattgaaggcaagatcaccaggaaggaacacagggcttgcaagatcacggaaaaccttcttggagttgttttgacacaccactcatgtcaagtgtctgggtacttgtaggatggcccgccactccacccaggggcaggagcaacagggagatcccacaagcaaagtgaactgggggatggggtgagtgggctccaggcaacagagccctactggcaggtcctcaccccctgggccggaactggagtgaggggcacagagtgcccaggtaaccgctcctgggaacagtggggaactgtcagatgctcgaactttcgagagctgggctctgagcgtcctcgtggagctgccaactcggccaaaggagaagcgagcagtttcttctgttgccgggcaacacgccttttaaacctgagcgagtgggtgcgcatgcaaagaacgggcgcgagtgacagagcgaccttaacggattagcaccttaacggattagcaccttaacggattagcgtggcaaggtatgcaagcaagtcacctgctggcaatttgggggtggggagggggaggtgcgcaatacatactggaaggagaggcacccacacaaaggacgcaggaagaacaggtgcgcacaaaggcacaatggcggcagatctgcccgtggatcactgaagattcctgctctcctgctgaggtggagattgcagtgaactaagatcacaccattgcgctagagcccgggcgacagagcaagacttggtctcaaaaaataaataaaataaaataagtacaataaaataacaaaacaaaacaaagtaagaggagatgatatctggtcgtgttttatggccatctggtaagctagattctttcctttggttttattgccaatcaatgattagaaagaagcagtttgctgttggcttgtttttcccctcaactaaatgtaagaaaaaaaaagagtcaaaaataccgaagctaattttaaaatgtatgtatagagagagacttggtcttaccttgtcatccaggctggagtgctgtggtgccatcacggctcagggcagcttcgacctcatgggctcaggcaatcctttcacatcagtcgaccagatagctgagattacaaatgtgggaaaccacaccctgctaatttcttgtattttttgtagagtcggggtttcaccttgttgccgaggctggtcttgaactcctgggctcaagcaatctttctgcttctgcctcccaaagtgttgggattataggcatgagccaccattcccgccgaaatatttttgagattcatagagatgagtaggtcataataagagtgcacaacttgtagttatatttaatatcttttgaaattactcggcacccccattgtaatttaaatgatttgttcctgacctggttttactttgttcctgagggttgcagatcccttgaacaatattccacgaatgaagcagtgataataaacctgcagctgccccgagggggcgctgtgcggaggttcacaaagggacctgggtctccctggtgcggatgcgggggccgcctccattctgctttctgacactgccaccgcggggccaggcttgatgtgaccccatcactgctcagttcactacacagtttcatcttttgatatggaagatttgactccatccacgttccttaggaggttactggaaatgacagcgctgtaaatttctgggtaaatgagcagccaacatttttgggagctgtcacacaaccacactgcccttccctctgcctgaaaacctttaggcctgattgactcggagaaagcccattaaactcagcccccactgacttgttcatttccactcaaacgtttgtgatagtcccaacacaaggcttgtcctccaagggacaacttgtaaacacttctaagagaaagggttgactgggcccggtgcctcacacctgtaatcccggcactttgggaggccgaggtgggcagatcacttgaggtcaagagtttgagaccagtccatgatcttggcttgaagaggcaagaccctatagtttattgaacattttaagcccactccttgatccatgagccgcagaatggatgttgtattagcaaaaatgaaaacaacattaatctccttgtatcatcattagagctcctggctgactggttacattgtcaatcaacagtaatattttgaaaggaacagtgggcttaaaatgttcaatatgctgtcaacagatgtgctgtcatccaggctttgttattccgtttatagagcacaggcagagtagatgtagcgtaactcttaagggccctaggattgtgggactggtgaatgagcactggcttccacttaaagtcaccagctgcttaggccctaatgagagagacagcctgtcctttgaagctttgaagccaggcattgacttctcctctgtagctatgaaagtcctagatgtcatcttttaatagaaggctgttctatccacattgaaaattgtcatttagtgtggccaccttcatcagtgatcttagctagatcttctgggtaacttgctgcagcttctgtatcagcacttgctagcttcgccttgcacttatatgttatggagatggcttctttccttcaatatcgtgagccaacctctgctagcttcaaacttttcttctgcagcttcatcaccaatctcagcattcatagaattgaagacagttagggccttgctgtggattcagctttggcttaagggaatgttgtagctggtttgatcttttattcaaggcaggaaaactttctccatatcagcaataaggctgttttgctatctatcatttgcgtattcactggtgtagcacttttaatttccttcaagaacttttcttctgcattcacaacttggctaactggcctagctttcagccttttggcttttgccgtgcctttctcaattcgcttaagcatttctagattttgatttaaagtgaaagatgtgggagtcttcgttttacttgaatacttagaggccattgtagggttactaattggcctaattttaatattgttatgtctcaaggaatagggaagcccaaggagagggagagagacagaatggctagtcagtggatctttcagaacacacacaactttatagattaagctcactgtcttatatgggcacagttcatggcaccccaaaacaattactatagtagcatcaaagaccactggtaatacatcaccataacagttataataataatgagaaagtttaaaatattgcaagaattaccaaacttgacctagagacattgaagtgagcacatgctattggcaaaatagtactaacagacttgtttgttacagggtagccacaaacccccaatttgtaaaaaacgcagtatctgtgaagcacaagaaggtgaagtacaatctgaggtgtatctgtattttcttccacgttgttaggtgtcttcttataacctaagttttagattttcctagacaataacttaaataattttagaacattataaattacttctcccttgaaggattgcttgtggtcaggagtttgagaccagcctggacaacatagtgagatcttctctctactaaaatttaaaaaaatatatagccaggcatggtggcgatcctcccacctcagcccagctacttggagggctgaagcagggggatgacttgagccaggaagttgaggctgctgtgagccattatcacgccactgcactcctgcctggacaacagagcaagaccctgtctccaaaaaaaaaaattacttcccctttgattatagaactttgtcacatatcaagttgattaaatgaagataattcaagcattaagtaattatttaatgctttttgtgttcttctagtttgagttctatgattctatgatcttaagatatttaccttaatatatagagagacatatatattaattattatataacacaaatcaattatttcaattaataatttgaagtttttttccatttacttggtacttagaatgcagggggaaatatgatataggatggttagtcatacataaggaaaattctttttgtacacttgacagtcttggctacatacccaattctctgcttttttatttcctatggacacttctttgatgatatatatgtatggcttgggggaggcggttggcttttgtttcctgtgagacagatatctaagttccatagatatctgttccttccctttagaagcaaagaggatactggttcttttatttcaagatctgtaagttaaaattggacagtctgaaatgcataatctttttcttttttgagacggagtctcactgtcacccaggctggagtgcaatggtgcaatctcggctcactgcagcctccacctccctcccagtttcaagtgattctcctgcctcagcctccagagtaactgggattacaggtgcctaccatcatgcctggctaatttttgtatttttagtagagacggggtttctccatgttggccaggctggtctcgaactcctgacctcaagtgatccgcctgcctcagcctcccaaagtgctgggattacaggcgtgagccactgcacctggtctgaaatgcataatcttttaaaactgaaagccatttctaatagtgttcttaatttgtcaagaatcgtatgagaagtgccagtgccctttgcctgtctagctataagtggattatcatgcccaccctttggagccagcagttttggttcagtcctttggtctctgactactcacagtctgcaggaaagagcaggttgtgacacttgactagtttatgagagcagaagctgttacgtgacacttagcacatactgctctcagaggccccagatggatcattaatgctcggaacgtgcgtgctttatggagaaaccgcctaatcaacggaggtagattccctaatacccatatcatctttcgttaactctcttaagagtcaccctaaaattactgtgctgacgatcactgtatttcattaagtatccattacaaaacaagcccttatgagtttagcttttatttaacaaatacattgttctcttctaacttgtgccttttatcatccgttgaagctttagaatagtagaatgttcatgctgaaaacgtcttggcattctggtttattatcaggtttacagatctgggactgaaacccgcacaaggataaatggctgcctcaaggctatcttaccaagagcagtgatgaccttttagctggaatggccagaggggtaacggtgactaatggtgttaaagggaaggaaagctcctgcccatctgcagcaccttcggcatctgcccctgccatgaccactgtggagaacaaatccaagattagcacagggcaccaactggacagaggcctccggtcagcctcactctgactgcaaccccctctcactggacagcatcacctggacacagagcctcacctagtctgtgtcccatggacacaactttgctttggacagtgacaccaagaatactcacccctttacttagccagaccacaggcagccacctggacacaaacatctctccagagtcagcctccacacagactccacagcagaactcccagggaggcactggggcatggcttcagagcaccaggcagcgctccgcggtgcctagcacccgctcagccagggcagcctgcagcggagcttggagccagcagcttctcatctcttggcctcgggaaatgtagctggagtcatcatttagcagagcacggtgtccctgggttggccacccagcttagttttaaaataaaataatgtaatcttggcctaatggtggaatttctgactgctagatgttctccttccatctgaccaggggattcagacacaatgtataggatgagggtgggggcccttctccctctgagaggaacctggagaggcccgggttctgctgaggtaggagagggtcactcagagggctcccacggaacagacaggcacactgaggcctcagtgggattagggcaggaaatgcccctcttgcaatgggggaccacgccgggtcacgcacccaccccctccaggctacattaggctaaggtcactctgtgcattatttcattatttcacatggagggtcgcccacggttgacagaaccacaggctgagccccaggcccatcagagcgcagtgcacaac

SEQ ID NO: 1943 - DNA, 1174 bp, Homo sapiens
gaaagaaaaagcatgtgagacacagaacagaagcccccaaacagaacaaaatggaaaaaaaaaagatttttcacagatgaagaagttcacattcattcgattcattgagcctgcggagagggaagagataggaattggtcactacggggagggaagggtgggagactagggggcggaagagaggaggggctggaacaccgtggggggggccaggaagccccctcccaaacctgcgctggctcaggctggaaggacgtgcttgttaactgtctagccaggtgctcgcgggactcgctgaagtcacgctgctccctgatggagaaggagggacagagcaggaagagaggagaggggccgcggagggcggaggcgctagggtcgtaggggagctgccctgtctccggagggcggtggctcccggcgcagcacgacgacatgaacaatccagagatcatggtgtccccacaacacccctgtgaggtaggttggaaggtggcaacgatcttcacgcccacttcacagacaagcccgggacacaggcaagcgcgagcgcatgggaggctgagcccggcggggcaggggcctgggccgctccccgcgtccccaccagtccctgccagagccaggccgcctgcaacacagtcacttggacacaggaaaaaagatcatgggtttaaaaaataaaagaataaaaagaacaaaaaccaaaaaagtgatgcagagaaggggaaaaaatagacgttttcttcccaagtggccagattgtgagcgaggtggtggcggccgggccggtgcccaccgtccgcgctgtctgcctgccccccgactccccagcagttcagaagtcccgcctgcgagtctcagcgctccccagcatcacgacagcggcacacaggaacaagcagccggcgcagggaggcctcttcgtttaacctctggacccagcgaatgcttccctggcggtgcgtggggactcccggagacctccggccacacggcccccgctgcaggcatcaagggcacaccccgcaggggaaggggtttccggcgctacccactaaggcaggatggacggtggccgggggttggaaggagaaaggaggaggaggagggtggcaattcccacttgcctgctgctgtccctgctgcgtgggcggcggctgggggccgccag

SEQ ID NO: 1944 - DNA, 1174 bp, Homo sapiens; identical to SEQ ID NO: 1943

SEQ ID NO: 1945 - DNA, 4293 bp, Homo sapiens
gcccgagccgggcggagcggagcgcgcggagcctagacccgctgccgggccggggctgggccggagcggcggcgcctggatgccggcccggggctgggccggagactggcgcccgccccgaagcgactttcggtccccgacccgctccgcctgacccctatgatgaagagggcgtccactggagttcttgctgtcgacatctttgacaagttcaacttcacgggagccagagtcccatggttcgacgccattcatgaagaattccccagggagctggagtcctccatctccttcccagccaacttcttcaaaccacctgaagaaaaagtgcttaggtagaggttgagcatcctaatcctgaaatctgaaatgctccagaatctgaaccttcttgagcaccaacctgacacttaaaggaagtgctcattggaggaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcatgtgagggctttgccaagacacagagaacccgcagggttgttggctcagcggcagatcgtcccacggggacagtctcttgtggtctgtgtctcccccttcagccccctgtggggcagtgagcctcctgctctgcttctgtgggtgcatcagagcccccccagatgcccacacgcagacgcgcacaggcctgcacgtggaaacacagacatgcgcacacgcaggcccacacacagacgcacacagagctgcacgtggagacacgtgcgcacacgcaggcccacacgcaggcccacacacaggtgcacgcggacctgcacgtggagacacagatgtgtgcacatgcaggcccacacacaggtgagcgtggacctgtgtgaacagatgcgcgcagacctgcacgtggagacacagacatgcaggcgcacaaagagatccctcaaggctgacacccaggaaggggcctctcacttgtgggactcccgagatgcagtggccaacacgagtgtagtgcccagttcactgctggataagacagaggcctgttctggtcacacatgggaggcagaacccagagactgggcccaggagcccttctgctgacagtgggaactcccagctacgtgtgggggtccccataccagacaaaggtccctgaccttagtcttgcccgagaggccgacacagcccagctttggggtctggctttacccacaagaggccacaccttgccacagcactgtttatctggcctgtttcagaagcaccgtcagagtggcgaaggcaggaggtggtgcacgagagtctacgttctagcatccattcaagtgagggaaaggcgtttcgtacttagaaaaatgcaaaattaatgattctcacccacacatgagactgtggattcacccatgtatgagatagtggattcagagccatgctgtggctctcatctgctgggagccagtagtgtttgtgctttggttttgcttttttagctacatggtttatgtgaggtgcggacttacttgagttgctctgtctttacagggagcttgctttttctctgctggtttgttttcacttttgctgtctctgtttagaagaaaacattagaactggggtgtggtggaaggatgggagcacaatctgggaggggaagacctgctctctctccacataccaggagggagtggcaggaaggggagacactgtgccggactcagggagtcaagagcgtgagcacccccaggcttcaatctgctgaacgttgtgcatctgggggcgcccgtgcagcaggaacactctccccatcacaattcctctgggcacagtggagagccatgagtgggggctgtcctgggggctgcgctatggtgagtgagcccacgccaggagccagttcagcccagcctcattcttctcctgcttctttgctttccaagttctagttcataagcaaccagcacagtacctggaatgtaagaggcgcttggcttataaaagagagaagaaaggaacccctttcaccacgagggacgtcaggcccagctctctgtcccgggcattcatcttttttccggcaattagcttcagctctaatgacctgctgtctgctttatgttgcacctatgatttccagattgtaaagtttgtggcaaatgtattaacgttcacatcccatttacagattagcaaactaaggatctgagaggttatgtgattttcccagtctggcggagggcagggccctgtcagaagccgagacacacctcgtaacagcttgttatttggggcttcccatcagtgaggcaggagtcataatggggccctggcttctgggcaattcccataaaacattgtgccacctgaagatggaagtgtcagaggaaggcgagatgttatttctgaaagcatctaccctcagaaagagacagaggagtgcatcgcagctgtgtgaacccggggtggtggtggttccagcagcggggcacgtggtggacgcaagacggccccgtttgagttttgctgctaggtgacatgtagaacttgaacttcagagggtgctccttggaggccctgatgagagagacacagaagggaagggagactgttcccatggtcctgcctctgcggcagcgagcctgctgctcttgcagctgggtggctgttcggtgcagggggccggtgaggaacacggtggggagcagcctgcgagggcgccgggctttcagcactcactatacctgctgtttggtttggccaggatggcctgggagtccccagggccgggcaaagactgcccccaacagacatgggcggagggaaccgtctcacccctgcctcttctcccttctctacgcagtgtcagtgggacgggagggtggtctgcccggggcttcaagctcctgtccaggaaccggacccatgtcgtacgccagtgcagccacacggccagcttcgaggtgctcatggacgtctccagaccaagagcagtgatgaccttttagctggaatggccagaggggtaacggtgactaatggtgttaaagggaaggaaagctcctgcccatctgcagcaccttcggcatctgcccctgccatgaccactgtggagaacaaatccaagattagcacagggcaccaactggacagaggcctccggtcagcctcactctgactgcaaccccctctcactggacagcatcacctggacacagagcctcacctagtctgtgtcccatggacacaactttgctttggacagtgacaccaagaatactcacccctttacttagccagaccacaggcagccacctggacacaaacatctctccagagtcagcctccacacagactccacagcagaactcccagggaggcactggggcatggcttcagagcaccaggcagcgctccgcggtgcctagcacccgctcagccagggcagcctgcagcggagcttggagccagcagcttctcatctcttggcctcgggaaatgtagctggagtcatcatttagcagagcacggtgtccctgggttggccacccagcttagttttaaaataaaataatgtaatcttggcctaatggtggaatttctgactgctagatgttctccttccatctgaccaggggattcagacacaatgtataggatgagggtgggggcccttctccctctgagaggaacctggagaggcccgggttctgctgaggtaggagagggtcactcagagggctcccacggaacagacaggcacactgaggcctcagtgggattagggcaggaaatgcccctcttgcaatgggggaccacgccgggtcacgcacccaccccctccaggctacattaggctaaggtcactctgtgcattatttcattatttcacatggagggtcgcccacggttgacagaaccacaggctgagccccaggcccatcagagcgcagtgcacaac

SEQ ID NO: 1946 - DNA, 4293 bp, Homo sapiens; identical to SEQ ID NO: 1945

SEQ ID NO: 1947 - DNA, 4293 bp, Homo sapiens; identical to SEQ ID NO: 1945

SEQ ID NO: 1948 - DNA, 6946 bp, Homo sapiens
ttttgcattccctgaaacaaacgacactatggtgtattttcttttggggggcagtaaataaaagtcttttatgttgacaatgataatattatattctacaatctatttgcatttctctatcctgtggattttattgcttagtataaatccccaggctgaggtgcattaagcttcactcagagagaaacaatgcattttatcatagggccggacagctatatgcacaagatgctacctgcagagattggtttttgcccagatgtgcaggagagatgcacagagaggaagaaatgcatacatgtgtgcaggttttggcgtgtgcacaagaagcctggaaggattttctttggatctacagtcaaaatggatttccgagaggaagctgtctgaaaacacacctcttccctgtgctacatacggtcccatctctgccagccaggttgtcaggaaagtgatcagcactggcttcaactctggctagagctctttggccaatgtgatgggcagaaaactggaatgaggacagaaaagcacctcagaggtttgaagagtctagtctctcaccaccttgctgtaggttttctgaatacttctgagtttaggagcattttttctcaacaggcaagtcaggagctgctaagataaaccatggcagtaagctcgagccagtgttcgtatttgccattgatcggccaccaagtgcttgctatgtgccatgcattgtgctaagcactatctcatttaatatttacagcaatcttatgaggtagatgctactgttatctccattttacagatggggaaactgaggcacagagttccacagctggtaacttgaggaataggaattcaaccactggagagtctggctggagttttttgtggtaggagaaaatatgctgtctaaatttgccttgggaaaccatcatggtggtcacaaaaccacttctacggcttgccttgacctagcaggaatgaagatgtaaagaaagaatgagcgcgtcatggttatgatgggatgatgatgtctgttgtgttgtttggtgtcagtttctgtaacgcctttctatttcaatcaaggctattatcttttcctctgttttagtgaagtttccttgaagtagaaaatgggagtgtattgggcatctcagagttttcagctgaactgaagggtctgatggtaactttacccccaaatctctgagagaaaagcagggagtccctgcttcagctctgctcagaagagcctccctcacatggtggtttctgtgtcactagactggttaaccaaatggttcttctaaatacccaacttttaatagaaactcctgcggcttggattattaaagtcctaacatgcttatttaatcgtgtttcaagtccatctatcttttttgagtctaaggaagactcactaggtcagaaggagtagagggaagaggattaatacatgattttctttttcccctttttcttttaacttaggctgagacttatttgaatgcctgtttcatatggagcttttaagtgtaacagttgtgagtgaaattgccccttttcaaggtaattgaattccatttttcactttccatttccctctagaaaaatcaaaacgttttcagagcttggcttcttagtgggtgattttctaaggtgggaactttagaaccataaaacattctagtgtggcaaaggcattcaggaaccggatgaccaggccccttctccgcaggtgaacagcctccaccagccggtcttggagaacatattgatttcactgtgtttttatttgaaacaccaaaggaatgcccatatcttgtccttgggccagggctgtgggttaggggagctgggtttctgtccagaatcttgtcatctgtagggcagctgaggggcattattacccagaggtccctggaaacctgtgctaaattggtttggatcagtgtccgtgaaaatgttggacaaaggagagtcgattttagctgacacctggacacgactttaaataacactgtatcacggagcaacacaatgtcctcccaactctttttcggtctttccgattatgttagggacaaagtctcagtttggtgctgttgtggtcgaactatcttctcatctctgttttttaaagtcaggcagatcaagccttactcctagggctttagaaggtaatagtttctgatttggatttaatcacattgttttatttcctttttaacatttttatgacaacttttgctttatagcagttttaaaggtaggaaaaaattttcgtttgaaaacaagttggtttgagatgtttttcactcttacataaaagacccaccttcacagcgtatgagcttctaaagttggggaagcagtggcttaggtgggcaggcaggaaattcaagcaggttggtttctgccaaagtcagagatgattgccacttactggaaggctgtgttggaacagagtgggcacaggcattgggagcagagctgatttccaatcttcctgctgccctcgctgcctgtgtgtgccgtggccttcttgagctttagttttctcacctgtggaacaggtttcatgagcagttggaaggaagcaaatgagcttcattttctacaacagggtgggtggtgtagttgatattcaccccaaaggtgcaggatccccacttctgtttattgccagcgctccgagtttgcttctgcatggaaggggaagatggactagagctgatacctcctgcaccctggtgaagaaatgcaccctgaggccagaaaatagtacaaacccatctggctgcaacagtccagcagcatgaagatcaaagtcacgtagtagagccagagagaaatttgccctgggcctaatattcatgaagcctttccaattcagactcggtattattgccaagtcggtgtgtttgggagaaatcagaagccaacacactagaaaagttgcaagagattcctaggggaacccacaaattcagttccttgccagaaacctgctcctccagatgaatctagtgcatcagatgggctcagaagcacaggtggcgcaggcagacctctactgagaagaacaacagtggaaggcagatgaaactcacattttggagtctgagagccatgcgggcccaccccagttacgtctacccctggtcggtgaccagagaatcctttagcagcaacagcagtgatgtttatttcactggtatgtataaagcgactgattgaaaacaagctgtatgcccaacaacttggaactggttaaatgatttttggttcagccgcacagtggaatatcatgcggccattaagaataaataaaaaatcctatactttccatgttcaactttagactgcaaacaactgaaaaaacaccttcataattaggcttcctcagattagaacgtgaagtcaaatcaacgtgtgtcagaaagttaacaacagctaactgtttgttgtggtgttctgagtaacttgtattatttttcagtttttttcccattcctaatgtgcaaatgtactatttttattgtaaaaaaaaatacatgtttgtaaagagcaataacataaatctctgcataggcaaattgaaaggaaatcagacaaaatgataccttttggtagtggaattctaaatcatttttttcttcattagagtttctgaattttctgcatttgatatgtttacctttataaagggtcaatcatatttaagatgattttttaaaagacaagtggacagggaaagagaggtctgctgttgcaaaaccaaagctggaggctctccgaagcccacttatgttagtcaattgatatttcatgaaactctagaatgtgcaaatcactttccacggggattgggggggtgagaaatacagagatgaaggagatgcaaacactttaatcaaagaaatccgtctggttgggaagagaaggttctgcattatataagttgcaaggtcttatccaagaggttagtctgtcaagagtaatagcaataattacacaacaatatgtcagagaggctgggagctccagcttcaaagccaccttgcctggggagaaacttaaccatattgggcctgagcctcagttacctacctcttctgtaaatgtaaactacctcttggggtccttgtgaggattaaatgaaacttgagcctaaaggggctgagctaggtgctttgcaaataacccaaccttagcatgaggcacgttatcatcattacggctgtggtgtttgtggtcacctatctgcaagtcacgctttcatagatatggctgagctgggatttgaacccacattgatctaattccaaagccaatgattccaccccaaccagacactgcatttactctctatgcctaactgaaatttgttctaaacctcaccctaaggtcttgccagaaagaaaagctaaattttcattaaaagatgaaaggagaaatgaatctgtttcaaaggacatgagaggaagaaggaaatatcccttcatgaaggattttgcaactttgtccatgcttctgcagggtgtaaaagtaaaaatcctatacttcccatattcaacgttagattttaaacaactgaacaagcactttcacaattagccttcctcagattggaatgcgaagtcaagccaacgtgtacctcttactgcagaagatttctgcactgtgaatgtgataggatttgcctccttaaccagagggtgctggtttttcctggctggagggtagaaggtcatgaatagaggacaaagcacagggaaggggcagcatgtcgggaagagccccaaggatctcagtatgaaaataaagaggtgtgagccaactgcccataggtttgggctatgagtctggggaaactgtttcaaaatcaatggaggcccaaaggcagagggaaaattctgtgtatggacttccatgtcattcagaaatgttaactccttgaaaagagttaatatatttttttcttttttaaacatttcaataggtttttggggaacaggtggtgtttggttccgtgggtaagttctttagtggtgatttctgagattttggtgcacccatcacctgagcagtgtacattctacccattgtgtagtcttttatctttcactcccctcccacttagaataatgttctccaattccatccaggttgctgcgaaggacattatttcattcctttttatggctgagttgcattccatggtgtatatatatataccacaatgtctgtatccactcattgattgatgggtatgcaggctggttccatacttttccaattgcgaattgtgctgctataaacatccatgagcaagtatctttttggtataatgatatgttttcctctgagtggatacccagtagtgggattgctggatcaaatggtagttctacttttagctccttaagtaatctccacactgtttttcatagtggtggtactagtttacatttccaccggcaatgtaaaagtgtttcttcctgtccctctggtcatctgtttttttaagggatctacctaaactcaaccataacccattccatccacctcatcttgcctcaagctaagaaataggagtgcagagaagaaaacagtacagataagaatgctagaaggttgtgtgtttgaataagaaggaacatggatcaggtttcaagtacagtacctgaggcaggtatgaggtagtagctaatggggtgaggtaggcagaaaaggcttctaaagaagcaggtacttgagttgggtcttcaaggccatagtgagtggtttcccggtggatctgagaaaggaaggtgagtttagagaaagggaagagcccgcagtgaggcatgaaaatgtacactgtgccttcagcgagcttggtgggtggcaatgtctggatccaagtgcgtgtggaggagactttgcacaataaggccactaggcaggtaggacggcccccagagggttttggctgacaagctgagggacatgctataagggtaggggccaggggaagagatggctccctggcagtgggtcccctgtgtgctcggcagctcatggataacagaggataacaggcctgtacctccatattgcccaacatgttatcacatcttcagtttggagagaagaattaaattcgtctaagtttataatttaccagatgactttggataagcacatatttggaacctcagataattcatccattcatttgctcattcagaacagttcttgcgcatcactttatattcagtgctgctgaagtttctttgggggctacacaggttagtaaggcttggttttcatctcaggaaccttatagccagaatgagggagaggtgagtactaactccacagtgttatcccagtcgctactcatttcccttaccaccacgccttcaaacacttcagtgtactttcagctctcaggaaaaatgcaaactttcatctgggcctaagaatctctatatgaactacccctgctcacctccggagaggcatccccttccaccaccctcccctccttcttctctatcctcattgctcctttcaatggtcctgacaggatccctttcagccacaggcccttagcaaatgctgctctcacggcccaagtcatcttccctggttcatgcctacttcggattaaagttacccctccggagagtgttcccgatcaatctgaattgaccaagtccttattacacactctcaaactccatgagatgtccttcatagctctcatcccagttataattagtttgcatttatttacacaatggctgtattaatttctgtattctccaccagaatgagagcttcatgagagccaggatgtgtgttttctcaaaatctgctttattgtggtctaatttgtgtataataaacacacccatgttaggtgtacccatcaatgaatttttagaaatttattaaaaat

SEQ ID NO: 1949 - DNA, 6946 bp, Homo sapiens; identical to SEQ ID NO: 1948

SEQ ID NO: 1950 - DNA, 1412 bp, Homo sapiens
gtttcactgcgttagccaggatggtctcgatcttccgacctcatgatccgcccgcctcggcctcccaaagggctggaattacaggcgtgagccaccacgcccggcccaggatgtgtaactctttactgaaaagtcttgccaccacatctgcctcatcctctctaatccaaccttcaggaaattgtattgaaacaaaaatagagaaaaatactgaaatagatacaatgtttttaaaacaagcaaattttattaaaggaaaattttgcaggtttaaggtttgcaggtgaaattttgtaggtgaaaaggtttacttttcaccagtctgttctggcatgcttctaatgatgtcagagtcacctaaaaaataaaaataaaaaaacagtaattttacaattcatttaatagcaactggtaccataaaatttctctacctttggttatcccttctgtagacaatggtctgcaaattagcactgactttttgcaaaagttatcacattagctgtactgtcatttttcttaaggttgaccaaagataacctagaatcacagccattatataatcacataaaatgatcatataataaaattggtttatcaccagcatttataaaaccagacctagggaaagaactaggtttggggacacatgcatggtcttaatatagcgaatgtttagcctgtcctgactattacaaaatcagaacagcgagaatattcgcagtattctatgaatcaaagattcacaattggaaaacagaatgatgtagattttttggcacttttttttttctcaagctaattttacatgtctgttctcaagaagcaagaattactttcttctgttttgccagattattctctccttataatttcaccttttaccaaatctatgtcattatttcataggtacttcatcaaatgaaattcattatctgacagtaaaaattttaacttataataaagccaattataatgtattggcattcattaccaattctctacaaaatacaactacacgatatgccttgctagatccatattctatctgaatttaggaaccaaagacatttgcgtagtaagaaatacttgtccagacattacattagaaaggcaaaaaaaaaaaagactttatgatttaaaaagcatacctggatcaatgatagccagtgtgcacactctgtagtattttccgcatgctgtgcccagttcaatattattgccactgtagtgatggacaccagttttagccaacatagcatagtactctatttcagatttcctttgggaaccaaaatgggcaaataaataaatgcgataccaagtgactgacagactaaatgttactacttcttttactagtgttaatgttgttaaggccttcaaaaagtaacaaaatcacatattactct

SEQ ID NO: 1951 - DNA, 1412 bp, Homo sapiens; identical to SEQ ID NO: 1950

SEQ ID NO: 1952 - DNA, 1412 bp, Homo sapiens; identical to SEQ ID NO: 1950

SEQ ID NO: 1953 - DNA, 1412 bp, Homo sapiens; identical to SEQ ID NO: 1950

SEQ ID NO: 1954 - DNA, 713 bp, Homo sapiens
taggaccagctcatatgttgcgttatctgtatctgttggggtaacttgcatgcgtgttagaatcggaggctgtcagtttgcagtcagcaacctgggtctgctgggcacaatgcaggtgtgtgttcctccctgggcccccaagtaacgagcatgcggcaaggctgttacaaaggcgtttagtttattctcatcagtatcactgatattctcatggttcacatttgccaacgccgctcctctccttacagtagttaaatgtgcaatctcacttgggggcccagggaggggtgggggttggggaggcagatgagaggcagggaggacgagggccagaaacacaaacaaggatgtggatgtggatggtgaaatgacaccctgcatagggggatggggagttaaaaaagaaaaaaaactgccttcacatgaaaatctaaaacaacaacaaaaaaccacccactctgggcgagaacaaaaagagaggaatggtaaaagagaaaattctgcaaacaactgctaacaatggaagtggacccggccctgccctgccctgcccagcccccaggagctgggcccagccaaccagccaaggcctgggacacccttaaactatagccctgttggggaaggtgaacaggggagggggacccacaggacccacaggagcctaggcagcagctgggactggagtcctactgcctcttgtatcttcattt

SEQ ID NO: 1955 - DNA, 713 bp, Homo sapiens; identical to SEQ ID NO: 1954

SEQ ID NO: 1956 - DNA, 713 bp, Homo sapiens; identical to SEQ ID NO: 1954

SEQ ID NO: 1957 - DNA, 713 bp, Homo sapiens; identical to SEQ ID NO: 1954

SEQ ID NO: 1958 - DNA, 713 bp, Homo sapiens; identical to SEQ ID NO: 1954

SEQ ID NO: 1959 - DNA, 713 bp, Homo sapiens; identical to SEQ ID NO: 1954

SEQ ID NO: 1960 - DNA, 713 bp, Homo sapiens; identical to SEQ ID NO: 1954

SEQ ID NO: 1961 - DNA, 2410 bp, Homo sapiens
tcctaataaaaaaatccaaaactggagaaaacgggtagcttcttaacaagacattcattaacaagagaagacatttccatccctataactatagataactccaaatatccaggttaaattaaccacaacttgggcttgcttcctcttccttagggcaaaaagctgcttcaagttttattcttcttataatacttttaattttcttgagaggttaagcaaaataccgtatagctaagaatatattagtaaaacagctacacggtagttcagacagagatgaccctcaacgctacaagaatgtaataacatccacaactactttcaaagtccagtttaacatccaagggaggatgacaggtcttccttactcagaccctgtcggtctaagaggcagcattttcctaccttagctgctttgcaagtgcctaattccttcgctatggccgtggagaacagtctcaatgccgttctcgaagactcacgtttatctttgcaccaattacttaacgacctaggttgtccgaggaagaaaggaagtgcccagagaaactggagcttaggactgcgctgtcttgacaacctcacggtccctcctccagccgcccccggagcaccgcggggccacagccccagacgccacggtaccggctccaggacgtaaacactgcccttctcttccctgcccgcccgcaacttccttctcccgaccacggctttgcgggagcccactggaaaagggaggataccacataccctcggaagtgaggcgggagaagggcttaagcagctccgcgaagctgaggtgattgagacgagtgagccgctcggcttcgtcgctgcacagcgcagcgacacaggggacgaaggagtccgggattagctcctgcactgattgtacacactgggccatcgccgcagcacaggcagcggcggcgcccgccctccggcccaccctgcgaggttatcctgcggctgcagcagctaccgccgccgcccgccggcctggcccggccgggcggggccccgaacgcactggagcctagaaacaagaaggaacagacgccgccgcttcggtttctggggcacaatccactgaccccccccttcccgtcaccgccgcttctcagcgctcgtccccgcgtgctcgcattccaccccgataggtggagacgccgacagtcaccacttagtccttcggacggcaaaaccttggtcactgcccggccggaaccgccatgttgaggccgaaccctgaccaaccggcagtactactcccagctgcccccgcgcgcgtccctcacgtgactgtgttaaaggagacggtaggggcaagggaagagagctgaggagagggaagtgaaaaacgacggaggccggttgggaggctggagccggaagtgttgtgacggaagctccctgggcggggcggggctacaagtgcggtgggcgggggcgggggcgggggcgggggcggggggaggtgcacaactgtaggccgggttctcaagctcgcccttagcagagcagagctgagagccacctactagcggcaggtggagcctcgagacgggtgctgtcgtggtgatggaggcgcacgctcgcttcccacgcagtttggcctttttgacgtccctggctgttgtgggcaaccgatttggttggtcgcgctgcttcctacgctcgccggcggagcagctagtggcacctgctcggagagagggagtggatctctcggaagtgcttggggtttcgctgaagcggacctgaacagaccatgtgtcctttaaatacagccatgcttttagaaacggactgtcactttatgtggactcaaccattgaacagaatgtgtgcttttgtgagtgctgcaattccttcaagtgtaattgcgctactgcatttttgttggtcgcagggaaggggtgtgcctgcaaatgtccgcgtggttcgtcctcagcctcttcctttttacactgtgctaggatgtttacttgcttgtggtggaggtaggggaagccagtatttgtgtactgtgtactgtcctgaaccggctttcattcctaacttttcaaagattgctttaaaggggggggggcgcgggtcaaatattgttttaaagggggggacggggtgaggtcaatggtgtgtgccttgtaagtagaaatgaatgaaaggaattttactaatgtgtcactcaattgtttgagctccttctgttttgcatgccaaaaatataaggcaaggaaaaatgtatcattctatcatgattttatggtgctctaattaaaggtgtcttccccaacgtcaatgtctcaaatttttcgacttcttgacaccctcaggttttcactaaggtaataatttatgacaagtaagatgtgtgcttctcatgtaagttgataaatgggag

SEQ ID NO: 1962 - DNA, 2410 bp, Homo sapiens; identical to SEQ ID NO: 1961

SEQ ID NO: 1963 - DNA, 2410 bp, Homo sapiens; identical to SEQ ID NO: 1961

SEQ ID NO: 1964 - DNA, 2410 bp, Homo sapiens; identical to SEQ ID NO: 1961

SEQ ID NO: 1965 - DNA, 17500 bp, Homo sapiens
cttcacaggatgccatcttcagcgtagaagaacctgcagaaatcctgctcataccagttctgtcttgtgaggagtcactagccctaaatgcttatttggggaggtaactgggagaaaagctcgttccatgccagctttagaaaaatctgggaagatactctgtagccgtgcaaacttctaaaaagaaatgaaagaaatgtgaagtgaataattggaaaaattcagcagttgtcacctccttttaaactctattcactaagagctggctagacaacccattctggaagctctcatactcactgcctcactcgctccacaagggatttgtaccaaccatttcactggcgtctctaaacttggaccaggagattcactgattgtggccatttcgaccccctactgttaggtctctgtatggaaagtcaatgcccacagaagcaggcattttccaacaagaagctaaagtcattcatgtttaaaacatactgcctggtaactctaattatcttcttatacgcaaataaccctaacatcctaactgtaagctccttgagggcaggaacaatgtcttacacctttttatgccctgtacagtgcctagcataatgccttgaacatagtaggtgctcactggagtctctgattgactggtatctaaaatagaaaccagagagatgagtgcacagccagagaggcaagtaagtgaatagagggacacagtgagtggcaagaaccagtcctggggtagctcctgggtgaagtctgtcctggcccctaggtagccagccctgcctggtggatggagacaaagggggcagatcacttcctagaggggtcagacacacatgtggccctactctcccacaaccatcatcaacacaggtgagcagccatgcagaaagaatctctgagggctttgagccagaacctgcaaccaacagctcatgggcatgtctagggtgcctgagcaccggccagccatcctgcaccccggaagcctcccactgtgcctcactgctctggcttcttgggattaattcttaaggcatgggcagaaataccaaaaatagaaggggagaacccccacgagaaatagtttgaaggcagccaaaggaggctgatctatcccctggcatccctggggcagtggggcccactccctcacccacaggaagagcggggcctctgctctgggatgggggaccctcagcgctgcaacttctagcactgcgcctacagggcctctgctcttgcatagaaccccttgtcatttcccaaacgtccttcctatatcttactttgttttttttttccacaatgctctaaacgtagccactagacaaaagctggaaatatttcagggagcttcctgtaatgattctcccagtctaggggcctcaaaaagtccagggttcaaagaataatctctctcaccattattaaatgattcgcactatctgcaagagatacttggattggtgccctgggtaatcttttaataagagaagatgttttaagaagatacttacacaagtgaaaatgatgagtgttaagtagaaaataaccagagccagcagcaggacaatctccgctctgtatttcttaaaagtctcttctttacgctgtgcagggcatcctttaaaaaagtaagcgacatgtgaagccattttaacaggatttttctaccatgaaaaaaagctaagaatgctttgttccttggtcctggagtcctgcttgtctcctcttcccaccatcaggatgaacgacagtaacagtgacagtgaaggtgacagcagcagccggcgcgcactgtcgctctgtgtctggctgcatgcgactctcacatggcatctttccgaatcttcagaacaggcctgagtagtcccattttacagatgaaagagccgaggctcagagagggtcaaggaccaaggaccaaggcggctgagccagacagctggtccaggcttatcctgcggcctgtctgcctgcacttcggatgtcaagcctttcctggcttattttgtcctcctaccagatgaaccaccacttgttaatccagaaattatcttaacttcatcactgttgggtagactgtggtgtgtcctcacctcaggaggtttcagggactatgaaaggaagcaggggagctgccctgatattgccaaatacgtcaacagatttttctagaatcattcaagctctttcggcaagggtgccagcatggttgggtggaagaacaactccctcagggctgttaaagggtttggtgcagcacgaagggagggtaagagcagcgaggcctttagcccagggacagacatgaagggaggtgcctctccccactcaggtgcaacacccaatgtgctgtttggggaagcaagttgagctttggctatagtgtgcttgcaaacagaatctgcttgatgccccaggcaggagcaggtggagtgcaagtgagcggagggggttctgccattggagccaatggctagatctccagagatgtcaacccctgaaaatggattcgacattttgtgcagcagtcgagggatggattctcacagccgtgggtaatgagagccattgtcctcatggtccctaatatgtattggtcattcagtctatcccgggcactacactcagcattttaacgcaacttctcatttaaccttcacaacaagcctatgttgtagacgttacttccattttagagattagagaactgaggcttagtgtcaatccgtgatttgctcaaggtcacacactaacaaaaggcagagttaatatttgagccagatctaagtgactgtagactctgaccccttaagttgtaggcaatatcgccatggaagaggaaaaggagagaaaatcagctattctcttcattttctctccactccctgcaggacatgcctgccctctccactctcctctgcaaggttcctctcattcaggtgaatattcattgagggcctactatgtgcccagatacatcagagaagaaaacgcagaggttcttgttctcttggggagacagacagtaaatcaatccatacataacatgccagttgtactaagtaccaggaaacaaagaaaccaggatgaagggctggagatccaggagggcctaagggaggtgtgtgcatacaacactaagcaaaaagcacacactgcccccttaaacagggactgtactcttgcaggtgtaataatattacccgaagtccaattcctttcagatccctgacagaaggagaaatcaacggttgtacggaatcaggggctctgtgaccacatttttatcatttccaccctcagcccctaacaagtgttgggcaaaagtcaaacaaaaggcatcatttaagccacagaaagagaaaatggtgacatgcttgcagcggatttccactttcagccacagatgtgatccaaagctctagagctacactccaaaagagaggaacgattttaggacctaaaggaagtacacatgcattgttcaagaagaaaacaagtgcagcaggtcacctcacctgtcactctcaagatcaccttgccacttaggtttctctgcccatccgggtcctgcagagtgcacctgtatgtccccgagttgcagctggtagtgtttcggatcttcagggaatagggcctttcattgggggcgtcgaaagaaccattttgccccttctgatgatagtgctgtcccctgaggtggtcttcctggggtgtctccatcctctcttcaccaccctccaataactgtgaagaaggaatcagagcgcatcacggtccactgcaagcactccaactcgacaccaatgtttccattttgttttcagaagatccagcctcaacttatgtttgtaaaacaagacgtgatgcttttgtgtgtgtgtgacctctgggggaggaaagatctatgaaaattcccaaggctacatcttcggaatatatcaggactacatctcatgattctatcataagtatcccaatttccaccctatattagggagagagagtcactgttgatgacagtgatatgctgtgtgtgaatcttgctggattatattttgtgtctatgtatacatgtatagataggactgttctgtattaaatgttctcttgttttcttcagataccaactcacccactgaatgattcctatttttgtatcccagccttttatttggaaaaattcctaaatctgttatgatccttgccagacaattcaactaaaatcagataagcagatgagcaacgcctcctgcgaacagtcaccttgttcctcaagggctgtgtctctgtgtggtcatgcctgacgtcgccgaatgtgccacaccttttctctgtactatggcagtgagacagctgagaagcatgctttatagagagtgtatgtgtcagatcatttgctgctcatatcaaactccacatggaagggcagtaacagctgacttcactgtactcaggacagaccagccggacttggggagatgcccaatttagccagacattttatctggctggctttctttttttcttttttgagacagggtctcgctctatcacccaggctggagagaactggcttgatcatggctcactgcacccttggcctcctgagtcaaccttctggtactcccacctcagcctctccagtagctaggactagaagcctgtgccaccacacctggctaatttttatttgtttgtttttttagaggcagtgtcttgctctgttgcccaagctggtcttgaactcccagactcaagcgatccgcccgcctcggcctcccaaagttctgggattacaggcgtgagccaccgtgcgcggcttgctttctgtgaattctttgtgatcaaactggtggagtgtccacagcatctcccactgcatagattaggctcataccacattcaccattaattctctctttcctagacatatttttaatttgcctaattaacttgctaagttgctcctccattgaaatactttaaagcttctaaaatgaatgtacacatgcagtaaagcaaatccttgttttcagccttcctgggcagcccttcaacaatgacatcccctagcagcacctgagtttccctttgctggttggctggggaccagcagggagcccaggattaagtgacattccttacctgtccctagcatgataactgcacccaagagccaccttagggaaggagacagagattatcagggcccactgccactgtctttgcttgcacctatcaatgatgaatctcccgttctgggagcaccctacaactcttctctgacttttaggaaggaactcagtgtagggaaagagataaccaaggagttaggggaatactctgagaagcaactcaggaaagaaaatacatacacatgggcacgtgtgcactcgtatacacacacacacacacacacacacacacacagtcatttctgcttcatttattaattcagagcatataccacaaggtcaccggaaagctcaggctccagccctggtgtttgtgagcattcctgtagagtgggctacagagacatctggtggcagattgatcgctcctgcaagaaaacctgctcagctccctcccagccctgagctgagatgaacggctcttctcaggccgagtctgcggacataaatcccatttcttgatggtcctttttgtgtggaaagattccttcctaaataatcaagaatctatgggaggaagctaaaagactggggcccataggtgtgcaaaaataaagcacaaaaaggaggtggggccaaggaaatttagaggaaactaacagtgtccatctgattccagaacacatctaatttagcaccatttttcccttttcaagcctaagtaaaccataaactgaagcctcgtcatgggctcacactgcttgcctctcccttccgctgcctggcagagcggcttcttcctaccaggcaagggctttcaagagaccagagaccgaggcccatccagggccaatctgtgtctaggatggcctgaaaggccagtttgaaataattagctcggcccagtccctgcagtccccattccgatgtccaatcttgcttttctttttctaaattaacctccaaatgcgagtgtagctgcaacaaccgttttgagattattcacccatggttttctcctgggaagctcctctcccatccagcaacccctccctcagctcagaaaggcccatctgaaagtcaagatcaacactgtgaacccctctggagctggtagaaacataaactattgtgtctatttacataaagatggccccattattgtgttagctgctgggaactgttgaagcaaaaaggtgctggtgatcaaaactggctggcagtaacttctgcctatttgcagagaattcattttaaaaatcagcagcaacaccaataaaatttatttgacggttagatttccaagggcctctggcaaaaccgtcagtgggccgctagttatttttaaatggcaaaacaaaggcagggtgagccataagaacagaaggaagaatcaagggagaaggcaaaacaaagaacctcaaagcgacctgcagaattctgatgtgctgccaccagtgggatcatggcaaaatatctcaactctcacagggtcatcttccaaacaccccttttcctaaatgacccagagaactatccgcaaaacctaggaactcttgccaaaccaatgaacagcgctgtttgcctaataactaactacagcaaaaagaattccctgtaaattcatacattgcacctggaaatatttcataaccctccctctaacttccagttttaggtatatacattttcagctaaactttctcttgtgacccccagctgtggaatttggggtttatccacagctgcaaaaggcgtggtagtttttatgttaatgttgcatgctcagaatgggggtggggccctagcaggatcaagggaccgtatgcaaaagctcatatcattatcatcagatacgtggccaggcagctatcaccctgctttatcagatgagctaactgtggcagaggcaccaccaaaaactggagggaaatttcagtgggaggaaaacggagtaacagcaaatgggccatccccactttgctttgttttatgagttctcataaacattggagctcactcaaaatcaaccactggcaagaacagctctttaaacattccaaatctaaaagtgttccattgcttctctgcaaaaccattttaggaaatagtaatttataacaaaaggaaccctcagattcattcacagccaaccataattgacaggaactatttaatgcacgcttcacaatgctaatattgtagtacagtgcgctaaagcacaacacaatttcagcaaattaattactcaaaacactcatcccaatcatgttttaaaaatccacatgttgtacattaacttttatgctgacaactctatcatttttggttgggctggaaaagtgcaaacgtgggacatctcattttcagaaagcctggggactctgacttgtctcaaggcctccaatttgactaaattatttaaataccatattctttctctcaaatggagatttgaccttaaggaaagcacaggccctaaattaaaacaaactctctttcatttgcagaatgctaaatcaagcaaacacaagtactaattgtatgggcacgtgaatggagtcagttttttttttttaatgatgaactaatttgaactaaaacaaaagacataaaataaatcattaattatggctgaaactgaaccaatattaaaacatcctattgtggaaagtgtttttttttaagtttacataattttatccaaatatatgccaacctcctacattaccatatttgaagctaagagggcaatagtttcattttatagcaaaaaaagagttttgatcacaaaattgaaatctaaatttatcatatagcagatttgttaagaatgcagggccaggcacggtggctcatgcctgtaatcccagcactttgggaggctgaggcaggtggatcacatgaggtcaggagttcaagaccagccttgccaacatggtgaaaccacatctccaccacaaatacaaaatattagctgggcgtggtagtggacatctgtaattccagctacttgggaggctgaggcaggagaatcgcttgaacccaggaggcgaaggttgcagtgagccaagattgtgccattgcgctccagcctgggtgacagagcatgactccgtcttaaaaaaaaataaaaaaataaaagcaggggtggggggaatgtgcaataggtacctacctaaaagaaaaaaaaacagtataaaaatttcatctaataatttgataaaacatatttaagggtatagattgtaaggatttaaagttggtattaaattaatctgatgtattccaaccacattgagcagctttttttatcgcatttcttgtgcactaacattcatgtaccttggtttctaactcaattaaagtgccaatataattcccattcatcataaaaacagctctttataatgtgcaaaatagtttggctcagaggttgatgtcataatgagggtagaatgtatgagcattaatatctttttttctatgcgtagttttattagaaaaatgattttctactttgaaatttactgggtctaacagacagagctggatttatggctgttaacagagttatgagtatagcagaggcaacataattaagagcacaggcattggcattggactgagctggaaccaaaccccagccctcccacggctacctctgctcttggccaactgactgaaccactctcaggcttggatagctccactggaatctgggggtgatcacatctcactgagctggcgtgaagatacttatgatgatgtatacagaccctaagcatcatatcgatcacacagaaagccctgaagatgttactactctctctctctccttttttttataaccaaggtttcattctgcatactaaatagttccctgaatataagacgtattgaaaaagtatttactgaatgaatgcgtgaattttagaaagagtgagaaagttacaagagcactagctttggaatcaaaggtctgaagtcaatcccagtttctccatgtgttagctgggtcatcttccatatgtcacttcacctctgagccccatttcgtgatctggagctcccttacttgctcatggggttattataaaatcaagtgagaaaacaagaaaagtgctgtataattggtaatgctggtaatagaaattattcttgtctgtgatagctttccacaccatccacccactctgtcatttccttaccactgacacttcccgtctcctctgggaaagttgtcctagaagtcccaatctctgctctagggagaaactgttttttccacatatgatgtcttcaaaatatccacaacattctgtattttttaaagcaccatcataataatgtatcaaaacccctttggaactgagatttgaaggcaatgttggacccttcattgttcatgccaatcatctctcttctattagcatcccgtggggcctgctggacctggaagaggtaccattacaagctctgagttcatgtcctctgaagaactccacacctaggttctagaggaggcaacttaactcaggcctggtaccccacgatcatggagactggctctgataggcacgtgacccagtcaaagtcccttgagaataatcagacataagttgagatatttgaagagaaacacaaccttctcctttgcacttgcttctggaaggatatacaggttgagcatccctaatccaaaaatctgaaacacttctgctcccaggcatttcagataaaggatgtgcaacttgtccaactctgtagttactggctgtgatctggctgctatgtagaggttggacacagaaccaatgtaaaggaaggcagagttgacagatggaaagtcaccaagtcctggggacattcatgaacctctaagcctagctatattcatttgccagggctgcagagcaccacaaactgggtggctgaaacaatagaaatgtattctctcacagttcaggaggccagaagtccaaaatcaaggtgttgccagggccaagctctctgaaggctttaggggagaatctgttctgtgcctttctcttagcttctagtggttgccagcagtcctcggcgttgcttggcttgtagacacatcactccaatccctgtgtctgtcttcaaatagctttctccctgttgtctgtgtcagtgtgtgttttctcctatcaggacatcattcatactgaagtagggcccaccctagtcaggtagcacctcatctcaatttgattacatttgcaaagactctatttcaaaataaagtcacaatcacaagcatcagaaattagaacttctgatcttttggggggggcacaattcaagccacaacgccatccataactgaaatgtgaactgtattttgatttttcaattttttcccattccaattatatataagccaatatatttccttctctttaggctagttttgattggatttacaatccctcacaactgaaagactcctaatgataaggcaccccgcaccaccatgtaaataaggttggtacgtagggggctattggcacatggctccagcctcgaggccagtcctgctttgtcccctgggcttacatgcctcccactccttggggaatgagacctcaaggcctgatttgaatcagaacctctgttctccagaactgctggtccaaggtgattatgaactgtttatggaaaccagcatccttcttttcctaaaggttttccctatgtggacccataatcctaggcagctaccagctcttctagaatcggtaacctcaattctatcggtaataccgattctaatcggtaaccccgaggactgctggcaaccactggaagctaagaactggaacacttctccaaattgtcccaatttgggatatgcagtagactggtcctccaagaaagcatcaagtgatattaacaagccttgggctcccaagtctgtactagtcccacatgacacacacggaaattttacccaaatacacctcagtgcaaaacaaaacaaaatgaaaaacaaaaacatgcttatgagtataaaagaatcttagggaagtattttctgcccagctctattttgagctaatgattgttgatacaaaatttagggttattccaggagtagccaggaagggattacggaaacatctttagagggaggaaactttttttaggtaatcaatctgcttttagtcttgccctacataaaactttcccttatgtcactgagaccttctccaaacttcctcttctttgtgtagtgacattgccaagtacgtagctaagacaatccagtcctcatgtgactcaggttcccccttttattaatggaaaacaagttggtttttttgtttagcttttttttttttttttttcaatttaactctcagctgctttcttcctccctccccattatcaagctaaaagattttggcaacttgtgctctgttccactattgtccaaaaatctcagtgatccaccattctcatctagatgagacttcttctatagccactcagaggcggcctcattcttccttgcccactcctccgcagaactacatggacaggactggtgaccaagaggaaaagaaggaaaagaatgaagtctccctctgagactcatcttctaagatgaatcatattctatccaacaccaggagaaatatgctttgctttaggcatattttgcattatgccattgtctttgcttaaaatccttcagtgaggccgggcgtggtggcttacgcctgtaatcccagcactttgggaggctgaggcaggtggatcacctgaggtcaggagctcgagaccagcctggccaacatggtgaaaccctgtctctactaaaaatacaaaaaagtagccgggcatggtggtgggcacctgtaatcccagctactcaggaggctaaggcaggggaatcgcttgaaccttggaagagggggttgcagtgagctgagatcacaccacagtattccagcctgggcgacaagagcaaaactctgtctcaaaaaaaaaaaaaacaaaaacaaacaaacaaacaaaaaatccttcaatggctccttactgccaaaaggataaaggtcaagtcattgttgctgggcattcaaggcccctcacaatctgtctctagcctactttctaatgttatctctcagccatatctgctgtttaagtctcccttctacatcactggttacctcaatggttcccaaaaagtcttagtggattcccaggcctttgctcaagatggtcctctggcaaaagttctacattgatcctgagatggccaatgccaggcccaggatggggcacacatttgggacttagaagtatctactaaacaatgaaagtgtaaatatgagagacatctgaaaagcaactttacatctttcatggtttgacctagggaggagcccataaaagtgattcaaccaggtcaagtactataggtgccaatggggacagtacgattttttttttttaattctaacatacattgttttcataattcaatggttctacatttaatgtagaaatgtttcctttttgtcctaaaacatgttcttaaatccaccttacaacagaatcattctggaatcaaggaagcacagtaagtgttcagtactggctccttccatgggctatgaaggtctctggctgtacagattacatctgccccaaccgcttatcaactctaggccctcctaaggcactctgctctcctcagtatccctggttttgtagctcattatcacacaagatggtagagacagaaaacataactccaccaaaaagaagtttagcaacatacacggaagacagccttgaacttttgaagtggcctcacgcaagccattaacctgctctccaacagtttccttagtgttaatgtcagaagcagaacactccatggatggcccatgatctgccccagctggggctcttctcaatattataaagtctatttatagtagacttttatatgaagtcacactcttacttcccttttctcccttcctttggaaatcatctgaaaagggcacttgtcttgtgatgcttcactctcctcacccccgcagcatcacccagagatgacaccatatatcctctttcgttttgcatcacccataggctgtcagggctcctagcatgatacaagaaggcattgcaactctgggataaatgatcactcattactatctttagtgattatcaaccaggcccaaagtactccaaccaaagtcatcctctctctccaaacctacattaaagagagtgtagacacagcgacgcttttcatgaagtccacatgcagccctttaatgcatggctttactcctcacagacatgatattgtgctatgcccttttatgctggaatttaatcacaggtcatggccagtggaagaaaagtcatggatcaaagtctatttgcatattttctcaaaatacctcctcaaagaaccacatctattacaactttttttttttttttttttttttttggtagagacaggtctcactgcattgcccaggctggcctcaaactcctgggctcaagtgatcctcccatcttcgcctcccaaaatgctgggattacaggcataagcctcagccaccacacccagtctattacaactttaaaagataaatcgattggctcatgcctgtaatcctagcactttgggaggctgaagtgggaggatggcttgagctcaggagttggagaccagcctgggcaatgtattgaaatcttgtccctacaaaaaattaaaaacataaaaattagccaggtgtggtggtacgcccttgtagtctcagctacttgggaggctgaggtgggaggattactcgagcccaggaagtcgaggctgcagtgagccatcttcatgccactgtactccagcttgggaaacagggtgacactctgtctcaaaaaataaacataaagctaaattgagctactatcctaatgaatataatgtattaacttttctatttcttctcaatcacccattatgccttaaaaagtataagggaggaagggatgagaagaggaccctttgttggatcccagttaagaggacatggtccatagaagagaagagctgggccaacaggaattgggatatctctgtccacttttggcttcacctttagcctcttgcacatgtgtctattaagtcccctctagcccatctcactgcatctttgaaacagagagaacagaatgaacactcttccttcccaaccctaatgttgcaaacagattggatgctgtctgttttgagttttctggtcaaaggcatatgataaaaaacacatggtttacatgggtccttttgttaattacaagtatcagtgccaaatggacaaaggcaagatgctacatggtgccggaggattgagtggtgaatagaattttaaattgtgagtcattataaccatacttatgatatgcagacagcctgcagaatgtgcttcaatctggtggatggtgaaaacccactgcaagggactctgctttccttgcccagtatgaagccccctcctaagctggcaaaacaggttttacaaagccagggtagtgatgatgaagtgagtaggatgggataagctggttctggttaccaaaatgaaattcctccctttgtggctacccctccactttgatgaaacattttacaagaaacttatagaaaaatgaccagatgcttaacattctgtaaaatgaagtattttggcatttcaccactggccttgtctccagaacactctatccatttttgttgtataagcataatcaatgaaaaagtataattattgggctggaaaataataagtatctacagaacatgctgagagctgttttaaaaaaaatgcttaaaggaacaatatatgtcactttcgaggcacctgattcgtttattggtatagcataactctcctacccacgaatctcaatcaccatttacttctcaaaaaataactacggtatgacttttcattggcactattccatggatcaacaggaaaaaaagaacgcctagagactgctgtccctttttttcttgacagagctttcaaagaccttgggggtaaatctcgcaagaattctgtccaataaacaagctcatgcgttaccgagttacgtcaccagctgacatccaaggagaagtccaaggttaattgctatggtttagtggaccattccaaatgaccctgtgcaagaagctttcactccagaactgtttgaacttcacagcctgaaatttcatctacttgtttcatgagtactttttaattactcccctgggggtattaataatgttttctttattaaatagttactctctggaagggatagtggtttcatgtttttccccgttctttgagataactaagtccctgcctggttagcccaggggcactttgattttctttatcttaagttattaagggagaaaacagagatcaagatagacctctaacaactcaggatttggaatcagactgcttcgttcaaatcccaactccaccatttagctagctgtgcaaaagtggacaagttatttccctccctaaggctcagtttcctcacctgtaaagtaggaatagtaacagtactaatccctaagtccattcttccgatggatggaaatggataatgtatgtaaatatttaccttggagcttggcacgtggtgagcattcaaaaattgtttttacaatatttttaaaaatactattgttttgactatgagaacaatttcggaattgttgtgttctctgatcccacagtaagtaaggtaccaatgaagtaggaatatttaacaccttacttttatacacaatacaatgctctgaggcagcagcaccatccccgtcatgcataactcatgaagtgctgggctgaattcacagagcacctttgcaatttatagggcaaaaattaggtgccgtgaagaatacacagaagtatggatacagccactgccccccagggaactgaccatccagttaggagacacacacacaaagagatcaccgcaatgatgccttgtactgttaagtggccaaagacgtacagtttcttatagtatcttttatggtgggcagaagaacgccctgcattttggggaaagctacaagtgcagagatttgcccccgtggtaagacagcaaatcagtgagagctacagagtaaggttgtaatatcatattcatttgggttaaaatggaggtgctgtggtagcagtggcctgacttaaagaaggaccagtgatatcaaacagtagctgcttggctttggaatgacaccatcattgccatcttagaatctgagaatgtttcagtcaagaggaaaccttgaaaaagcctccttgtcactcagtccacttacagtaggagcagcaaggcctgttcttacacatgcgggctccggctcatgcatccacctgatgctctcaaggctgccagaggaaggaggaggagggctaggggaggaagccaagggtatcccacaaaggagatgaccactgataactaccatggatgaaatggcctaagtcacttctgtgtcttagcctttcctttcaaattgccccctccccctcccatgtatcatgggcatcacagtcacaaaacacaagaaatcagaagtctggagacattccccctgtccaatgcccaaatctaggtccctgttgctttcttcctgacctgctggcccacaaccacaggtggcctccagaattaatccaaatgagagtctctgcccttccaaaacatcttaagtggatcattcatctcaggccaccttcagtgacaggaaggggattgaggtctgcggagagcaaaacctaattcggccctgtacctggatgcggatggggtgggggaggcgcgacgggaggctgggtactccaagttcagctgcgggagacgcccctcgcccccacctggcagccacagagggtcgccagcctaggggagatggttcctgctgtcttcaaatgagcccaccaaaccccagcccgtgggtatcgcagcacctaccttgacccaggagaccgtgtagggaacctgcggatcccagggggcggtgcagggcaagtccacatcttcggagcaagccaccttcacctccggcgtcgcgggagccaggctgtaggctacaagaaagagagagcgcgtcgtgagcaagcgaccgacgggagggggtgtcgtggaggggcggggggcgacaggcgagacaggcgctcgcgagccctaccgcagctcaggagcagaagctggaggccgcgcgacatggctggagcgctgcgccgctgccacga

SEQ ID NO: 1966 - DNA, 5823 bp, Homo sapiens
tttcttctacaaatacaaaaattaactgggcatggtggcaggcgcctgtaatcccagctacttgggagtttgaagcaggagaattgcttggacctgggaggcagagattgcagtgagccaagatcatgccactgcactccagcctgggcaacagggtgagactccatctccaaaataataataataataacaaatgaaaaataaattatgagttcacaccaatattttccactcaaattcaggactgcagagggtctggggtttgtatgtctgttttaatcagttttattaagatacaatttacatacaataaatttacctcttttaaatgtacaaattgatgagtattgacaaatgtataaccatctccacaaaggcaatgtagaaaattttcatcaccccttaaagtccttttacacttttttttgagactgcctcagtagtaaccactgctaaatttatcagagaactgcacacctggattgtattttgacagaacttccttccaacccaattgcttttaataatttttttatgataaatttttacccaaaatgttatagaatttatttacaaagaaatttcgtaagttgtatttctcctactggtgtggtattatgctaaggaaacaggtctggagtcatgaaatccttaggtgtctaatttttctaacctgtaagtttctgtgctactgcagatctcagttactgtctctggtggtgggtgtgtgctgcggaagagtcagaggtaaggcactagtccatttccttccaggacagttgagaaagaaggaaatgaactccagtcatcacaaatccactgttgatgattcctctggccaggtctcccctttaaatccttagggagaagcaacactgagaaaagataacttcttcttttttttttttttttgagacggagccttcctctgtcgcccaggctggagtgcagtggcgcgatctgggctcactgcaagctccgcctcccgggttcacacaattcttctgcctcagcctcccgagtagctgggactacaggtgcccgccacctcgcccggccaatgtttttgaattttttagtagagacggggtttcatcgtgttagccaggatggtcttgatctcctgaccttgtgatccacccgcctcggcctcccaaagtgctgggattacaggcgtgagccaccacgcccggccaaaagacaacttctttagttgtaatcccccatccctgagagtagaagaggcagaaggccaaaaagtcgaccacacatgtttgcagctcctcatcccagcaagatttctgtgctgccctggtgttaccctgcagatgccaccttttcccagttttctactggattattggtctttctcttaatgatttgtaaaagctcataatattatgaaacttcatacaatatctgagacctgggctcaaaatacagtcatgcttcacctaacagtggaggtcactgtttgaacagcatagagtgtactcacacaaacctagatggcatagcctgctacacgcctagggtgtgtgggatagtctattcttcctagggataaacctgtacagcatgctactgaacactaggcaattgtagcacaatggtaagtatttgtgtatctaaatgtgtctaaacatagaaaaggtacagtaaaaacacggtattatagttttttgggaccccattttatatttggtccatgaatgactgaaatgttattatgcaacacatcatggtgttttctccctagttattcttttttttttttttttttttttttttttttttgagatggagtcttgctctgtcgcccaggctggaatgcagtggcgcgatcttggctcactgcaacctccacctcccaggttcaagcaattctcatgcctcagcctccccagtagcagggactacaggtatgtgccaccacaccaactaatttttgtatttttagtagagacggggtttcaccgtgttggacaggctggtctcaaactcccaacctcaggtgatccacctgccccatgggattacagacgtgagccactgcgcccggcccctagttattctttggatttagtttatgatttctaaatgtaatttttaaatgtttcatctaattaaatgatttatctaattaaatttaacaatcctttatgttttctgggttgtgagtcatacctataaaagtcctccccacttcaagattatttttaaatcccctgcatattcttctagctcttctgtgactacatctatcagaattaattttgttgtaaagaatgaggtaggagtccaacttttttaatgtgattctcaagtttttacaatatgttgaataatccatcttttccccattgatttaagatgccatatttatcctatactaagttcctgtacatatttagaactacatctggactttccgttccattgttctacttgttcaatcacatacaaatatgtttgtagagacagggtttcgccaagttgcccaggctagtcttgaactcctgggctcaagcaatccttctgccttggcctcccagggtattgggattataggcgtgagccaccacacccacccctattgttgccattgttctagttgctgtgatagaggaaatgttgggaggtggtgtatctgccacctctgtgtcctgtgtcatatccctgggccttccctctgacccagcagcatctgagggtctactcactttgcactgatagtgtcttgcttcaattgcacaatacacatgttcactttctgtcctggggtgtttgcagtgcctggggtgagacactgaggtaagcctgcttggaatacccacatgctagtctagaagtgggggaggtgtcgctttctggggtgatcctcaaccagtgagcgttggacaccagtggataaatgcctctcactatcaatcctcaagtggacaatactgagaagaggctcttgggctcttcagaagattccagtgggctcatgtccagctgcccaccacagtgctcaactcagcaaaacaccctggtactggtttttcccatggcgcattgggcctgcttcctagggccacctcctacataaatgatgtgcatagaaggccttatttcaggctctgctttcaggtctggtccaggataaaacaagcgaccagaagtccctagaaagcagcctcagggaacaaaattaccccctagggatggatggcaacaaggactcccttgctggtgataggtaggcagtgagaacccttagaacgccacagctccacaattcctaagaccttcccctgccatgtggaatgaggtttagaaagaaatgaggcactagtggacgccagcattccagcacttgaaaggtttggggcaatgctaattatgtggattgtgaagttaattggcttctcttagctgccttagaagatttgcaaggagaaaatgagaggctacggttcagggcaagctgtgaaaccctgatgacagggtttaagccactctcatttatcacagccagctggaaggctgtgctgaaagccaattccaggatctgatcgaaagggtgggccaaccatggaggagatggagtgagcacatctagcagttctgctctgctaacttctgacactgacagggacggggtaggccttgggatgtggacatttgagaataagaaactcccaatgcccgcgagcgctcttgagaaggagaacagcccctcttattagaagacctcacatgaggcaggcgcttcacaatattttttaaattattgtggtaagttatacataacataaaattttttaccattttaaccaattttaggtgtgtaattcaatggtattaaaaacattcattcatattgccgggcgcaatagctcatgcctgtaatcccagcactttgggaggccaaggcaggccaatcatttgaggtcaggagtttgagaccagcctggccaacatggtgaaacctcatctttactaaaaatacaaaaattagctgggcatggtggtgggtgcctgtaatcccagctacttgggaggctgaggcacaagaatcgcttgaacccgggaggcagaggttgcagtgagccgaaatcgtgcccctgcactccagcctgggcaacagagagagactctgtctcaaaaaacaacaacaacaaaactcatattattgtgcaaccatcaccaccttccatcttttttccagaacttttttgtctttccaaactgaaacgctgtatctgttagccagtcactcctcgttgtcccctgcccccatcccccaggaaccaccattctatttgcttcactacattttgcttgtcttctttaagatccatccttgtctcccctatagcttaataaccagggtcgggtctcagtagagcctgacagggtaaaggcagttcctgatgtgagtggcaattgctgagccacacaaagactgcagcatctgcggacgcactcttccaggagccagaggagcccacagcagcgtgggtctgagcgtgctgaggtggtgagcgtggatataagactagatcaggaaatggagggccagctaaatcatgaacatcaatgaatatcaatatctttttttttttttttttttttttttgagatgaagtcttgctcttgtcgcccaggctgtagtgcagtggcacgatcttggctcactgcaacctctgcctcccgggctcaagtgattctcctgcctcagcctcccgagtagctgggactacacacacacaccaccacacctggctaatttttgtatttttagtagagatggggtttttgccatgttggccaggctggtctcgaactcctgacctcaagtaatcacctgcctcagcctcaagtttgctttttgttcatggaaatcagcttcataaaaagcatcttaccctgagatgtagtttgtttctgtaaatttcagaagttgagttcagaatagacatatccagatttataagaatcacaggcttctgaaatataaaagggaaaataatttacttaggatatgtgaccagcaaggctgtttttaaaaatcctatttctagtagctgggtggcctgacagaaccaggtattaactaattttttcctggactgtgttaaataatttattcttgaaaatgttagctgggcataatgcctcatgcctgtaatcccaacactttgggaggccgaggcaggaagattggttgagcccaggagttcaagaccagcttgggcaatatagcaagatacttgtctctatccaaaaaaaaaaaaaaaattagtcagacatggtggtgcacacctgtagtcccagctactcaggaggctaaggtgggacgactgcttcagcccaagaggtagagggtgcagtgagctgagattgtgccactgcactctagcctgggcaacagagtgagagtctcaaaaaaaaggagaaaggcaggaaagaaagaaaagaaagagaaaaagaaagagagagagagagaaagaaaagaaagaaagaagaaagaaagaaagaaagaaagagaaagaaagaaaaagaaaaaataaagagagacagaaagagaaagaaagaaagagagagagggagggagggagagagggaaggaaggaaggaaggaaatgtttgagtagtgatcctgtatcctcctctctgggttttttttctatgacattcccccaccacatctttccctcttcctcaccctccatctcctgatgagatttttttaggagctggggtgctggttgccattggttccttgcagtgtgcctgcattgctcccatccaccccattaacgggctcctgaa

SEQ ID NO: 1967 - DNA, 5823 bp, Homo sapiens; identical to SEQ ID NO: 1966

SEQ ID NO: 1968 - DNA, 5823 bp, Homo sapiens; identical to SEQ ID NO: 1966

SEQ ID NO: 1969 - DNA, 5823 bp, Homo sapiens; identical to SEQ ID NO: 1966

SEQ ID NO: 1970 - DNA, 5823 bp, Homo sapiens; identical to SEQ ID NO: 1966

SEQ ID NO: 1971 - DNA, 4074 bp, Homo sapiens
ttgtcttcactgcacacctgcaagaagtgatttcttggttagctaagtatataactaagactaacccatagcaatcagcgcctttgcacacagcaactcctaaaacattttttgatgaataaacaaatgagtgaataatgaactatgacaagacatctggaaagtttcagggacgtgagggaaaaggtttttgttccagtagactgacttcataccggcacttttacataagaatggcaacaatgatgtcaaacgaaaaaattaattttcatcgagcccagagtccacttttctcttctagtcataactgccattaaaaaaaaaaaatcctttcagcccaactacagttgtcaaccatgttcccaataaatggaggaggtttttctcagaagtgcaggaatgcaagagtctggaaatggaaagggcaagacaggagtctgaggtaacgcgaggagactgagaatctcaatactggggcggacacgcagtaaccacaggaccctgggtcccaatcaggtgctgctgggaggaggcgcgtcagccaggggtggaggaagcagaaaaggctctctcacctctaacgccgcagtggattagagcatctgagaagctctggaaaaaacctctcaggaaaacaacgacttcagcaggacccactagccaaggaaaggggataaaataaatagcaaagggaaggaaaaacacgcacctctgggatgctgcaggtcctgttgcagccgccgccatccctcgaagccaccgttgcttctgccagagctgctactagcgcgcttatcagctccgccaccgcccaagggggaaacttctgcagaaaccccaaccgagcttccgtctaacacaagctccaggccgggcgccgtggctcacgcctgtaatcccagcactttgggagtccgagacgggtggatcacgaagtcaggagttcaagaccagcctcgccaagatgctgaaaccccgtctacgaaaaatacaaaaattagccgggcgtgatggtgggcgcctgtaatcccagctactggggaggctgaggcaggagaatcgcttgaacctgggaggcagaggttgcagtgagccgagatcgcgccactgcaccacagcctgggcgacagagcaagactccttaataaataaataaataaataaaaaataaataaaataagctacttcgagctccgttttccctaggttttatcatggctgccacaggtggccaagccctttcgtctccgtgatgtcactggaggctgcgtggtcttttcagggaacagaggggcctggatggcgcctggattccggcgatcgttgcgctgggaatggaaaagggctgggactcgctggaagtcgttctgaactaatagagctaaaggccttctggttcctggggagacgcgcctggcccccgtgtactattcattcccttcctcataactccacagcccaggctttcttcttagtgggcttcctagaccgaaagtgatctcagggccgctttgtttcccatcccggtcggtcaggccctccgtcagcgccctttgacccatgcagatcggatggggaaagctgccagcgccttccagggatgggggcagaatggggagctggagggagtggtctttttctaactttataccactatcaaactgtgttaattcatgtagctttataataagtcttgaagtcctgtgactttattctcccaagattgctttggcttattctaaggctattgtatttgtaggtgaattttggaattagcttgtcagtttaaaaaaaaaacaaaactgctaggatttgtactgggcttgcgttggatctgtagatctgtttggggaaaactagtatattaacaatactgtccttcaatccattaatatcattatttcccaccatttatttaagtggcctctaatttttcctggtaatattttgtagattgtacacatatttatatcttaatgtttggatccaagttgtgcttggatcgattgcagtatagagatcaaacatatatttcattagatttattcttgagcagtgttttaaatgcgatgttaaatagcattttatttttttatattctcgtttgttgtaagaatatagaaatgctattgatttttacatattgatgttatattcaagcatgttgctaagttcccttattatttgtaagggacaaaaagactacagagtcttttggaatttatgtgattacaatcttccaatctgtgaatagagatggtttaactttcctgtaatctttataccttttagttttgttgctggctagtatgtccactattgaatagaaatagtgataatggacttccttgtcttggttgtaaaatcaagaggaaagcattcaatatcaagtgctttttctgcctttattgaaatgttcatatgtatttttaataataatatgttactgttatataataataattttaaaataatattttaataataatgttacaatgtaaccaattacattggttaattttcaaatgttatctaaatggccaattgtccttccggatccccattgattccgattgggatggcactgtaagagaggcagaaccagtgaaggaaacaaggttttttcaggagttatatacaggggtggtccagtggtggtgggctggcctggagaaatactaccgttcgtattaaaaaaaaaaaagcatgtagtccatatagcatatagcattttcacttagaaccctccttctagcaatctccatttaacccaaaacaaagggcctcgatcacctgtacagcctgtgttccaagggatggggcagggatatggctgtccttcatagataagtagtgaatctcagtgttggctactcccggattccttagcctgggactccaaacacacttagaatagggtaattctcaggtatgctccagttatggctcagccatacaccaaggtgtatacaccaacccctgccatgcaccaatatgcatataaatatgaatagcctctgaaagggcgaattcctagattgacctataggcccacatgaaaagttctatattaatagctatgtcatgactgggtgcagtggctcatacctgtaatcccaacactttgggaggtcgaggtgggtggatcccttgaggccaggagttggagaccagcctgggcaacatgacaaaaccccatctctactaaaaatacaaaaattacctgggcttggtggtgcacacctataatccaagctactaaggaggctgaggcacaggaatcacttgaacctgggaggcagaggttgcagtgagtgagatggcaccactgcactccagcctgggcaacagagtcagactctgtctcaaaaaaaaaaaatagctgtatcatggacattgaaattataatgagataccaaaactaccaccagaatgacttaaattaaaaggatttccaataccaagcattgacaaggatatggagcattttttagagagaatgaccaaggagttggctacagtcaggtgctgcagaatcagatctgtggaccttaatgtgcatctggtgaaataaataactataatggtgatgaagaaagcaattgcccaggaatcctactgtggtctgagataagaagatcatattcctattgccacatccctggaggccatttgtcttttttcaatgactgatcatcctattcagagtgagaggatctggcatggaaacaagaggcctgtcgtaccatggcaactgaaagccactctttcccacttaccattgttttcaagccattaatttcctattaaacttcattttcctcttcctgagagtttcactataaaaatatatgtgtgtatagatatatattcctagcataagagtactataatagtgttttacatagaacttttacaacaattctttgaagtgctttattgttcccatttgacaggtgaggcgatctcaggcacaggaaggctgaatgacatttccaaagtcacctccttgtaagaggcagtgtcagaagctgacaatggacttgaccactatgctgtcgtagcaacagagag

SEQ ID NO: 1972 - DNA, 1675 bp, Homo sapiens
tctttcttctgcttctacctgtatttacctcctattgctaaataatatggttgtacagctattcatcattttccagatttagttattatgcattttctgtgatagaatatggcaacctaggtctcttatacctctcccacacacgtacacatcttctcccttcatttcctgaaaaaaaggttatatcacagtatttcactccagcagcacccccttatctgtgggagttgcattccaagaccctgaatacgaatagcaccaaacccaaatagtaccaaacccgattgctgtcaattggaacacatttctgttcatgtcttccacccacaaatttaataccttttcatcttaactaagtgtttatcacacaccgtggggtgtaataaataatttttgcagcttgtggtgcaacagcaaaactagcacaaatttcttttgccttcttcacaattttacagatggatttgttcttactgtagatcttagcaacttcagcatgtgttttttttctttccttattaagtcaagaactttcacattttctgttagaggaagcactttacagcttctctttggtgtatcttatttgccagcatcactactcttatgctttggggacattagtaagtaaaataagagtgactttaacacaagcactgttataccacaacagttgatctgagcaactggatgatgactaagtgactcatgggtgggtagcatatacattgtggatccactggagaaatctcacaccagcacatgttttaaaacttaagaattatttctggaattttccatttaatattttcagactggctggctgtaactgaactgcagaaagcaaaaccacagataatgggagactattatattcacattatcctctatgtaaatattattcacagctgagccatgtagtgtactgtggttatatttcctctctaatacaaaagtttcttttcctctagcacttaaaaactgtattgcgtttttacttgcttatttttctatgtatttacgactagtttatctcaatctctgcaagagaaatctaaatccctctcaatgtgtatgaatcaattaatttcttctttttctgggagacatctctcctagagtcctttaagagtcctgctccaacatgaatgacttgctttctaagcctgctacacaccaacatcctgggaattctcttcactttctcctgcgttggattccttgtttcccagctactgtgttttcctctatcttggtttaatctcttattttggaggatcttttatactcaaaaggtctctatctactctcacatttatttgttggtgcctttcatgttacggcctttccctcaaatgtattgtgttcattgactacttttcataattaagaatgaggctctgacaggttgaccaaatgctgtgagtggaagggatttgttgcattgtgggcttcatcgtcaggtgagtaatagggcagacacgcagcttttgtgttgaaggatcctcaactatttgtatctgtcagcctttttttcagattatgcagtttccccataggaggatcctccagggtcctgtcttgacagggtttgagtctgtctgtcatcattctggtagctaaataaggaaagggtactgggatttttgtttagtatgatgactgacttagtccc

SEQ ID NO: 1973 - DNA, 1675 bp, Homo sapiens; identical to SEQ ID NO: 1972

SEQ ID NO: 1974 - DNA, 1639 bp, Homo sapiens
cagaaatacatattcacaagttaggcaattacacagttcgtaaaataagtccccaccctatcctcccaccccagcttctccatagaggtaacccctgcccattctttcttctgcttctacctgtatttacctcctattgctaaataatatggttgtacagctattcatcattttccagatttagttattatgcattttctgtgatagaatatggcaacctaggtctcttatacctctcccacacacgtacacatcttctcccttcatttcctgaaaaaaaggttatatcacagtatttcactccagcagcacccccttatctgtgggagttgcattccaagaccctgaatacgaatagcaccaaacccaaatagtaccaaacccgattgctgtcaattggaacacatttctgttcatgtcttccacccacaaatttaataccttttcatcttaactaagtgtttatcacacaccgtggggtgtaataaataatttttgcagcttgtggtgcaacagcaaaactagcacaaatttcttttgccttcttcacaattttacagatggatttgttcttactgtagatcttagcaacttcagcatgtgttttttttctttccttattaagtcaagaactttcacattttctgttagaggaagcactttacagcttctctttggtgtatcttatttgccagcatcactactcttatgctttggggacattagtaagtaaaataagagtgactttaacacaagcactgttataccacaacagttgatctgagcaactggatgatgactaagtgactcatgggtgggtagcatatacattgtggatccactggagaaatctcacaccatcccactttgccctgcccagaacatgggtggagggtgatagtgcgagatttcaacatgctactcaaaacagcacatgttttaaaacttaagaattatttctggaattttccatttaatattttcagactggctggctgtaactgaactgcagaaagcaaaaccacagataatgggagactattatattcacattatcctctatgtaaatattatctctcctagagtcctttaagagtcctgctccaacatgaatgacttgctttctaagcctgctacacaccaacatcctgggaattctcttcactttctcctgcgttggattccttgtttcccagctactgtgttttcctctatcttggtttaatctcttattttggaggatcttttatactcaaaaggtctctatctactctcacatttatttgttggtgcctttcatgttacggcctttccctcaaatgtattgtgttcattgactacttttcataattaagaatgaggctctgacaggttgaccaaatgctgtgagtggaagggatttgttgcattgtgggcttcatcgtcaggtgagtaatagggcagacacgcagcttttgtgttgaaggatcctcaactatttgtatctgtcagcctttttttcagattatgcagtttccccataggaggatcctccagggtcctgtcttgacagggtttgagtctgtctgtcatcattctggtagctaaataaggaaagggtactgggatttttgtttagtatgatgactgacttagtccc

SEQ ID NO: 1975 - DNA, 15239 bp, Homo sapiens
ggaggtgcatggctctgtagacgtggacggtgagctggggaggaaggtggtcttggagagaaatgccccatggggagctgagacctgtgtgtcatgggatcatcctggatttggcttaaaatccacgtggctgtggaaatcccagggtgcaccgaggatctgtgggggagcaggggtctcttaaattaccacggtgccagctacatggcccgggtgggtggttccccacactgcctaccccttcatacctcgccccattacaccctcctggaatcattctcactggaggctgcaccgtttcctgctgcccacgatgaacaaagcaggaaactgtcttttccagacttccccacgaagtgaggttttgacgacctcattctccaagagcaaacccagcccctggagtccgttctttccctgcgcgcgtggacacccctgcagcagtggctccttttggtggccgctcttcagacacgtgctagagagcaatcattgatgacaacgttttctttcaaaaggcccagaaaacaaaattaaatcttgggactcgaagcttcctgggcctgtgccacgaaggcccatgcttagccggtctggtgccaggctctgtgacgtgtggaaaccaggcccaccgaccacacagcagtggctgaggatggctccctcctcggctactctctgaaatggtagaggccactctcatggctgagtggtctccgccgttctgcagaggtgtggataagaacaggagttcctgcttgtctcctaggggtccgtattgaacgttggcaatcagtggaaatcctgtctcaggccctctcggggccccacactgatcattgtatttaaatcctcccagtgtcctgcagacacctacctcccagaccaaagagggaccttgctggtggccaggaaacaagctgaagcacagagaggagagaaagagacagagttgggtcctcgggtcaccttaaaaggctgtgagactttttgccagggcagggcctggcgggtggtggagatgcaggatgaaggacttaaggagggatcttttactttcagtgtgaaagtgacctgtgtttttatgagggggctagagaaatactcagaatctgagagcaggcagttggagtgggatctcagcaaacttccgtgtctgcatggtcctgcaaccatcgccctggacagaggtctcagctgggtagagatggacggttgtcagggcacagcctgtccttagggggtgctaggaatggggattggggtgaagaggagttcaggaaagaggggtgaggcatggggaacctgctggcttagaggatgcaaaggggcaggttttatggacgctttatgcaggtccctttcataaagatacttgcccagcctgagcagaaacccacaccctagagtttgtttcttccctgtgggcaccccccgcccccgcagcagcggcttctttcagtggcagaggctgactctttttgcagcttctccagcacttgcaaatgcaacttccttgcacccacttcagacactttacagctggaaccccttccttcaaggttaggggcccaggcccacagcccctacctccaagtttccacgtttgaagaatcccaaccttttccctttgcctcctcagcctcaggggtgacacctcagagctcctgtttacctctttagccaccaggttagtaattttacacccatgcaagtgtgtacaggaatcttccggatccaagtggctggtgtgggcgttgtcttctgtctgaaccctggcccttgtctgtgcagattcctcccctcctgtccgggagagaagagacagtttcgatgtcatgtggagacaggaggctgtggtcaacgaggggaggctgtggtcaacgaggggaggctgtggtggggggtggcgttctgagtcacttggctggcttgggaatgtgagctgggccaggtgcaccttagagagcctgggtggtgctggggaccttcaggctctggagtcctgggtgaccctgacaggtgcatgtacccacatctccttggcccctgtctctgttgctaatgtccctgcacagaccccccccagccgtcatttacagattcccagcagtgaagcacacgggcttaggttaaaatcactgagccccttgcacagcggccttctggtcccctctgctgtaaggcaggaccacctgtcagcccctgtcttctggggaccccactaggcctaagagatgaggctgtggggttctgtcttctggaggccccactaggcctaagagatgaggccggcggcggaggtctggcctggaagagaaatgtggtgagtcaccccaggcctgacagattcactcagacctggtccttctgctcctaggctgagccatctctcagggaccctcctgccctccttcacctctcacctggcctgccccaaccagttctccaggcaagcccaaaccagttccacctggtttgtgactgtgtttggaaagagggtctttgccgaggtaattaagttaaaatgaggtcatgtgagtgggccctgagccagtctgatgggtgtccttacaggaagacattaggactcccagagggtgactccaggggcaggtggcttggaggactggccgtgcaaggaggcagcaaaggggcggccatctgcaagctgagggcagaggccttggaggaagcagccctgccagtgctggtaactgtgagtgcatctgtctctgttggtcaagccggcagcctggggcattttgctgaggccgccccagccgcctagcatagtcgccaataagtccccgaggttctggtgtgctctctggactagtttcctggggtggctgcaacaaattgccacaaacacagtggtttaaaccacgcaaatgtcgctcccgcagcctgcaggtcggaagtccaaaccaaggtgctggaagggctggttccttccggacccttcaggggagaatctttctgcctctttggcttcttgaggccccttcctggcattgcttctttctccactgactcctaccatcagcgctgagtcctgcctgcctcttataaggtacttctttctccactgactcttaccatcagcgctgagtcctgcctgcctcttataaggcgcttctgggatgactcctggtgcacccaataatccagggtcatctctccagatccaggttcataacccaatcacccccacaaagggaggtcacgtgttcccaagctccagggatcaggaggagggcatctttgggggtgatactatgcagctgaccacagcctctctccacctgggctcccacacccaccctattctgcagatcttcagaggccacctgggatgtcagaagcttccaggaaccaggaggtagctgcatctcctgtcccttccctgagtcaccttgctggactccacagtgtggtgcagacaagaagctgcaggggacaacatggaaggaagcggggatggaggagatggaatgggatgggctctgggcccggccaagcagagcaggatagggctgagagtcatctgagcacaggtggttcaaatggcagagaagctccacgctggagcggggaagagcttgggctttccggccagaaagcgcaggttttggccacggctcttctgccactcactagatgtgggagtttggaggcgttacccgagctctgagccttactttcctcatctgaaaaatgggaataatggtagggttaaattaaaccaaatttggtctgaggatgcctctgcactttgagtccaactgcgaccttagcagcaaatgaactgcaggcctagcttaggagtgtacttttgtaagaaatagccgagtcttagccaatcacagcagctgagcttctataaatcgcaggtggctgctgagtagtccatgttcaaacacggcaaaccaagctgtgaccaatgagctgtctctgcagctcacttccattttctgtctataaacactccctgcccacactgtggagtggagctcagcccttggaacctcttctggtctgagggctgcccacttcatgaatcctttgcttaattaaactcaattcatttcaaatgaaactcaattgattgctagattaatttaaatttaattcgtctaaagttttcttttaacagttcctaccttgttgagttgtcgtgggaatcaagtggaaatttctttttcacatggaaagggcttagcatagcctggcacgtgctgagtgttcagtgcacactggttatgatgatcacagttagtgtctccatctttggtctgttcagcgctacagtgtttgggggccagctaggcagtgctgcagctgcagctctgtgtgtgtgtgtgtgtgtgtgtgtgtgtgtgtgtgtgtgtgtgtggagggggctgtgagattggcgggctcaggagaagatgactactagctgttgccaaagtttcttttctgcaagggaaagccacaagtcactggctccaatgtggacttttaaaaggccttccttcctttctctcttacttctggggagcccatggataggaaatggcactaaactgacttcatctctgtaccctgatgcctccatcgccctcagagtttacgccctcgatgaatcacttagagtgaactgggagctgtgtatgaggtgacgtcaccctgagatagagctctgtggtcactgggaggtggctgtgtgcgttatctccctgtggcatgccaggaggcgtgtgtgtgtgcacgagtgtgtgtgtgcatgcatgtgcatgtgtgtctttgtgtgtgtgcaagtgtgtgtatgtgtgtggataagggagagggagggagggagctgggctgtctccccttccccacaagtggaccctgcagctcagagccggaggtgtgagctgagtttggcgtttgtatgttgcttgagttggaatttgaactcacaggggacaggaaaggatgcctgtccccaggactgactaacgacatcaggcctggctattgaacttcctgctctgcagatcctgggttctgggaggatgaggaaaggatgagcgaaggctgggggatctctggggtgggggtggactcagtgagtggaaagagtaaaggtgttgggggtggactccctgtctgtgtgaccgctggcaaagtccttgacctcggccagtctgcgtttcctgatccaggcagtggggacatggtcctttccctcagaggggtggtgaggattcaatgaactcctttaggtagagcttgctcaggagcatcagctgtaacacctgtcctggaaggttgctaggtgccctcaccctttgttctgtgcccacctctctccaccccctcttcagcccggatccagacgaggcctggggaaagtctcccagaaagcgccctgaccagggcggtgccagctgggttcctgtttgcctaaacccaagcagcaagctcttcaaaggaacctaacaaaccggacagagagctttgtttttttcctcacagcaaaggagacagaaaagtttgctgagtaagtcagacaccattaaactcacaaaaaggctctttgttccggcctgagagggggtgaaaaaaataagcgaagtggtcgaagggcgtgtgtttgcttccgtgttcttggagtgtttgggcagggctcacccagctcactcttcctgctctcccccatctctgagtcctctgcccctggtgatcccacctgttatatcaaaaaattgcaccacggcccagccagaaggaacggctaagggctgttagtccagccagagtttcacttttaaaatgatgctacctagtacttaagttagacgctcccgcagggctttcctgtgctttttcttgttggaagtgatgtgaccgaggctcttgccaaaggtcagttagttgctgtctgagctgggcttgggaccaagcccctcgtacccagcctgttgtcatttactgtcatccctagtgctagctgtggaaaagtctgcttgattctaacccttttgtctctagtacagtgagatctatgctaagatttgtttgtcctcattaaattataaattcttccaggcaggtcactatgtggctggtgcccccctgcagttgtgcagtgtgcaacctgtcagactgaacatggcagccctgcttctggggttaatacaatattattgattcattcttccagcagatggaacaatgcctgtggggggcaattatgcctttgcttctaagactcgtgcttgtaatgcccaaaatccagtgtcactgagcccagctgtgctgagagaaaccagcaagtgggccaaaaagaaaaggtctcctcctcccagacacactggctgctggagaaagcctgtgtgttcttaggtggctgggctaggtgggggcaggctcatgggcaggggaaccagtctcttaggtgggcatttctggggggctctcatggggtggaactaaccagccaggcccagttctctcctttggcagccagagaggggagaatgtcagatgtttgtgccttgactcagcaggtgacgttgtgaacatttatgagcttttcttcctttgggctcatttctttatctgttaaaagcaggcagggcagtgcccagcccgcacctgcccagaaggacagacaaaacataaaagggcggggtgattgtgaaatatcactgggcattgttcatgtcagagctcctggtgcagtgcgatgcccaggactttgtgtgggcagggctggtgctgaagtgcaggagaagactcagctctggctgagcaggcgctgacccacactgctgctctgtaactcacaccgttaacaatggaaagcgttgccttgttgtctgttttgtgcatccatgttttcattccgatttttagtccacatctctggagggcagaaaatctgtcttatgcttctttttccttcaactgcatccttgggagggtggtagatagaagacagacattctttacacaggtgaggcccgcaggaagaaccagggccagtcctcatggtcatcacacacctggagagggaggcttctgtgactttgtgtgtggtgacaacgctgtgctgcttggtcttccgaatggttggacagcctttggcatgtgctctaggacgcccagagctgcaggttggccttgactcctctagccttgccaagtccctcaggtagatcagcccactggtaccttcagccggccggcaccctcctgcccaggtggggccatgcctctgttggctgcactgtctttcaggagggtgtccttggctctggcattctgggctcctagaacagaactgcaatggttttcctcagcctgcgttcctgacttctgtccagcttgtggtctgccttgtggctcccttccctggggaccgtcccctctgtcccccaccaggagggtcatgcctgccacacactgctcctaacaacccgccctgtgatggctctggctggtgacccgcagctgctggccaggctgggctgaacccggatggctgcggatcagcagagcacgcgccccaccgcgttgggcctgctctcggatatgctgctggtggactgactcataactagcgcttcctctcaacaaaaacaaacacccagggagagactcaagggccctccttggctaaacaattcttgagattgagttggaagggaaaacccattacacaaagggctttgcaggggaagaggggagaaggcgagaagccagaacaaacacaagaaggcccaagccacccagggactgggagagggactccggctcaggtgggcgcggccatatccacctttttgggactgagacactgagcacatttgctcactgctttccctccgacagctgttaaagctggtgctttgaacccagccctgggcagggtccttgctggctccgggaacctccattcttgctgggctgaccctttgcacagcgggctagggcagccctgggtgtggggctccagctcacagacagtgtgatcatgaaatgaggaaagtgtgggctttggagtctgtgagacctggctgcaaaggctgctctgctggccctagctttatgggctcaggcaagtgacttaacctcgcagagtctcagtttctttatctgagaaatgggtggtgatgcctacttgggagattgctgtgaggattaaagatgacctatgtacagtgctggaacataggaggcagttactacctagcagctaatcttacttaattaaatatcttcccctctcaaataaaccttctgggtctagcaaagaaagttgagtaagatacaggccttctccactggacacacacagctccttggggaccatctggtgggatctcattcccaggccccaggccagatgctcatcagcacccagtgaggccacagccagccctgattccaggtcactggcccacctctggtcatagtggcctcttctgtcttctcatcatcccacagttaggcaggacctcccatgaaccaatggaaaaatgcccagtagtacagatgccagcatgctgaccagggaacaggcacaggtcaccttgggctcggtgtggagccatcagctggccagggggacctcactgtcctcctggttgcagaggaaggcactgggcttgtgggaagagtcttagagaaaaactttgcaatggggcatggccacaggactgagggccaagcaaagactactgatgagaatttctgtggggggagagtttcatttcaatggaaggaagaacttttatcagtaagaacaaaaacttcactgttgaagaatagattcaagggcaccttcaccttctttgtccctccttgacttggccactggtggtagtgtgtgtgcacatgtacgtgggtgtgtgtgtgttgttcagcttaataaataacacatcaaaatcatgcagtgcagtcaaattcatatgagaaaaaaatttgtttgttctcaagttctgtgaaagtagatatacctgaaccagccaaccactgacctccaactaccaagttctgccaaaagttgtgacactcagaggacaaaccagttaagcagtgtttgtcaaaaaatattccctggacaagacttattcctgtctgggtgtgtccacgttacaaaagcatgtctacaccacattgctacatcgatcttcagaacgtctgagtgaagtaggcaggagggtattgtcttccttttgcagaggaggaaataacttgctcaaggttacatggccagcaagtagcaggcttgggagaaccaggtcttctggctgcttcacaaagcctgatctagaaaaggagggggctgcctcgtgagtcccgtggacccaaactgagatcagatgacagaggatcagatcatggagaccttctggagttcataattgtaccatgaaagcattgtcctgcacgacagtgagagcagaagttggcacaatttttagatgtgtaatttggcaatatgaatcagaaaccataaaggtgactatgggctttgaccaattattttcatttctaggacagtgtcttcaagaaataatcagaaatgggcaccaggttaaaaagttacacatagggttaccgtatgacccagcaattccactcttggtgtaagcccaagaaaatgaaaacatgtgtccacacagaaaaattgtatgtgtttatagcagtactatttatactaactgaaaagtgaaaagaccccaatattcaccactattgaaaaaataaaatatgatctatccatatagtagaatattattctgctgtaaaaaggtatgaagtagtgatatttgctgcaacatggatgacccttgaaaacactgcgctaagtgaaagaagccaggcacaaaagaccacatcctatgactttgtttatataaatccagaataggcaaatttgtaaagctaaaagtagagtagggttgcttaagtttggagtaggaaagttgggaagatgcagattcattgctaatgggtatgatgtttattttagcagaacaaaaatattctaaaattagattgtggtgagggttgtacaacactgaattatttttaaaatgttaaactgtacactttaaatgagtgaattacatggtatgtgacttatatctcaacaattttttttctaaaaaaaaagggcaccaggaagttcttctcatcagttttcataataataaaaaaatttgaaacaatccaagctcataaggaaaagaaataatcaaataattatagtacacccatagttgatgtataaagaaatcaaaaaatataatacataaaaatattttagacaatgagaaaatgctcatgaaatattaaaaattataaaatacaaatgtatgtttagtgtgatttccattttattttaatttttaaaaattaaatgttttatcttttaagaaagaattttaagaaagaatgcagagatcctgtgtatctttcaccaatttccccagatgggagcagtttgcaaaactgtagtacaagacagcaaccaggacattgaccttaatatggtcaagcaacaaaacattttcaccactgcaaggatcacttgtgttgcccttttatagccatgccccctttcttcctgtgccattctcaccttaatcccaggaaacagctaacctattcttcatctctatgattttgttatttcaagattgttataaatggaatcatatagtgtgaaaccttttgggactggcttttttcactctacataattcactaagacccatctaggttgttgcacttatccttagttcgtatttgtttaaaaacctgtacacagcgtgtgtagtagttttatttgtaatagcccaaacctggaagcaatccagaattctccagggaaaccatctgggcctggagatttccttttttaggaggttaaaaattaccaattaaatttctttaatagttacagggctattcaaatcatctactttatatttgatgagttgttatagtttacatttttcaaggaattggtctatttcatctaagttgtcaaaatttacgtggataaagtttttgtggcattccatgagtatccttttgatatctgtagggtctatggtaatatccttgttttatttctgatatttgtaatttatgtctttcctcttttttcctttgtcagtcttactagaagtttaccaattttattgatcttataaaaaaactagttcttgattgattttctctatttttttctgttttcaatttcatggagtttggtttttatttctttatttctgctttctttggatttactttttttttaggttcttgaggtggaagcttagattatttatttgaatttttcctttttctaatatattcatttagtgctatgaattttcccctcagcactgctttagctgagtgccacaaattttgatatgttgaattttcattttcattcagttcaatgtattaaaaaattatctggagacttcctctttgacctctgggttatttagaagtgtgctatttagttttcaagtgttatgagattttcctatcatttctctgttattgatttctagtttgattccatgtgattggagaacacacgctataagatgtgaattcttttgaatatgttgaggtttgttttgtggccctgaatatagtctatcttagtgtatatattttgaagtatgggaaaatgttcatgatatattatataaaaatataaattataaaatgtgtgtatagtgtgattccaattttatgttaactgccctttattttcctccttatcctcttctgaattatctaaagttaagaattctaccttttatgatcagaaagtttttttttttaaatggaaagagcagtgggtagtgtgtcataagatacaagtttaaaaactgggctctcattttctagcaatgtgacccaggcactgcatctcattttatctaattgagcctcatttctaaaatctataaaatggaaataataaaatgcccactttatagagttattgtattaaacaatccaaagccagcatttattaaatgcccaagcagtgtgcacacggtatggtggtgtttctattacagtgaggaagctggactcttttatctcttgggtcccttgcgactatttgcttttaagcctctgtgattctttcactgaggagcagacagaagtctgaaacatattgtgtctgtggacagaactctccataaattgctgttctccagatatttctggaagcctgggagtataattgggatgtaacaaatttggactttttagcaatgttccaatttcaaatgttctgtcctcttgctcccctagtataacagtaatgttttcaccatgcaatttcatttctggttagaaaaatgtggatattaggttaaaagattcacctgaaaggagaagaaaaattcttggttgtctgccataccctttactagaaacctttcccctcttcttaggcctgtgattgttctccaaagcaggtgattgtaatcaagctcccaagaaccaggttatcagtcagttttacagccctaatttctcaatggcaggaaaggagtggggcctgtaagatgagtcaaggagggacagggtttccttggtattacttaattttaaagtccttttccctgcccatgcatgactcccaatccaccgctgggctggcctctagaagaaccgctgtaggagctctcaccctgccagggccacctccggtcttctctctgtgtcttccacccttccttggccagcagacagtcttctggttttagaagtgtcttttcttcctacttgtgtggtattcccttccaaatccaccctatccatgtggatggagtcttcttgaccaagagagccagggtccaagcttttctaaggatattccagaggatactagggtctattcagccaatgaacccttagccctgcttccagactcggtgtactaccatccctctcaaagctccctgttcatccaatgtgtagtatctactgataattcagcatcccgtgccaaccagtcatgccccactctgtgatcttagggtggcggatgcctatttatacattgcccttattttattttacaccctttatcacctgggtctgtgagtttcttgggttcaaggacttttctcatttgtttttgtttattttgatcaaggtaaatatatagcataaaatttaccattttaggtacacaatttggtggcattaagtgtaccatagtctcaatgccttagtctcaacactaagtcacatgaaatcaaactagaactgtcaccaccatccatttccagaatttcatcatcccaaacggtaactgtctacccgtcaaacaacaaccccagctgggcgcagtggctcatgcctgaggtcctagcattttaggaggccgaggtgggcagatcacttgagtccaggagttccagacccgcctgagcaacatggtgaaaccctggctctacaaaaaatacaaaaattagccaggagtggtggtatacgcctgtagtcccagctactggtgacgggggaggcctgggagctgaggtgggaggatggcttgagcctggggaggcggaatctgcagtgagccgagattgcaccattgcactccagcctgggtgacagagtgagatactttctgaaaaacaaaaaaacaaaccaaaacaaaacaaaacaccccaacaaacccatttatttttgcatcttctgtcttctatgtgaggacctttgcctagcacacatccaggcagacatattgtgacattgtccacagacatgagacatactgtgaaggtgcccttgagttgtgcaagacagtggtcaagctcccatcccacttcttaacacatggcgggaccttaaatgttcttaaaattgaaccaaccggaaagcaggatattatgggcacacttttaatccttggctcttggggtaaactgccctcaagaaagaccttgactttcaccctggggagaagatctctctttcatggccttccaaattctgcgatctgtggcattaattctgctcaaattgatttcatttgtctaatattttcagcctaatgagacagtgggctgtgctacgtgaccgaaccagcaactaaagcaacagggccttccccttggggtgtccattccccagggtcgggcgataggaacttccttccaagcgactgaaccagcagctacagcaacagggccttcccctcggggtgtctgtaccctacggtcaggtgataagaacttccttccatgcggctctcgtctttgaaatcatgactttaatggtggtgataagaccacagaaacttttgctacttgaatcctctcaagggcagcttagaaaaagtcaattttgctagagacatggggagacacagaactcctccatatgaaatacatcatccctgttttaggacaaaagagcgggtctgtgggtatgaagtggacggcaccctcctcccttcaagcgcagcccagccctcctctcccctcctctcctgcaaggtgtcggtgattcctccggcttgccctgggctctcccttctcagaccaggcgcctctgtggtcagcattgtgcgtctggttgcttacatgcccctgcttgtttacggtgattgttttgtgtccacagatcctggagaatgagctatttgaggaacaagacttaactttgctatgcatagctcatcgaggacgttccagcagaacttattccctgagtgataaagcatacagggtgtaggtttctgtagaaagtcagacagaaacagatggaactaaagaaaacacagttagaggggtccccaaataactgacttgtgcttgtctctttggcttttgcattatctctgagacgcagaatgtacctggaacattcccctggagggcaggacctgtgaaaacaggagcaggaggagctggcatcagctgtgcttgctcccagttctgcagcctgaagggaaaaggctcctgaagctttcttaccacaggaaggaaaaacaacttgcattaaggctgtgtcccaagatcaaagacattcttaaacaatgaatgagtaccagggaaaaatatgttaggccagagtggaagttgggttgtatttggaaagaagtggcggtaccgagcaaagatggggagagagggtcaggagtagaagaaacaggccgggcacggtggctcacgcgtgtaatctcagcactttgg

SEQ ID NO: 1976 - DNA, 15239 bp, Homo sapiens; identical to SEQ ID NO: 1975

SEQ ID NO: 1977 - DNA, 22412 bp, Homo sapiens
caatggtttgccagcaacttaggccaacggcaacagcggaaaccgagacagctctgcaaaaatatttgtttaattagcagaaacgatctgtgatcagaatccatgtttaacgacctggcttacagccaagctcaacacattttccttcaggactgtttttggtgttgaactgagcaaattcagctctgaccttcatcctggctgggggaggggagacgccccaccctgctcagaccctgggctttttattgaaaggcagtgccaggcacactctgatgggtcttgggggagaccaagggtgccctgctcaatgtcagccctgactctgtgccacgtgcactcagctctgccacggaggtgcatggctctgtagacgtggacggtgagctggggaggaaggtggtcttggagagaaatgccccatggggagctgagacctgtgtgtcatgggatcatcctggatttggcttaaaatccacgtggctgtggaaatcccagggtgcaccgaggatctgtgggggagcaggggtaagtccaggtgaacctcgagctgttctcagccctgaggtttgggtcactccgagagcacttgggtctctgccgaacggcacagatcattctcaggcccttacaaccatccgggtcactctagaattccttttaggactcctgggctgggctgtggctattcaggactctgggtaagagcccttggagtcacctgggaggtagaatcgccattttctagcagccatcttgaatggcagattccctgcagttcaagctggggctgcccaaggggttctggggggtcctgggtgccttccagttgcccctccaggtgcaccccctcctcccccaggacactgaccggcgggggccatcgtgggggaccttgtgctctctggctctggctggctcagccagtgggagcctgtggggctgggagggaggagggtgtgatgaggcatctccttcccgctgggctcctccccacctctttcctccttttccaagtcccctgaccatccctcccctatctctccaggtctcttaaattaccacggtgccagctacatggcccgggtgggtggttccccacactgcctaccccttcatacctcgccccattacaccctcctggaatcattctcactggaggctgcaccgtttcctgctgcccacgatgaacaaagcaggaaactgtcttttccagacttccccacgaagtgaggttttgacgacctcattctccaagagcaaacccagcccctggagtccgttctttccctgcgcgcgtggacacccctgcagcagtggctccttttggtggccgctcttcagacacgtgctagagagcaatcattgatgacaacgttttctttcaaaaggcccagaaaacaaaattaaatcttgggactcgaagcttcctgggcctgtgccacgaaggcccatgcttagccggtctggtgccaggctctgtgacgtgtggaaaccaggcccaccgaccacacagcagtggctgaggatggctccctcctcggctactctctgaaatggtagaggccactctcatggctgagtggtctccgccgttctgcagaggtgtggataagaacaggagttcctgcttgtctcctaggggtccgtattgaacgttggcaatcagtggaaatcctgtctcaggccctctcggggccccacactgatcattgtatttaaatcctcccagtgtcctgcagacacctacctcccagaccaaagagggaccttgctggtggccaggaaacaagctgaagcacagagaggagagaaagagacagagttgggtcctcgggtcaccttaaaaggctgtgagactttttgccagggcagggcctggcgggtggtggagatgcaggatgaaggacttaaggagggatcttttactttcagtgtgaaagtgacctgtgtttttatgagggggctagagaaatactcagaatctgagagcaggcagttggagtgggatctcagcaaacttccgtgtctgcatggtcctgcaaccatcgccctggacagaggtctcagctgggtagagatggacggttgtcagggcacagcctgtccttagggggtgctaggaatggggattggggtgaagaggagttcaggaaagaggggtgaggcatggggaacctgctggcttagaggatgcaaaggggcaggttttatggacgctttatgcaggtccctttcataaagatacttgcccagcctgagcagaaacccacaccctagagtttgtttcttccctgtgggcaccccccgcccccgcagcagcggcttctttcagtggcagaggctgactctttttgcagcttctccagcacttgcaaatgcaacttccttgcacccacttcagacactttacagctggaaccccttccttcaaggttaggggcccaggcccacagcccctacctccaagtttccacgtttgaagaatcccaaccttttccctttgcctcctcagcctcaggggtgacacctcagagctcctgtttacctctttagccaccaggttagtaattttacacccatgcaagtgtgtacaggaatcttccggatccaagtggctggtgtgggcgttgtcttctgtctgaaccctggcccttgtctgtgcagattcctcccctcctgtccgggagagaagagacagtttcgatgtcatgtggagacaggaggctgtggtcaacgaggggaggctgtggtcaacgaggggaggctgtggtggggggtggcgttctgagtcacttggctggcttgggaatgtgagctgggccaggtgcaccttagagagcctgggtggtgctggggaccttcaggctctggagtcctgggtgaccctgacaggtgcatgtacccacatctccttggcccctgtctctgttgctaatgtccctgcacagaccccccccagccgtcatttacagattcccagcagtgaagcacacgggcttaggttaaaatcactgagccccttgcacagcggccttctggtcccctctgctgtaaggcaggaccacctgtcagcccctgtcttctggggaccccactaggcctaagagatgaggctgtggggttctgtcttctggaggccccactaggcctaagagatgaggccggcggcggaggtctggcctggaagagaaatgtggtgagtcaccccaggcctgacagattcactcagacctggtccttctgctcctaggctgagccatctctcagggaccctcctgccctccttcacctctcacctggcctgccccaaccagttctccaggcaagcccaaaccagttccacctggtttgtgactgtgtttggaaagagggtctttgccgaggtaattaagttaaaatgaggtcatgtgagtgggccctgagccagtctgatgggtgtccttacaggaagacattaggactcccagagggtgactccaggggcaggtggcttggaggactggccgtgcaaggaggcagcaaaggggcggccatctgcaagctgagggcagaggccttggaggaagcagccctgccagtgctggtaactcctgcaggtcggaagtccaaaccaaggtgctggaagggctggttccttccggacccttcaggggagaatctttctgcctctttggcttcttgaggccccttcctggcattgcttctttctccactgactcctaccatcagcgctgagtcctgcctgcctcttataagatcttcagaggccacctgggatgtcagaagcttccaggaaccaggaggtagctgcatctcctgtcccttccctgagtcaccttgctggactccacagtgtggtgcagacaagaagctgcaggggacaacatggaaggaagcggggatggaggagatggaatgggatgggctctgggcccggccaagcagagcaggatagggctgagagtcatctgagcacaggtggttcaaatggcagagaagctccacgctggagcggggaagagcttgggctttccggccagaaagcgcaggttttggccacggctcttctgccactcactagatgtgggagtttggaggcgttacccgagctctgagccttactttcctcatctgaaaaatgggaataatggtagggttaaattaaaccaaatttggtctgaggatgcctctgcactttgagtccaactgcgaccttagcagcaaatgaactgcaggcctagcttaggagtgtacttttgtaagaaatagccgagtcttagccaatcacagcagctgagcttctataaatcgcaggtggctgctgagtagtccatgttcaaacacggcaaaccaagctgtgaccaatgagctgtctctgcagctcacttccattttctgtctataaacactccctgcccacactgtggagtggagctcagcccttggaacctcttctggtctgagggctgcccacttcatgaatcctttgcttaattaaactcaattcatttcaaatgaaactcaattgattgctagattaatttaaatttaattcgtctaaagttttcttttaacagttcctaccttgttgagttgtcgtgggaatcaagtggaaatttctttttcacatggaaagggcttagcatagcctggcacgtgctgagtgttcagtgcacactggttatgatgatcacagttagtgtctccatctttggtctgttcagcgctacagtgtttgggggccagctaggcagtgctgcagctgcagctctgtgtgtgtgtgtgtgtgtgtgtgtgtgtgtgtgtgtgtgtgtgtggagggggctgtgagattggcgggctcaggagaagatgactactagctgttgccaaagtttcttttctgcaagggaaagccacaagtcactggctccaatgtggacttttaaaaggccttccttcctttctctcttacttctggggagcccatggataggaaatggcactaaactgacttcatctctgtaccctgatgcctccatcgccctcagagtttacgccctcgatgaatcacttagagtgaactgggagctgtgtatgaggtgacgtcaccctgagatagagctctgtggtcactgggaggtggctgtgtgcgttatctccctgtggcatgccaggaggcgtgtgtgtgtgcacgagtgtgtgtgtgcatgcatgtgcatgtgtgtctttgtgtgtgtgcaagtgtgtgtatgtgtgtggataagggagagggagggagggagctgggctgtctccccttccccacaagtggaccctgcagctcagagccggaggtgtgagctgagtttggcgtttgtatgttgcttgagttggaatttgaactcacaggggacaggaaaggatgcctgtccccaggactgactaacgacatcaggcctggctattgaacttcctgctctgcagatcctgggttctgggaggatgaggaaaggatgagcgaaggctgggggatctctggggtgggggtggactcagtgagtggaaagagtaaaggtgttgggggtggactccctgtctgtgtgaccgctggcaaagtccttgacctcggccagtctgcgtttcctgatccaggcagtggggacatggtcctttccctcagaggggtggtgaggattcaatgaactcctttaggtagagcttgctcaggagcatcagctgtaacacctgtcctggaaggttgctaggtgccctcaccctttgttctgtgcccacctctctccaccccctcttcagcccggatccagacgaggcctggggaaagtctcccagaaagcgccctgaccagggcggtgccagctgggttcctgtttgcctaaacccaagcagcaagctcttcaaaggaacctaacaaaccggacagagagctttgtttttttcctcacagcaaaggagacagaaaagtttgctgagtaagtcagacaccattaaactcacaaaaaggctctttgttccggcctgagagggggtgaaaaaaataagcgaagtggtcgaagggcgtgtgtttgcttccgtgttcttggagtgtttgggcagggctcacccagctcactcttcctgctctcccccatctctgagtcctctgcccctggtgatcccacctgttatatcaaaaaattgcaccacggcccagccagaaggaacggctaagggctgttagtccagccagagtttcacttttaaaatgatgctacctagtacttaagttagacgctcccgcagggctttcctgtgctttttcttgttggaagtgatgtgaccgaggctcttgccaaaggtcagttagttgctgtctgagctgggcttgggaccaagcccctcgtacccagcctgttgtcatttactgtcatccctagtgctagctgtggaaaagtctgcttgattctaacccttttgtctctagtacagtgagatctatgctaagatttgtttgtcctcattaaattataaattcttccaggcaggtcactatgtggctggtgcccccctgcagttgtgcagtgtgcaacctgtcagactgaacatggcagccctgcttctggggttaatacaatattattgattcattcttccagcagatggaacaatgcctgtggggggcaattatgcctttgcttctaagactcgtgcttgtaatgcccaaaatccagtgtcactgagcccagctgtgctgagagaaaccagcaagtgggccaaaaagaaaaggtctcctcctcccagacacactggctgctggagaaagcctgtgtgttcttaggtggctgggctaggtgggggcaggctcatgggcaggggaaccagtctcttaggtgggcatttctggggggctctcatggggtggaactaaccagccaggcccagttctctcctttggcagccagagaggggagaatgtcagatgtttgtgccttgactcagcaggtgacgttgtgaacatttatgagcttttcttcctttgggctcatttctttatctgttaaaagcaggcagggcagtgcccagcccgcacctgcccagaaggacagacaaaacataaaagggcggggtgattgtgaaatatcactgggcattgttcatgtcagagctcctggtgcagtgcgatgcccaggactttgtgtgggcagggctggtgctgaagtgcaggagaagactcagctctggctgagcaggcgctgacccacactgctgctctgtaactcacaccgttaacaatggaaagcgttgccttgttgtctgttttgtgcatccatgttttcattccgatttttagtccacatctctggagggcagaaaatctgtcttatgcttctttttccttcaactgcatccttgggagggtggtagatagaagacagacattctttacacaggtgaggcccgcaggaagaaccagggccagtcctcatggtcatcacacacctggagagggaggcttctgtgactttgtgtgtggtgacaacgctgtgctgcttggtcttccgaatggttggacagcctttggcatgtgctctaggacgcccagagctgcaggttggccttgactcctctagccttgccaagtccctcaggtagatcagcccactggtaccttcagccggccggcaccctcctgcccaggtggggccatgcctctgttggctgcactgtctttcaggagggtgtccttggctctggcattctgggctcctagaacagaactgcaatggttttcctcagcctgcgttcctgacttctgtccagcttgtggtctgccttgtggctcccttccctggggaccgtcccctctgtcccccaccaggagggtcatgcctgccacacactgctcctaacaacccgccctgtgatggctctggctggtgacccgcagctgctggccaggctgggctgaacccggatggctgcggatcagcagagcacgcgccccaccgcgttgggcctgctctcggatatgctgctggtggactgactcataactagcgcttcctctcaacaaaaacaaacacccagggagagactcaagggccctccttggctaaacaattcttgagattgagttggaagggaaaacccattacacaaagggctttgcaggggaagaggggagaaggcgagaagccagaacaaacacaagaaggcccaagccacccagggactgggagagggactccggctcaggtgggcgcggccatatccacctttttgggactgagacactgagcacatttgctcactgctttccctccgacagctgttaaagctggtgctttgaacccagccctgggcagggtccttgctggctccgggaacctccattcttgctgggctgaccctttgcacagcgggctagggcagccctgggtgtggggctccagctcacagacagtgtgatcatgaaatgaggaaagtgtgggctttggagtctgtgagacctggctgcaaaggctgctctgctggccctagctttatgggctcaggcaagtgacttaacctcgcagagtctcagtttctttatctgagaaatgggtggtgatgcctacttgggagattgctgtgaggattaaagatgacctatgtacagtgctggaacataggaggcagttactacctagcagctaatcttacttaattaaatatcttcccctctcaaataaaccttctgggtctagcaaagaaagttgagtaagatacaggccttctccactggacacacacagctccttggggaccatctggtgggatctcattcccaggccccaggccagatgctcatcagcacccagtgaggccacagccagccctgattccaggtcactggcccacctctggtcatagtggcctcttctgtcttctcatcatcccacagttaggcaggacctcccatgaaccaatggaaaaatgcccagtagtacagatgccagcatgctgaccagggaacaggcacaggtcaccttgggctcggtgtggagccatcagctggccagggggacctcactgtcctcctggttgcagaggaaggcactgggcttgtgggaagagtcttagagaaaaactttgcaatggggcatggccacaggactgagggccaagcaaagactactgatgagaatttctgtggggggagagtttcatttcaatggaaggaagaacttttatcagtaagaacaaaaacttcactgttgaagaatagattcaagggcaccttcaccttctttgtccctccttgacttggccactggtggtagtgtgtgtgcacatgtacgtgggtgtgtgtgtgttgttcagcttaataaataacacatcaaaatcatgcagtgcagtcaaattcatatgagaaaaaaatttgtttgttctcaagttctgtgaaagtagatatacctgaaccagccaaccactgacctccaactaccaagttctgccaaaagttgtgacactcagaggacaaaccagttaagcagtgtttgtcaaaaaatattccctggacaagacttattcctgtctgggtgtgtccacgttacaaaagcatgtctacaccacattgctacatcgatcttcagaacgtctgagtgaagtaggcaggagggtattgtcttccttttgcagaggaggaaataacttgctcaaggttacatggccagcaagtagcaggcttgggagaaccaggtcttctggctgcttcacaaagcctgatctagaaaaggagggggctgcctcgtgagtcccgtggacccaaactgagatcagatgacagaggatcagatcatggagaccttctggagttcataattgtaccatgaaagcattgtcctgcacgacagtgagagcagaagttggcacaatttttagatgtgtaatttggcaatatgaatcagaaaccataaaggtgactatgggctttgaccaattattttcatttctaggacagtgtcttcaagaaataatcagaaatgggcaccaggttaaaaagttacacatagggttaccgtatgacccagcaattccactcttggtgtaagcccaagaaaatgaaaacatgtgtccacacagaaaaattgtatgtgtttatagcagtactatttatactaactgaaaagtgaaaagaccccaatattcaccactattgaaaaaataaaatatgatctatccatatagtagaatattattctgctgtaaaaaggtatgaagtagtgatatttgctgcaacatggatgacccttgaaaacactgcgctaagtgaaagaagccaggcacaaaagaccacatcctatgactttgtttatataaatccagaataggcaaatttgtaaagctaaaagtagagtagggttgcttaagtttggagtaggaaagttgggaagatgcagattcattgctaatgggtatgatgtttattttagcagaacaaaaatattctaaaattagattgtggtgagggttgtacaacactgaattatttttaaaatgttaaactgtacactttaaatgagtgaattacatggtatgtgacttatatctcaacaattttttttctaaaaaaaaagggcaccaggaagttcttctcatcagttttcataataataaaaaaatttgaaacaatccaagctcataaggaaaagaaataatcaaataattatagtacacccatagttgatgtataaagaaatcaaaaaatataatacataaaaatattttagacaatgagaaaatgctcatgaaatattaaaaattataaaatacaaatgtatgtttagtgtgatttccattttattttaatttttaaaaattaaatgttttatcttttaagaaagaattttaagaaagaatgcagagatcctgtgtatctttcaccaatttccccagatgggagcagtttgcaaaactgtagtacaagacagcaaccaggacattgaccttaatatggtcaagcaacaaaacattttcaccactgcaaggatcacttgtgttgcccttttatagccatgccccctttcttcctgtgccattctcaccttaatcccaggaaacagctaacctattcttcatctctatgattttgttatttcaagattgttataaatggaatcatatagtgtgaaaccttttgggactggcttttttcactctacataattcactaagacccatctaggttgttgcacttatccttagttcgtatttgtttaaaaacctgtacacagcgtgtgtagtagttttatttgtaatagcccaaacctggaagcaatccagaattctccagggaaaccatctgggcctggagatttccttttttaggaggttaaaaattaccaattaaatttctttaatagttacagggctattcaaatcatctactttatatttgatgagttgttatagtttacatttttcaaggaattggtctatttcatctaagttgtcaaaatttacgtggataaagtttttgtggcattccatgagtatccttttgatatctgtagggtctatggtaatatccttgttttatttctgatatttgtaatttatgtctttcctcttttttcctttgtcagtcttactagaagtttaccaattttattgatcttataaaaaaactagttcttgattgattttctctatttttttctgttttcaatttcatggagtttggtttttatttctttatttctgctttctttggatttactttttttttaggttcttgaggtggaagcttagattatttatttgaatttttcctttttctaatatattcatttagtgctatgaattttcccctcagcactgctttagctgagtgccacaaattttgatatgttgaattttcattttcattcagttcaatgtattaaaaaattatctggagacttcctctttgacctctgggttatttagaagtgtgctatttagttttcaagtgttatgagattttcctatcatttctctgttattgatttctagtttgattccatgtgattggagaacacacgctataagatgtgaattcttttgaatatgttgaggtttgttttgtggccctgaatatagtctatcttagtgtatatattttgaagtatgggaaaatgttcatgatatattatataaaaatataaattataaaatgtgtgtatagtgtgattccaattttatgttaactgccctttattttcctccttatcctcttctgaattatctaaagttaagaattctaccttttatgatcagaaagtttttttttttaaatggaaagagcagtgggtagtgtgtcataagatacaagtttaaaaactgggctctcattttctagcaatgtgacccaggcactgcatctcattttatctaattgagcctcatttctaaaatctataaaatggaaataataaaatgcccactttatagagttattgtattaaacaatccaaagccagcatttattaaatgcccaagcagtgtgcacacggtatggtggtgtttctattacagtgaggaagctggactcttttatctcttgggtcccttgcgactatttgcttttaagcctctgtgattctttcactgaggagcagacagaagtctgaaacatattgtgtctgtggacagaactctccataaattgctgttctccagatatttctggaagcctgggagtataattgggatgtaacaaatttggactttttagcaatgttccaatttcaaatgttctgtcctcttgctcccctagtataacagtaatgttttcaccatgcaatttcatttctggttagaaaaatgtggatattaggttaaaagattcacctgaaaggagaagaaaaattcttggttgtctgccataccctttactagaaacctttcccctcttcttaggcctgtgattgttctccaaagcaggtgattgtaatcaagctcccaagaaccaggttatcagtcagttttacagccctaatttctcaatggcaggaaaggagtggggcctgtaagatgagtcaaggagggacagggtttccttggtattacttaattttaaagtccttttccctgcccatgcatgactcccaatccaccgctgggctggcctctagaagaaccgctgtaggagctctcaccctgccagggccacctccggtcttctctctgtgtcttccacccttccttggccagcagacagtcttctggttttagaagtgtcttttcttcctacttgtgtggtattcccttccaaatccaccctatccatgtggatggagtcttcttgaccaagagagccagggtccaagcttttctaaggatattccagaggatactagggtctattcagccaatgaacccttagccctgcttccagactcggtgtactaccatccctctcaaagctccctgttcatccaatgtgtagtatctactgataattcagcatcccgtgccaaccagtcatgccccactctgtgatcttagggtggcggatgcctatttatacattgcccttattttattttacaccctttatcacctgggtctgtgagtttcttgggttcaaggacttttctcatttgtttttgtttattttgatcaaggtaaatatatagcataaaatttaccattttaggtacacaatttggtggcattaagtgtaccatagtctcaatgccttagtctcaacactaagtcacatgaaatcaaactagaactgtcaccaccatccatttccagaatttcatcatcccaaacggtaactgtctacccgtcaaacaacaaccccagctgggcgcagtggctcatgcctgaggtcctagcattttaggaggccgaggtgggcagatcacttgagtccaggagttccagacccgcctgagcaacatggtgaaaccctggctctacaaaaaatacaaaaattagccaggagtggtggtatacgcctgtagtcccagctactggtgacgggggaggcctgggagctgaggtgggaggatggcttgagcctggggaggcggaatctgcagtgagccgagattgcaccattgcactccagcctgggtgacagagtgagatactttctgaaaaacaaaaaaacaaaccaaaacaaaacaaaacaccccaacaaacccatttatttttgcatcttctgtcttctatgtgaggacctttgcctagcacacatccaggcagacatattgtgacattgtccacagacatgagacatactgtgaaggtgcccttgagttgtgcaagacagtggtcaagctcccatcccacttcttaacacatggcgggaccttaaatgttcttaaaattgaaccaaccggaaagcaggatattatgggcacacttttaatccttggctcttggggtaaactgccctcaagaaagaccttgactttcaccctggggagaagatctctctttcatggccttccaaattctgcgatctgtggcattaattctgctcaaattgatttcatttgtctaatattttcagcctaatgagacagtgggctgtgctacgtgaccgaaccagcaactaaagcaacagggccttccccttggggtgtccattccccagggtcgggcgataggaacttccttccaagcgactgaaccagcagctacagcaacagggccttcccctcggggtgtctgtaccctacggtcaggtgataagaacttccttccatgcggctctcgtctttgaaatcatgactttaatggtggtgataagaccacagaaacttttgctacttgaatcctctcaagggcagcttagaaaaagtcaattttgctagagacatggggagacacagaactcctccatatgaaatacatcatccctgttttaggacaaaagagcgggtctgtgggtatgaagtggacggcaccctcctcccttcaagcgcagcccagccctcctctcccctcctctcctgcaaggtgtcggtgattcctccggcttgccctgggctctcccttctcagaccaggcgcctctgtggtcagcattgtgcgtctggttgcttacatgcccctgcttgtttacggtgattgttttgtgtccacagatcctggagaatgagctatttgaggaacaagacttaactttgctatgcatagctcatcgaggacgttccagcagaacttattccctgagtgataaagcatacagggtgtaggtttctgtagaaagtcagacagaaacagatggaactaaagaaaacacagttagaggggtccccaaataactgacttgtgcttgtctctttggcttttgcattatctctgagacgcagaatgtacctggaacattcccctggagggcaggacctgtgaaaacaggagcaggaggagctggcatcagctgtgcttgctcccagttctgcagcctgaagggaaaaggctcctgaagctttcttaccacaggaaggaaaaacaacttgcattaaggctgtgtcccaagatcaaagacattcttaaacaatgaatgagtaccagggaaaaatatgttaggccagagtggaagttgggttgtatttggaaagaagtggcggtaccgagcaaagatggggagagagggtcaggagtagaagaaacaggccgggcacggtggctcacgcgtgtaatctcagcactttgggaggccgaggcgggtggatcacctgaggtcaggagtttgagactagcctggccaacgtggtgaaaccccatttctactaaaaatacaaaaattagctgggcatggtggtgcatgcctgtaatcccagctactcaggaggctgaggcaggagaatcgctcgaacccgggaagcagaggtttcagtgagccgagattgtgccatagcacttgagcctgggcaacaagagtgaaactctgtctcaaacaaacaaaaaaaggagtagaagaaacagaagacacgaaggcagtagttacggagaaaaagcaaaaacagagagcagcggaaaagagagagggcagagatctggatgtagagagatggtgaaaggaagagagagagggagggtgagtgagaaggaggaggaggacaaaggaaaaagaaaatgggagaggagagcactggcagagcaacctaggctttaaagagcgaagaatggaccaggcgcggtggctcaagcctgtaatcccagcactttgggaggccaaggaggggaggattgcttgagcccaggagtttgagactagcctgggcaacatagtgagaccctgtctgtgcaagaaaaactgtaaaactagctgggtgtggtggcagcggcacacacctgtggtcctagctacttgtggggctgaggcaggaggatcgctagagcctgagagattgaggcttcagtgagccaagattgtgccactgcactccagcccagatgacggagcaagaccctatctcaaaaaaattaaattacattaaattaaaaatttaaaaaagtgaagactggaaaaacaagaatgagatttacaagagaattaaaggcgatgagagttggaaatacaaaatggacagcatgagaagtctggcagagaaaaattcccatgtagggaaattgagttgggccacagagaggaaggcaggaggtcagatggaaacacagaagaaaggatttaggtcaccacatcttttatcggccattataaagaagcctgacttcagtctgtgtttatggctcttgaacacagacccgaggcagcctctagggtgcagcatctgggcaggtgagatgacctttgtcctccacagggaaaatgtggtcaagaatattcaaagggccaggcgcggtggctcacacctgtaatcccagcactttgggaggctgaggtgggcggatcacaaggtcaggagttcaagaccagcctggccaacatggtgaaaccccgtctctactaaaaatacaaaaagtagctgagtgtggtgacacacacctgtaatcccggctacttgggaggctgaggcaggaaaatcgcttgaacccgggaggtgaggttgcagtgagctgagaccatgccactgcactccagcctgggtgacagagcaagactccgtcttgggaaaaaaaaaaaaaaaagaatattcaaagggctggaaatagggtagacattcaccatccctccacctggctatgcagccatcgtgatgaaaacttggcttctgtttcagatcttcttttgtgggacccctccctaggctctgggaggagccccacagagtattcacatagtcatatgtttttgtaaaatttgcaaaactaatgtttcaactgctgtcagccatactatggtcctgaggcagtctgcagtctctcctcgtacatttatatgatctctagaagctccagtgtagacacagcctcaggaatgctcctaccacccacgggcaccgcagcacaagggtcctctggacctgtgaccttattgccatgggatgcatcccacagtgctgggccctagaaggatggtggaagtggaagagacagagatttgaaatgtaggcagccagaggctggaccatggaattctcacaaccatcagacgtaagacagcaagtggaggatgcggttcctatcaaggcctgataatcacagctgaagttctcccctgtcagaaagagccacaataatggtgcttatgcaattacaaatgcatcgtgcaccttttttgtcctctcttggatcccacagccaatattggagtgattttagttccaagatgtgtaccacgcctgtttgtatgttgtattaaacagcctgcctgaaggcaggaggctctcggtgcctggtaaacagcacagggcctggtccacagcagatgctcaacaaataattgtaagactggcgaatgcatgaatgaatgaaatatgcattgaaataaatctctgatttttcattctctaaatgccatccatatatctttgtgttcattacagcaaaagaggccatagcaataaagatagaatcactacttatgggggggccattctcttttcacacctactaccttcccttccagagggctgatgcagggttagaaatgagaatgtgaggccagccgcagtggctcacgcctgtaattccagcactttgggaggccaaggtgggtggatcacctgaggtcaggagttcgagaccagcctagccaacatggcaaaaaccccatctctactaaaaatacaaaaattagccgggcatggtggctggcaccagtaatcccagctactctggaggctgaggcaggagaatcacttgaacctgggaggcagaggctgcagtgagctgagatcatgccactgtattccagctttggtgacagaacaagacctgtctcacacacacacacacgcaaaaaaaaaaaaaaaaaaaaaaaaaaaaaaaagaaagaaagaaagaaaaagaaagaaagaaagaaaagagaatgtggaagggaatagattccagcatcacgctctattttccttgctgaagcctctgtgttctaggttaaataaatctgtttttagccttccttctttggagtttcctgaggtccctgcaggtttttttttttttttttttttttcgtttttttttttttttaacagaaggcttggttattgcaaaacctctttgcatgtttttgttctctttcagtggagactctgtttggcaatagaactaaagtttcctcacaggttttgggttacagatagggtcttactccatccccaagtctcctttgggatcacagttttttaagaattgtgactgtgcagaaccagggcttgcataaggccaccaagactctggattcagaaatggaaaatttccttttaaaattaggtaggggagtttgaaccaggatttttatttggatagcctaattcttggaaatgcagctggtatcccttgggatattccataaaaactttcacgcatagcttcaggcatttacttattccttgtaagtcttgatggagagaggtttccacacaaagtgctgtgatcaggacttcaggaaacacaaagaggcttttttattctgcgcaggccaggttcccacgcaggtgaactgttctgcagtttggtttcgcctgcagacatctccaaatctgtgctatggtgaaattcttcctcaggtcgaatcaaaatcttctctgttgatgtttaagaccacttttttgtttaaggccatttagtttttacaggaaaagaggaacagctctttaccttctgcctaatctccctttctgaattgaaagactgtaatctaatcgctgtgaagtattttctttcccaagcgaaagaatcacaattctctgagcttctgctctttggcgcattgataaccacgggcgggaagagtgttgggcagcgtttagagtctctggcaggctgaccacacactctgggttgttagaagctctttcccgactacatctgtcgtctaggccgggagagttcagggaaaagttctggggcttcaagcctgctgtgcagagggagaaactgaggaccaggtatgagccgagcccagcctggccgacgggtcctgcgggtggcgcaacgtgaggcgtcgcttggtatctggattctctcgagtccacaggcaactggcatcgcttattagtcaccctccattcagtgtgtaacctgacaatatcagcggtgctttccggacaaagaagctaacagaagaaagccaaagttgtgtcatcaggctgggcggaacgaacgcgagcccatcagcaaagagcctgctttgatcttcatcgtgggaggatggagggtctgatgaagccgcgacagtctgcgtctgggtggggcgggccctgccctgggagcgcagtgggacgtgctgccagcgtgcttcccatccacctccttcacacgtgtgacccatgactgtccactgcccctggagttgagcccaggctccgcaggatggcagtgggtgggcctcattgcccagcacgcctatctccccaccgtcctcgccagcatctcctcccagagcacaccaggctgccccatgcatccagtccacacacgcactcaaacggccactaagccaggttccgctttagatcttggctgtgaagacgctagcaagaggagctgatgcttcggtggggagcaaggcggaaaagaaaccctcatgggaatggatcgagagcagggggaagtagctctggccacaggcactggtcccatcttcaaggaggactctgagaagctgacacgtgtcccaagctgagccaccactgggggataagggaggaaccttacccactgtcaggtcgtgcacacctgccattgcttacgatgtcatcactcataggcctctcatcctgcatgggaaattaggccagataacctctatgatgctgtgcaaacctaggcgtctacaagcccaaacgttgatctcagcctgactctcacccagcctcgggccctgcggtaccacgtctgtgctgtcttcatgcccaggttgcatcccaggcggttacaccctgtgcatggctgtgccgcctccaaggatccttcacttcctcagcagaactggggttgggagagcaggggctttcctgggatgctccgctgctcctcggcagggccagactttgaatcccacccacgcatctacggtctggaaagacacaccagaatttgtcaaaagacagtttcccatattcaagggattatttccctccttctccttcctttacccttggatcctctccagaatcaagtggatctgactccctgcatcccccggggagtcactatgaagtcagaattggactcagacaaaggacggctctggaccaagtccccagcagcccttgtggaccttggagcagggagagaggccgtgaatacacctgacccccttacagtggatgcttgggggctgccataacaaagcaccacagatcagatgcttcaaccacaggaaggtctcatccacagtcctggaggctggaagtccaaggtcaaggtgttggcagggtgggttccttccagaggactctggggaggggctgttccaggcctctctcctgggcctgtggacagctgtcttctccctgtgtcgtcacactgtcttccctctgggcatgtgtgtccacgtgtcccaccctgacaaggttatattggctgaaggcccactctcatgacctcgttgtagcttgattatccctgtaaagacttatctccaaataaggtcatgttctgaggtcctggttggtaggacttcaacatatgagtttttggaggcagggggcacaattcaaccatagtagggtcatgtggctttttctgactgcccatcacctgcaccccgagatgtgagtttggatgagaagctgagaagcccaacacctcccagctgctctgcaataatgaatggtgaaggttcgtgtagcactttggctgcagacagatgcgcgtgtgtggagcagggagcggattgggacctcctgtcgcaaagatgtgcccactgcaggattccctcttgttttctgggactgcagcggccccagcacctgcatggggtccagtgctgggccagaggggcagtgagacatcacgtctcacgtggcaagtgggcagtccaccagcactccctctgcagatgcccacacccagacacaaggggtcctgtggctcctggatattcctggcatcgatcaattccttttcttttctctaggtcctctctgcccagacaaattctgcctgacagctgtttcccacttccaggcctttcctaccgagatctctccagcactcaccgcctctgtgagctcagcgcctctcggtttcaggctccttgctctaagaactcctctctggcacagtgggaatagtgtgagctttggggtcggtcaaacccagggtcaaactctgattcactagatgtatggccttggataagttattcaaagtctcaaagtcttcgtcttttcttctctgaaacaggctaaaacaagctactgcactgacttgtttggaggattaaaggagctaatgaaatgcaagacaggtgcctcccgacagtgtgccccagtgaaggctgagcttctatcatggggggccttcagaccagagtcttcaggtgtgcagtaggctataggtgagactggtttggctagtgatgacaggagatgaatttcaccatgggccagcagggccacatgtggtcagtcttcaggaagtcactccctggatgttcagctccccaaggtgtgcagggccacccagttggctctctgaggcctaggcccacctgctattcacccttcagatgttcccctccttatgttccctaagagcctggctcctttcccctcccgggtagttcgcacacactacaagacgtgaaagacctgaagaaggtgtttaggg

SEQ ID NO: 1978 - DNA, 4940 bp, Homo sapiens
cctcctgggttcaagtgattttcctgcctcagcctcccgagtagctgggactataggcatgtgttaccatgcctggctaattttctgtatttttggtagagacagggtctcgctatgttgcccaggctggtcctgaactcctggccttaagcggtccatccacctcggcctcccagagttctgggattacaggcatgagccactgcgcccagtcaccttcccctgttcttcaggtcagggtggaacaaggcctgactgcacctccaaagaagagaagggagtaaatggagagaaaaggcaggggattagagcttggagactcaagcagagctatggagagctgaaagggggagcttaagggtggcaaggaactccagagacatccactactcacaggtgtgtagggagcccaaagctacactagaggaaaccccaagctgcaatccccacccagatcctcccactcaccccaagatggcacagacttacatgcagagaacgaagacagagccttaagtaatagtacttttaataaaattaagttcttaatagcacatttaatacattaaccctcccccttcttggtttctctgcattttgtgcaacatcactttgacttgattattcttgggtctgttttatttcccgcttttattttgcttttgaaatctttttccttggtggatttgtacgtgtcttcactagatgcctcaaattaagtctgaccacaatcctactctactttctacagtggagagaccatcctccctgccccagggctgtctccacccacccccccttccccacccgcaccctcgagtggggaaggggaagccctccccaccccagacgctaccatcccaaactagcggggtttctaggacaaaaagagcagggggaatctgtccctaggtggggcgagaagagtaaattgggtagagggagatgtgtttggggtctagggccagggagggggatggcagagtcattggtgtaatgaagcaggctcctcctgccaaaaggagagccaaggggcccctccaaccccttggataggaggggaaggcccagtgattgcaagctggggttggtagaaggcaagtgctttaaaaatgttgatttctcacacgcagaagccaagccctccagttttgtgtggggagggcaatgtgttcccaggccagggtacagtagatgacccctacctgaacacatatagatggaggtgaactggagcagagggtcagggttagggtcacccaaagtccctgtgcctttccccagcctctgtgcccatggggatgcctttctcccaggccttcaaggacagtgtttccactccactccgtgggaagtccttcttggaatctaacttttatgagacaagaaagcactttgcaagtaggtgaagaacgagtcagctttaaagaacaattactgagattgttactgctactgctgccatggaggtcaaagctaagtggaaagctggatgggaacaggggtaggggactgatcgcctcagtgctcttgaagctctgaaggtgagaagcgtgtgtgcatgtgtgtctgtttgtggaatgacttcccaggctcttaaatcaatctgtagagaagtggaccgaggtcacacttcaagaaggacttcctcagttaggcctgggggaagcaggcatgggagggtttgagctgggagccccaggaggggacataccacattggagtatgggctgcccaggtactaggggtgcaggtgaatgtgcttggcctcctctgctgcccccaacccagcccctgtcttattgagatgatcagtgtgcatcctttccaagaccctgggaaatgaacccctcatttctttgtcctacaatttaaaaatccaaggattctcagaatcaaccccagcagactggaagctcccaatcttaaactagcaacctgatccaaccctggtatctgaagattgggcaactcagggtggactcagccacttccctcctctatttatcttttccttacaacttttatacattctactggacccaggggccctcaatgctactaaactttaagctatcttaatattgtctactaagtaactagtaattgtttctttctctctctaggattatatgaaataaatttgaattattattattaataattattattttgtagtattcttttcttttaaacccctcggtttctctttttcttctctttctctcttgtttttggttaaaaaaaaatctagatctcttaaatctcacacatctctgagggttcctataggcctgctaggccttaattctggattccccctcctcacttgcccctgcgacagggcaggggaaagtggtgggggacaccccaggatcctcagtccttagtcctacagcttcttcctttcttgttaatccctttctttgtttggctctgccggctcccctgagggggagggggagaggggaggaggagtccatggagtgaaatccaatctactggaagggtcccaggagggaccgggttcccccagctcctctctccaccattcacccccgggatgctcccccaagaaaagcaaatgacattcctccccaaaaaaaaagtgggggaaaaaagcaacgtaaacccaaacatatattaaaaacactttttttttttaagatttaactctgaatacaaatgtatttttttcttcttctctccctacatatattctaaaccttctaaagtttttttatttttttaaggatcactttatcataaaataaaatatccttttcatataataaattacctaataaaaagtctttttttttcatattagcccaggttctttgctacatttatatggtaataaacgcctttattaaaatagaatattaaattataaagaactgctttttttttttttttttgctatttttgttttctctcctctgtgttggtcgcctgtctcgctccctctcatgctctctttctctcctctattttgtctctcactattcgtgttttgtgtttgtttctaggtttggctcaattggtaagggtgggattgaatttgctgagccccctagtgtaacagtcttctgcctttgtgggtaaagagtggagagggggagggggacgacagacagacatcccttcttcccacccccctccccacctgccccccggcaaccgagggtgcccatttggtttggtttctattgtacagacatctcaggatggctcacataggcgggaaggagggaagtcgtcacagggcagaagaatgggactctggagctttaagtgctcgggtgatcactcagaacagtcccaccccactatttacaaggatctcctgggactcccatccctccatcctctcttggcccggccagcggaaccaggagggtggagagctggtggcagccccaaatgagcaggagggaagcagcaaagggggtgcaaggcctgtaacaatatgtgattctcagaataggccctgctgcccacctccccccagtcctgctttgccccaggctgacccctctttgaagacctggcttctcctcaaccacatcaggtgggacacagactccatgatttgcatggaggattcaagctaataaggattcaagctaataaggattcaataaaggttcaggtcaggttgagaggggtgcagggagtcgggcactgcatgggaggagcagctcttccctccaccagtctctcctcctgcctcacgccctttcctgctcctttaaatagcagacacactactctggcgcccccacttccacaaccagaaaatccagcccaagaactactccctaaatataatgcccatagtgatgaaggtgggggtttgaccctttaccccagtattagtcccctcctcacattttcactgagaatggggatacattccatcaataatttgagatgtttctttggaggagtgggggagagggcctccagatgcctgaagaggaatggagggaccatccaaatattcctccccctacttctccccagaaggatggtgtccccaaagctgggctggtaggggcaggggcagggggaagggaagaaagacaaagacaaggaacaagacagagctgggagtgacagccaccaaaagaaagcaaagcaaagagctggagggaaaggaaagagttgaggaaagggaagatcccaaaggaagggaagataggcggagagagtgaagggaaacactgcaggggacaggggcagagaggaggactcctctccagattcctctagcccagctttgtggggacagatggcttctgagcctttcagccacagaaacgattgacatgcttctctccccaacccctagaagatctatgcaacttctgataggactccaactcccttacactgctggaaactggtgacagtttcccaaacaggatatgggggtggggtgggaggtaaagggtcatgttaggaggtcggaggtcaggaccagagggcttagggattgcaaagagcacctctagatacaggtggtaattctccctctcccttttacccaccccctcctcggaagaaggggtggagtgacacacagcgggggaggtgggcagagggcgtcagaatgccttagtggccacctctggcaaaacaaaagtttctcttagctgcttccagatttaagggtgtgttgaggtatcagagttgtaactctagtaaaattttcagtctggccccctcccaatctttccaggacagggtgaccagaggctctgaaagtggcgcaccctccagccaccactgcctccctccccccttccccagcgagcgagtatctctaagcaccttgcccctcaaatcaccgctttccaaaaggctttagtggaaaacaggtccagggtgggcccagtggagtgggccccggaggcagaggagaagagcacgga

SEQ ID NO: 1979 - DNA, 4940 bp, Homo sapiens; identical to SEQ ID NO: 1978

SEQ ID NO: 1980 - DNA, 4940 bp, Homo sapiens; identical to SEQ ID NO: 1978

SEQ ID NO: 1981 - DNA, 4940 bp, Homo sapiens; identical to SEQ ID NO: 1978

SEQ ID NO: 1982 - DNA, 4940 bp, Homo sapiens; identical to SEQ ID NO: 1978

SEQ ID NO: 1983 - DNA, 4940 bp, Homo sapiens; identical to SEQ ID NO: 1978

SEQ ID NO: 1984 - DNA, 423 bp, Homo sapiens
atccattttcaaaattctctaggcaaacaacacattcagtacagtgcagcatatcagcaggccaagttaaccaatcaggttccatatcttcattagtgttatatgatccatatgacctccccttcctttcacatgggctggtctgacaatatttattggcacatgaacaagcctcagcatcacagtgacttgctgttcctggagaattgtgaagtacgctttgcttatcttcaaatacttccttctcactactcaaagtgtctgtgttctcactttccgagtcattttcagtatcttgagacccctccgacatttcctcttcagactggactccaagacatttaaatcgccacattgagactatacgtaacatggacctggaaaagcttaaaaatatgaagaggattgaactggctgccatct

SEQ ID NO: 1985 - DNA, 423 bp, Homo sapiens; identical to SEQ ID NO: 1984

SEQ ID NO: 1986 - DNA, 423 bp, Homo sapiens; identical to SEQ ID NO: 1984

SEQ ID NO: 1987 - DNA, 895 bp, Homo sapiens
ctctgcccggccgccatcccatctaggaagcgaggagcgccacttccccgccgccatcccatctaggaagtgaggagcgtctctgcccggccgcccatcgtctgagagctcacaattggatatactggttattttaccaaggctttaactggaatgatatatttttggatatgaccagactgctttgagcaatttaggttgtcttcacagagcaaataaaaagccccttggaaagactggcttggtgcctcatctacatggctcccttacgaggttcctgatgatcttgtgggtagttcaatacactgaatgattgtataagtgggaaaagtggcatcccccttgtccagtttctataagactaccattgaataaaggcctcaatcaaccatccatacctactgcagattcttctagatgctgatgtatgcggaacccagaatttctattcttggcacccatataagtaaattttatttgttctgcattatgttctagttttcttgatatagcactttaaaaaatcattttcatacaaattcatatggtttctgcaaatataaattaactgtctcttgcaactgttttgatatgtaagcaatgacacccaaattcagatttcattgttgtcccttaggggtatcctagtatctgactctagttagggggttagaattagttatactggctatgagacttctgttgaattgacattcttttaggagctgtctcaagtaagagctttctagtatcttcaaacaaaaaaaaggactcacctactcagacagaaagtctattttttaaaggacgcttagagagatttgtggggttcaaggttattatatttataaagatctacccaaatttacccctttgatttcagagtcccattact

SEQ ID NO: 1988 - DNA, 814 bp, Homo sapiens
atttttcaggcaaccttttcatcatttctcatctcttctttcaatgcaccacaagagggcagtgttttatcatattctccttgaattatataataccaacagtggaatgagatgacttccagaagtagaaattgactattatgccaaaactgttcaccaaagttgataaaactctaggtttacaattgtaccccaaggtcatgggactggaccccatcccatagtaagtcatcagtttagcaatgataaagaaaataaccttctgaaaatttgtatagatcagaaataaagtattttttgtggaagactatttttaagtattgaaggtactatttcctttcttgaattcatattgcagatgtacggtgtggatttattggtttatctctgcaaaccttaaagtagaagattgcaagggccaggtgtggtggatcacgcctgtaatcccagcactttgggaggctgaggcaggagaattgctggaacctgggaggcagaggttgcagtgagccgagatcacaccactgcactccagcctgggtaacagagcaagactgcttcaaaaaaaaattttttttaattaaaaaaaaagtagatgactgcagcaaagaagagatttattagctcttcctttcaaggtatctgtgtactgtatataaacaacaaaagctgaccaagagtggtacttgtgctaggcatattagtaactgctttgtaattgaaagcaagaaatatcataaacaagcattagatggctaactaccaaacaagttaagtcccttagggcaggtagattcagtcttttccttctctg

SEQ ID NO: 1989 - DNA, 2299 bp, Homo sapiens
gattctgtcctatgctttgagcaaccctacattgtggtctgaaaaatgtcttcaagtcaaaaactggaataactatagagctcactcagttgtgcactggagactactcataactttctcaagttctgattatatgctccacattcttttcggaaacatgaattggaaacatattcaatcatgttagtgggtgtaccagttcacaatcccaatagaaatgatgtaagaagcaggacacaactccagaggtggggctcagacatggaaccagattgaggacaagttaacacagggcctggtaagaagcagttttctaattagacatgcccaccaatgtgccatgtcaatttatcattccaatggcaacacccagcttttaccgactctttacatggctatgacccaatgacccaagttactaccccttccctagaaaattctgcataaaccacgccttaatctgcatgcaattaaaagtgggtataaatatgactgcaaagctgccctgagctacggtggtctgcctactactgggtagccatgctctgcaggagcagtcatggagctgtaactccatcagactgtaacactgcctcttcaatacaactgttttcttctacatctggcttgcctttgaattctttcctgggcaaggccaagaaccctcacaggctaaactccactttggggctagtttgccctgtatgagaaatgtttgagtccagttcctctacatcctaactcacatttgacactggcattgattttttatgtatttatcgattttgttctgtattgttttgccacttggataggtgtgtatgcctggttcattttgattactgtatgtatggttcattttgggtttctccagtgtctgatgatgttgaacatctttgcatgtgcttacctgccactgggacatcttcttcaatgaaatgtatcttgctgttttttgctcatgtcataattgggttttcttttgagaattctttacatattgtagatactatccatttgtcaaatacatggctagcaaacattttcttcccatatgtagctttgtttcactctttatagagtgaaatatttagatttcaatgaagtccaatttgtcatttttcccttatggttcatgcttttgatgtaaacaataaggattctgtccatcatagattccaagtatttgttctatatttttagctacaagtttcacacttttacattttacatttaatctgtggcttattatgagttaaattttgtataaaatgtgagaggtttgaaggttgagttcttatttattttttacttgccttttttttttatctgtaagtgttcaattgctcgagaaccgttatttgaaaatgttatcttttctgcaatgaattgcctttggaactttgtcaaaaattagttaggggtatgtttgtggatttagtatatttgggctttttgttctcttcaattaagctatgtatctatacctccaccaagactagactatattattactaatagctatatagtactttacgttgagtggggtaattttttctactttattttccattatcaggactggtgtggctattctagtgactgtgactttctgtgtaaatttcaaaatatttttgtcttttgtctacagaaaaaaccccttgctgggattttggtagcacctgcctaaacctatagatcaacttggtagaattaatgtctttactctgccaagtctttcaatctattcacccaatatagctcttcatttatttagcactttgaaaatttctttcatcattattttgcatttttcaactgacatttcctgtatatgttttattaagtttataattaagtatatgttttttggaggaagtatacatgtattttttaaaattttatttcaatatgtttattgttagtatatagacatgtgatgatttttgttggttgtatattttgtcctgtgttcttgggtcttgtggccttgttgtaatcacttattagttacagctgatttttttttgtaacttacttaagattttctacataaacaattatgtcatctacaaagagagacaacgtcttttcaatctacttgctctttgtttccttctcttgacttacaacagtagaaagaactaccagtagttcattaaataaagttcatatgagtggacatatttgtcttgtttctaaccttgaggtatagggaggattcagggttttgccattacaaataattttagatgcagtttttggtttctgttttgctctgttttgttttgggtaggca

SEQ ID NO: 1990 - DNA, 842 bp, Homo sapiens
cactagtgggagcttctcggtgcctgcgtgaagacgccctcttgcctccgggaaaagtatcgtctgcatcttcttgctccaggagcgggggtggggagcgcagcgcggaggaggcagcgctgagatgactcaacagtgcggcatttgggggcgccgcggaggctgggactgcgtaagcggcgatagggtaggacccacagcctcctcgcaggcattcttggagctcggttccgcggtcggtccggatctcccgggaagtctcgccggagtcaggcaggccttaggaagaagctgcctgatgtgcaaggtttcataggccgtcagagggggcatcctggaggagccctggcatcaggaaagtgagccccccatggcagcccgcaggaatgaaccagtgctcagggcagaaaaattctgcctgacctttcccatcttcctgatgatgttaacaaacgacagccactgagggcacaggagggggctctacacaggccaagagctacaggctacagtctgagcacagaaaaccctccagctccagcatccagggccacagctggacacaagtacagaacctggcagccctgcagcccagacaatgcccagggtgtgatttagggtgcagagctgcaactcagatcctgtgccatggcagtatcacaggaaggacttgacggagaggtgaaggctccagacgccaggatatttattccctgtgccaatacagcattcacacctgacctccaggtcctgcagcagtctctcccttgctggggacaacacaggaagagacaaaacctgaggaaggaaaaagggaacctgcaaccagccatggacctcat

SEQ ID NO: 1991 - DNA, 842 bp, Homo sapiens; identical to SEQ ID NO: 1990

SEQ ID NO: 1992 - DNA, 842 bp, Homo sapiens; identical to SEQ ID NO: 1990

SEQ ID NO: 1993 - DNA, 16291 bp, Homo sapiens
atgtctgaaaggttgaagccgtatgttgctgagaccattgctatttttggactgcaatgggcgaattgataatgactaaacaggactctgatcagccaatcagtgtcgccgcggttcctggttctaaagtcctcgccggcccaccgggactcagattctccccagacgccaaggttgcgggtcatggagtcccgaaccctcctcctgctgttctcgggagccgtggccctgatccagacctgggcagattacaattacaatcaaggcagaaatgatctcatttttacattacaactctggaaaaggcaatagactgagatgcaagtgtgcccccaagtgatgggcagaaggagagaaggtgttttggatgcattctagaacacaggtaatctaaggagagttgatcaaggccgtggaagagtcctccagccactattggccatcaaaggagtcctctgtgtcccaggaatggtcctgctttggtgtccctggtgtgacccatcacccgctgggaacagcctgagagaagtagggcctctgcaccaatgctgctgaggatgtcagagcacaggaacgaggccttgggaaattacctggaaatgcgactgaaatcttccttcctgaggggtctgggctcttggaaatcaaaccctctcaggttgggtggctggacgattctcctcacacttacaatgggacaaggggaaccaggaggcccccaaggggatccctgggttccacacgaactcctcctaccctcattgtgtgacagcagccatgcctcctcctggggatcaggatctattacctgtgcctggagaggaggggactcctcttctcacccgctggtctctggacacatactgtccaattcccctgtggcagctgtaatgtgtagttcaatgggcactcatttgtccccttttaagggtaccctcctttagaatccaggaccttctaccctgcagagtgtggttttgggagagaagtgcaaaatcccacgacaggtgagttgaaggaatgggatatggagccacatccacttccaccccttggtatctggacccacgtgttcttcctactgagattacagaactgtagagatgtctttgatttttaaaatgcaccatgtcctgaaagatggcaccctcccacccgcagagtgcttcctgcaagctggcgttgagctgtgcctatagaagctcttttcaacattctttatggccagcagcccttggttggtgcagatggtgataggaccagtgggtcccacagcatggccacactgcacctccttcgctgtcaagtgggtcccccacgaagatactgcacggagagcagtgccaagcctgtggatcaggaatatcaacagcccccagagagtggtgctggctgagggtctgagagcaggacaggaaaacccacctatggaataggtgcctatccctgtgaagatgaacctctggcccttccaggatggaaggagtgcaatgtagtcaactcctcacttagggtctggttggtcacctaaagaaatagagccctaccagggaagatcattgggttcaaatgctgatgagtaggacatttagaggtggcagtgtctggatctaccttggtaggagggagtcagtactgttggacccataggtagcctcatccctgccactgtgtttgctccatttatgtacccatcctacccggcctgggctgacccatggggaaggctggctaatttcagtgcttctgcttggttgttcagggccatttcaggtttgggtgttttctggggatgttaacatgggattcaggctcaactcacaagaaacttttccatctcatgatggatgctgttgggcatgtccaatgtatgacttcatgagttacacagatgctaattcgtaggggcacttggaatcacatggttgttttgtgtcccatggtcaagcattctatcttatcagggcctacagtaacatgccaaaagttgcttccaacatatttctctgctttggatggggcatatttctgtgctgtggatgacatggccttactccagaatcccaggccctccactgtgactctcctactggtgcttggttcagctccaccccaaatcttaccccaccactggcactttcagcaccagggggtctgaaggatggtgactgcgccatggcctggatctgctgcagtgtcctttcctgtggaggctccactcaaagctggcatcctcctatgtcacctagagtgtgggtcaaagcaatacacctacatgtagaatgtgatgtcagaactcaaacaggctcaccaggcagtgtgcttccttccttgcatgaggatgcaagatgcaacagtttgtctttcacattggaagggacacccctggatgcccctaaccactagacctgtaaaacttcactgcagtggccacttctgaatctctgtaaggtttatttatcttcaccctctggagagaagatgttttaccaaagcctctagtgtaccttcctcctcttactcatccatcccagtcaacatgatgttgtcaatgaaataaaggaatttaatattctatagtatatccaggttctccagatctcttaagactgtactatagaggcctggggaattataatagccctgaggcaaactatgaattaaagtgttgtggatcccacatgaatcactttatatccacttttgtgtgtgtgtgtgtgaggcagagtcttactctgtcacccaggctggattacaggtgcacaccaccatgcctggctaatgttttgtttttggttttggttttgtttttgttttgtttttggacagagtttcactctttttgcccaggctggagtgcgatggcatgatctcagctcaccgcaatgtccgcctcccaggttcaagttattctccttcctcagtctcccaagtagctgagattagaggcatgtgccaccacgcccggctaatttggtatttttagtagagagaggttttctccatgttggtcaggctggtctcgaactcccagcctcaggtgatccgccctcctctgcctcccaaagtgctgggattacaggcatgagccaccacacccgggctatatccacttctaattggaatggaagggaatgcactcaccacatccacagctgcacactgtgtgcctgaggccttattaatctgctctaccagatatatccagccagcatgctagctgcaatcaggactcctacttggtcacatctggagtaatcccattcattccttagtaatcccattcattccttaggctccatcaggcttatttgctaaattacatggagataataggcaaccccaacaccaccccacatcctccagctctctaatggtggtgctacccccacagcacttgcagtgccttccacaagattcaccctgggacatacgatcatttttgatttggccagaatggaggcagtttcagaggtttccctttggccttcagcacaatgagagcccttactccacagactagggatgcagtgtgggggtgactccagctgccagggcatcagtgtcaattatgcactaggagaatggggagataaccagggctgggtctgtggactcagtgaccccatggtgagccgtgatgtgtccaggtttatttcgtggtctccgtaatccccaatgtgagggggtcatgatgatgctgtgggcctctgggcatcaatgtcatctcacacccaaagtcagtactcccccaagttctccctatttccctttcccagggtacagtctctaaagtaaatggctgtaggtccctttgcacaatggctcagggaattgacccagcatacacttgccacagggttgcagggtccttcctcctaggaatatggacacctcctccgtcactgggttctgaatctgaagcttggctgagatctaggcactgagaatggatcatgattttgtattggttcaaacaccctcagcctcctgctcctcaattcttgctttcttatcatagataccaagcagtgctcttgctggctgcccttctgttctgaccctggaacaccaccctctattaaccttacccacaactgcaggcaggtcaagccccctcggctgctcctctggggttgccatggtaaccgtgtcctctggcttttgcaggtcactgccaccacttgttctctatctcttcagggccacaccctctccgtggatattaatgagcccaactctgggacatcttttcctaccatcaccctcagccttcagagaacaatacaatgaaacttcttagtgatgcaggtccctgttgccagcacgttcctgaggctctggtggaaggtgggccccctgggtcctcttataaagcacggttccggtgggctttccggcctcacgtaatgtctccatcccacaggccaaattcccccagcctcattattccctcttctacatgttccggggcaactaagtcaggtctagcttgtgagataccggcatcattttttcccagtctacatggatcaccccagcagtgggtttgccccatgccctggggtctttgaaaaacccatgtgatacggttggctgtgtccccaaccaaatctcgtcttgaatttccacgtgttgtgggagggaccaggagggaagcaattaaatcatgggggcaggtctttcccatgctgttctcatgatagtgaataagtctcatgagatctgatggttttaaaaggagaaatccctttcgcttggttctcattcttctcttatctgctgccacgtgagacatggctttcaccttctgccgtgattctgaggcctccctagccacatggaactgtgagtccattaaacctcttttggtaaattgcccattctggggtatgtctttatcagcaacatgaaatggactaatacatcatgccttgagaaagtgttcccaagtcaaaggatttttatctatctagcttgaaattctgtccctttgatcaaatgccctcaaattccaatcccagaagtgttccccaggatcctatgtggacatgccagctagttcctgcaaagctcctgagtggaattcccgctgcattataagggtgaggcttctgcagcatcttccagcgtaggaagtgggaactattactggaaaaggcgagccttctctgcatgcccagagggtactggagggcacccatctgataatgctgtcctagtttgcagaatctcatgtttccccaccagggccctgattttccacaacaggcctgccttggctgaatgtcaaacatctctggaggtctgtaaccctcacaatgatatcttcagctaccattccacactatctaccctttcgctacaggaaacaagggcctctccatgagacactgcagaggccctcacacatagccagtgacagctgttagaatccctcagattctcattctccttttatagggcatcaacacagctgagcagtaaccagccagcttccctgttgtaggttttccctcccaccctgtcattattgtgtagaggcttctatcacaccacctgccatagcacccggtaaccagggcatcttctcaggtcggtgctggggatatccacagcagctcagctgcaccttgtgccatggactttctctgtccccaaccaacgtggatggcattcttggcctgccaggcagtgggcaagctcaggcccaatccccgtttttgtctgtgtctatggaccactcctgaagccacttgtgttggttagcatcccctgaggagcagactgcaatacagaattaaatgtgccaggatttattaggggaaatagccatgaaagaaattggggagcaagacagaaaagactgggaaagccataagactgtgatgcaagtggcttttttatttttattttttgagcaatctcagctcactgcaacctccacctcccaggtgcaagtgattctcatgcctcagcctcccaagtagctgggattacacgcatgcaccaccaaacctggcaaatttttgtctttgtagtagaggcgggttttcaccatgttagctaggccggtctcaaactcctgacctcatgtgatctgcccaccttggcctcccaaagtgctgggattacaggcgtgagccactgtgcccaaccagactgcaatgcaagtttaaaccccagtgaaggagagagggaaggaagtttggctgaaagtatcctagacccagtgcaggttaagagaagttcagtaatggtgagccctggagcctcagtgggcctttaaaggagagacaatcctgtctttgtttctcctgttctctcaattattgaatcgaagaagccaatggcaagtatggtctgagagcaaacgtagcaatagatttcaggcggcaacagctggagcatcatcagctgtgcttcctctagctgaggggctgggatgtgcattctcaagactgccacaacaatccagtggggagaaaggacaaagggtaatgatcaaagagaaaaaaaggtatgaactgatgaactgatacctttaagtagatgagaaggatgatgtttgggacaccagtagagggactgcctctggctgggagcgggaaggttaacccacaacaaccatccatgtggtagaagacccagcatgcagtgcagctgcaaatgcatgagcagatggaatctgtgaaattgtcttctagtgtgttcagttttctcagtgaagtaggaagcaaggtcatcagctgaagtaagaatgcagatagaaggttggatgtgtgagcagagagaaggtgtgtgagagtcacccagaccagtaggaggctgagggtgagccatgcttggagagggtgattgctggtcgtggtggggggtccccatgaggtttgggtcatgaagttagagagagaagtcagcatgctgtgtgctgctttccagcctccttcagctcatgggggcaggtgcagcgtaggcagaggtggattccaccagctgtgtagttttgccaaacaagtatggcaacgcaagggaggggcaagggagggatggaaattatttacaatagaattcaaaatggctgaagagggaggagaggacatcaagggtgagggacagtgagtagatggcaggatcactggattgggaatcccagagtgggtggaaggattgttggaattgatgtactacagggcagactccaagcctggaaagcaggcacataggcaatgagtggttcactgatattacgtcacagcatatgataaaatgatagtataagtatcctcagagcctgtggcctccgtgcaaggggatgagtggaaagatggtcagagaatgggaagtgtgagatagagagtatggaagggctggggttcttggccatgatgagacctaggactctttaggggagaacaacaacaaagcaacaggatcctggtgtcagggacagaccatggccatggcgggatgatagcagctctcctacaaaataatgcttatatgacaagggcatgagattcaggcagagggaggagaaggtcatggaggagaggagtcccagcatctgagaagccagagggcgatgcatcctctctgctctatgggtgtttattgctgccataaaaattaacacaaaacaagtggctttaaacagcatctctttatcatgtcacagtcatgtgtgttacaacttcaacagtctcatggggctaaaatcaaggtaaggggaggtctgtgttccttctgactctgaggaaaaatctactgtcaagctcattcaggttcttgtctgaattcacttccttgcagataggactgagatccccacttccttgctggctcctgtccaggggccacccttagctcctagagccctctctcagttcctcacacatatcccatgcaacatatccaatcctcctgcttggaacctctgacctcccccttctgcggtgtctcctctgccttcctcctctgcagcatctgactccagccagagcagcttctctgcttttaatggcttgtgagatttgatcgggcccacacagatagtccaaaataatcttgcaattttaaggtccttaatcttcatcacatcagtattttcccttttgccatgtaatgcaacctactcgtgggtgcccaggattgagattggacgtctttgggaaccattactcggcccatcacatctgagtatgttgaagtcaccgaggatcaaggagacagcactgctggagagggcgatagtgaaccaggaactacaagagtcaggactgagaggaacggcctggggcccacagggaatggctgcaatgaggggagtggggcctgaatctgatgacagctttgggggcttaggaaggaaggaggcagaaaggtctgagaaccacagtgaggagtgaggatgccaccccacctctgggccaagggtacaaggtccctgtgcaaactcccccatgtgggaggactttggaagggaccacatcctctggcagacacagacatcgctggagctgtgaggtccaggaacatcctgagacaggatgtggaggttttgctgatcatgggctgagaattccaaggggcacagcgggaagacttctggatttgggaatggggtatggggagacaaaataggggtgtgcagagccttgtggggatgtgaatgcagggtgtttgggggacccagtgtgactgacacaaacagggaaaaggcatgatgagctcagtcctggtggactcaaggcagatgatggtgctgaggctgtgggagacgagggaggaggctcaggggtggctttcacctgggctctgtccatggaggtgaggacagggagatagttgggcctcagtgctgtgtggaccctttcttgtctccctgatgactggatggagggcctggaggaagaggggtcttagaggattcactcatgtccctgggggagggggactcactccaggtctcaggtctgcactgacacatttgtttgtggcttggggctgcctgctataaactattgggggttcgtccattttggagttataacctaaggcagaaactcagatggttcaaatgtcctcttcatgaagcaatgttatcagcgtatcatttagattgtcttgcaagagtctcatttgttgtttttctaaatgcctgccaatattgtttgaaaatctacaaatgtgataaatgtatcttcaaagttaactggttgcaggttgtttaaccttatatgtacagtttcacatatgtataaaaacagtagtttgggcctcttatattctaatgattaagactttaagctgtgtacacattgcaatgcaagtatgcgtcatgcataaccctagcactaagagtcaagagggaaagtacctctcccctaacattttacaaagtttctgtgttctttttccactgagtgggaacaagtcagctagtgaggaacatgaggcctttggcctcatctaaagttactttagctaccaattgtgagaagcactgaccaccgggaaggcctccctgcctggttcctggacctctataccatggcagaggccatcttccctcctagtgcagagtgatgtcccaggtagtgacctggttagccattgtccactctcgggcagttttgccttctaagacattggtttttctctgaggacctccctgttttcagatgatcaaaactggggccatccactcccttctgaaccacctctgcccagtggcctgtggctgtgccctcagtcacaacaggacaccccttcagaacacgctgcaggaagccgacatctctacacaggctcacacatgcacagtgtgtgcacggagctttggttctagttcaggaagaatgggaggaggctcactagtccaacagagcttgagccctgtaccagtgtcatattccaggagccagagttacaagggatacaaagtgcccagacctaccagagaaggcaaacccctacagcatgcagggctagacaggggcaagaaacaaggtcattctgggccagcaagaagagggaaagggaaattacagtcatacttcagatatatgcaggtttggctccagaccatggcaacaaagcaagtcacacaaatttttcagtttcccagtgcatataaaagttatatttacacttgactgtagtctcttaagtgtacaatagcattatgtacaaaatgaactatgtacataccttaatgtaaaactactttattgctaaaaaatgctaacaatcacctgaggcttcagctaatcctaaccttcttgctgtggagggtcttgcctcaatgttaataattgctgactgatcagaagggtggttgctgaaatcgctgtggcaatttcttaaaataacacaacgaagtttgcagcaagattattctcctcacttggacacttagaggccattgtagggttactaatcggcctgccttcaatatttttgtgtctcacagaatagggaaggccgggagagagagagagagtcaagaaaccagccagttggtggagaagtcacaacatacacaacatttatcaataaggttcaccattttataagggtgtgggtcatggtgtcccaaaacagttacgagagtaacttcaaagatcactgaccacaggtcaccatacaggtgtaataatgaacaaggttgaaatacttcaagaattaccaaaatgtgacacagagacatgaagtgagcacatgctgttggaaaaatggtgccaaatagacctgcttgacacagggttgccacaaacattcggtctataaataaaaaagcaagaaaaaagaaagaaagatggaaagaaagaaaaagcaaaggaaaaaatgcagtgtcagcaaacagtaataaaggaaagcacagtggaaggtgcacctgcaaaggggaaatcagcactgaagcaaagtcaggaaaagctttcaagtcagatgggcctggacctgggcatgaaccctccaggtcctcccaccagccagctgaagaggcctgagcacatctgacccagagctggccccgacagacacttgcccagtgagtgagtgctgaatgaaaccatctgagccagtttcctcatctgcaaaccagtgacataattcctgccttgcagagtttcagaagaataagtgagaaaagacacagtgccaagagaaacagacacaagacctgtggcgggctggacaccagggctctaaagcaagttctgcctaaactggcaagaacatttttcaggaccctgactgtcccacagaagaagtgacaagaatttatttatgacatgacaataacacatgtattcatggtgttaattcgatttgtttcatagagacagggtcttgctatgttgcccaggctggtcttccactcctggcctcaagcaatccccctgacttggacttccaaagtgctagcattacaggtgtgagccattgtgcccagcccttaacttgaaaatctgacagtataataaaagaaaaaaatagaagtattctggaaatggaagaggaaagaaggctaaggtggaaatcatcaatctgtgtcatctgagaagccccacgtgcagaggctgtcccgggactttaggggagaacaaaaacaaagcacccaggatcctggtgtcagggacagagcatggccacggcgggatggtagtggctctcctatgaaataatgctcataaacatcccttgtgagaaggatcagatcaacatataaaaatatgccaaataaagtgaaactcaaggcaggagtgggactggccattctcagcccgtgacctccatggacttggagaaaggctcagcctggagatgtgtgaggcctccgacctggagcagcacccgcccctaaagaccaggcacaaatcccagcacatggagggatccagacaaatacacaagagatgaccacagcaggagctttactgggcacagagcgaggccacacaccactcagctcctgcccctccacctgcccttctctccccacctgcccctgccccagcacagcagatcctcagaatccaaaaagagaacctaacttccatgttttattaatggcttataatattttatcacatcttcagaaaacactatgcagaagataactgtagagcaagacatctatttagggtgagtgagtcacagtggagatctgggagggagaccctgtaaccctttcattccaagaaaagaaaggtcgatccaaagaaggggaccccaggcctggatattgggattacatgaaaggggttctggggcatcaggggaatgggtccctctccctacatcctcccggggctgtgcttgggaggacagcagctgggggaagaaaagtcagggtccacagagatataagggggctgagaactatctgtgtcttgctggtctgcacaaggcagctctcaaactgtggagaacatggtaatgaccagattcagctcagccactctcagcctttacacctagagcattatgggcagcccatcaccatcccctaccttcaaatccaaagatcgctacagcccaaagctgctccctggcctcaactcctgttggtatcaggccccaaggaagctgtgagcacgtctgcctgggaccctgtcaccatctggagaatgacaataaagaggacccagcagcctgcaggaggagactgtatttgaggcaggaccatgggatgggtgaggcacaggactgtggctccatcctctctatttgaggagttagagatgagctgcctctgccaccccttccatggtgatatttctagagtacacccctgtgctgaaattcttatgaggaaagagacctgatgagatgctatggtgaagaggggccataagggtcttgaataccaagttaattttgctaccagctgagattaggaagtgaagcccaggacccaggagaggaggaggaggagataacacaggaccctgtgatcactctcctggccatctgtgtacagtgagatgcttcccttcggggttgggagcacccagtgtcatggtcctgagtgttgctaccctgctgttctcatctgtgaatgcagccagaccactttcttcctctgatataaataacttggaggatctgtcaccagacacctcatatctacatattaataaattctgtacagtggtttggcttaatgttttatatgttataagaaataagcaaaacatagggatgatatttttagtaaaggtatttcagggtatatgagaatcagattcctagggccctgggtacctcatcttgctgtttaaagtcctcatggaggatcagtggagtgcagagcccagaaatcatcctgaaggctgaagctccctggtgaaaaggaccctctcctgcaccctggggctcagagggaacaacaaagctccctcccagggtctccagcctctggcctatactgtcagcctgcactttcttggccttcctggctgctaatattccagttcccagcagcctcctctctcacccttcacctcttctgactgggtgcgaatggtaactagaccaggcagtgccctccttgtcagtctgcctgtctgcctggttccctctcagagtttgtgtcttcactcggttcatcatccccagccccagcaggaacagggagaagtgacttggcaaatgccccactcaaaatgggatccctcaaccagagaccacttgtgaaagtcagttttccctgactaaagaaacaggacatttaccctgttagaagttgatgtctgccagagacctccacctgggaaatgctggttcatggcagggtctctcttttagtaaagggaaaaattcctggctaattgatagctaataagtcatttagaatccagttcatgtaaaaggattacctacttaaaggattaactccattataataaggacacacatcccacaccgcacatccaatgtcatttgtgagattgctttgattcgctcatgtagaatgttactctgctgctttgcagagaggcttgccacacatttcaaatctctgctcctcatttcacaccatctggctcatgaggtgaaggtgatgagaagtgtcttcagacaatactccgaggtttgtctatcagagtcatagtcatatattacatatagagattattttcttagaagttgtaatttattgatatgtattttactcatggcatagatagatactatccaacaattcgtttttattacctctacattacactgcttaggtagccactactggtacctctgcattttctttcttgtatgtgacattaacgtataagattgtatgtacatggtggcttggtttccaggaattgctgattaggtaatttagaccattccttccactgagtacaatgggaaaaggaggaaaacatacatatttgaaaaatctggttgagcaaatggatgggctaacaaagcagtgaagatttgcctggccaggaaccaggagaggggagaaatccagaagagcaacttgagctgtggggctgcttttgtggatcagaggcagtaacacctgctccctggccagaagccaacttccaggattcaggactcagaattcagaacttagacagtcccttggtctctctagaattcagtgctcatttagaccgggctaagaccctcacactcaatggctggaggatccaagcttatggcatgactgcctctggagcatttcatgctagagagatcccaacaggtgtaggtaaatggtctagagggtactagccaggcttccatggaactctgtgtaaggcacttccctgtgttgttactcatgttggccatgtcctcgggaatttagtggaacggccatgtcgtcttgagtggaagtgaggacggtgagggggtccctgggcagtcagagattttgtgtccctgcgtcctttccttccatctcaaccagagaccacttgtgaaagcccaagaacaaatgtcattaaatgtccgaggcgaatccaagaccaccgatccattgcgcccaggagccttgggccatgtagcccagcagtagtgaggtctgtgaggccttggtcacccccaaagtgttgccccaagaggagctgccgctcgttgccatcaggcacctcaggagctggacatggtattcattataatttctgatgaggaactagagaggtctcatagcatatagaccttgatcaaattgggtcatggtggagtcaggcaaaactctgcaatgactcacaggtacctaagtataaaacaaagtctcaactcagagcatccatcagagcttcaggctcagtagtcattcctttatgctgttgctgtgtttgtactgtgataactggtgcttgaagggaggacatatagttacatgttgcgggaaaacacatgtcattagaaaacttggcatgatttagggaccattgccttttccatggtagatgtgggactctctgtcatcttcaccttgttgttccaagtgcagaagagaaagcttcttcctgctttcagctgcgtgactgacaagggaagctggaattcagagaatcagtggcagcctctgtctctccaggccccaaccctgcaggtttaaggaatggacttaggtctctggcactttgttctcaacacacattttccttcactcattcagaaaaaaaaaaataataatagaaaatgaaccaaaggctgcaattctcatggcacctagagaactggagtacggaccaaggttgccacatgcctgtcattgctccaccacactcggttgccatgtgacctcgggagaagctctctaccactagggacttttaaactcatctgtgaatcctggataaacacagacattccggtaaccttactgaaatgaagtgaggaccaatgagttgacaggtggagaaaaattttttttttttttttttttgagacggagtcttgctctgtcacccaggctggagtgcagtggagcgatttcggctcactgaaagctccacctcctgggttcatgccattctcctgcctcagcctaccgagtagctgggactacaggcgctcaccaccacactcggctaattttttgtatttttagtggagacggggtttcaccatgttagccaggatggtctcgatctcctgacctcgtgatccgcccgccttggcctcccaaagtgctgggattacaagcgtgagcctccgcgcccggccgcagaaacagaaaaatttaagtgatggcctttactcctagacagggcttttttaggaacatgcaccttaaaagtaggaggaaaac

SEQ ID NO: 1994 - DNA, 16291 bp, Homo sapiens; identical to SEQ ID NO: 1993

SEQ ID NO: 1995 - DNA, 16291 bp, Homo sapiens; identical to SEQ ID NO: 1993

SEQ ID NO: 1996 - DNA, 16291 bp, Homo sapiens; identical to SEQ ID NO: 1993

SEQ ID NO: 1997 - DNA, 13672 bp, Homo sapiens
atcagccaatcagtgtcgccgcggttcctggttctaaagtcctcgccggcccaccgggactcagattctccccagacgccaaggttgcgggtcatggagtcccgaaccctcctcctgctgttctcgggagccgtggccctgatccagacctgggcagattacaattacaatcaaggcagaaatgatctcatttttacattacaactctggaaaaggcaatagactgagatgcaagtgtgcccccaagtgatgggcagaaggagagaaggtgttttggatgcattctagaacacaggaatggtcctgctttggtgtccctggtgtgacccatcacccgctgggaacagcctgagagaagtagggcctctgcaccaatgctgctgaggatgtcagagcacaggaacgaggccttgggaaattacctggaaatgcgactgaaatcttccttcctgaggggtctgggctcttggaaatcaaaccctctcaggttgggtggctggacgattctcctcacacttacaatgggacaaggggaaccaggaggcccccaaggggatccctgggttccacacgaactcctcctaccctcattgtgtgacagcagccatgcctcctcctggggatcaggatctattacctgtgcctggagaggaggggactcctcttctcacccgctggtctctggacacatactgtccaattcccctgtggcagctgtaatgtgtagttcaatgggcactcatttgtccccttttaagggtaccctcctttagaatccaggaccttctaccctgcagagtgtggttttgggagagaagtgcaaaatcccacgacaggtgagttgaaggaatgggatatggagccacatccacttccaccccttggtatctggacccacgtgttcttcctactgagattacagaactgtagagatgtctttgatttttaaaatgcaccatgtcctgaaagatggcaccctcccacccgcagagtgcttcctgcaagctggcgttgagctgtgcctatagaagctcttttcaacattctttatggccagcagcccttggttggtgcagatggtgataggaccagtgggtcccacagcatggccacactgcacctccttcgctgtcaagtgggtcccccacgaagatactgcacggagagcagtgccaagcctgtggatcaggaatatcaacagcccccagagagtggtgctggctgagggtctgagagcaggacaggaaaacccacctatggaataggtgcctatccctgtgaagatgaacctctggcccttccaggatggaaggagtgcaatgtagtcaactcctcacttagggtctggttggtcacctaaagaaatagagccctaccagggaagatcattgggttcaaatgctgatgagtaggacatttagaggtggcagtgtctggatctaccttggtaggagggagtcagtactgttggacccataggtagcctcatccctgccactgtgtttgctccatttatgtacccatcctacccggcctgggctgacccatggggaaggctggctaatttcagtgcttctgcttggttgttcagggccatttcaggtttgggtgttttctggggatgttaacatgggattcaggctcaactcacaagaaacttttccatctcatgatggatgctgttgggcatgtccaatgtatgacttcatgagttacacagatgctaattcgtaggggcacttggaatcacatggttgttttgtgtcccatggtcaagcattctatcttatcagggcctacagtaacatgccaaaagttgcttccaacatatttctctgctttggatggggcatatttctgtgctgtggatgacatggccttactccagaatcccaggccctccactgtgactctcctactggtgcttggttcagctccaccccaaatcttaccccaccactggcactttcagcaccagggggtctgaaggatggtgactgcgccatggcctggatctgctgcagtgtcctttcctgtggaggctccactcaaagctggcatcctcctatgtcacctagagtgtgggtcaaagcaatacacctacatgtagaatgtgatgtcagaactcaaacaggctcaccaggcagtgtgcttccttccttgcatgaggatgcaagatgcaacagtttgtctttcacattggaagggacacccctggatgcccctaaccactagacctgtaaaacttcactgcagtggccacttctgaatctctgtaaggtttatttatcttcaccctctggagagaagatgttttaccaaagcctctagtgtaccttcctcctcttactcatccatcccagtcaacatgatgttgtcaatgaaataaaggaatttaatattctatagtatatccaggttctccagatctcttaagactgtactatagaggcctggggaattataatagccctgaggcaaactatgaattaaagtgttgtggatcccacatgaatcactttatatccacttttgtgtgtgtgtgtgtgaggcagagtcttactctgtcacccaggctggattacaggtgcacaccaccatgcctggctaatgttttgtttttggttttggttttgtttttgttttgtttttggacagagtttcactctttttgcccaggctggagtgcgatggcatgatctcagctcaccgcaatgtccgcctcccaggttcaagttattctccttcctcagtctcccaagtagctgagattagaggcatgtgccaccacgcccggctaatttggtatttttagtagagagaggttttctccatgttggtcaggctggtctcgaactcccagcctcaggtgatccgccctcctctgcctcccaaagtgctgggattacaggcatgagccaccacacccgggctatatccacttctaattggaatggaagggaatgcactcaccacatccacagctgcacactgtgtgcctgaggccttattaatctgctctaccagatatatccagccagcatgctagctgcaatcaggactcctacttggtcacatctggagtaatcccattcattccttagtaatcccattcattccttaggctccatcaggcttatttgctaaattacatggagataataggcaaccccaacaccaccccacatcctccagctctctaatggtggtgctacccccacagcacttgcagtgccttccacaagattcaccctgggacatacgatcatttttgatttggccagaatggaggcagtttcagaggtttccctttggccttcagcacaatgagagcccttactccacagactagggatgcagtgtgggggtgactccagctgccagggcatcagtgtcaattatgcactaggagaatggggagataaccagggctgggtctgtggactcagtgaccccatggtgagccgtgatgtgtccaggtttatttcgtggtctccgtaatccccaatgtgagggggtcatgatgatgctgtgggcctctgggcatcaatgtcatctcacacccaaagtcagtactcccccaagttctccctatttccctttcccagggtacagtctctaaagtaaatggctgtaggtccctttgcacaatggctcagggaattgacccagcatacacttgccacagggttgcagggtccttcctcctaggaatatggacacctcctccgtcactgggttctgaatctgaagcttggctgagatctaggcactgagaatggatcatgattttgtattggttcaaacaccctcagcctcctgctcctcaattcttgctttcttatcatagataccaagcagtgctcttgctggctgcccttctgttctgaccctggaacaccaccctctattaaccttacccacaactgcaggcaggtcaagccccctcggctgctcctctggggttgccatggtaaccgtgtcctctggcttttgcaggtcactgccaccacttgttctctatctcttcagggccacaccctctccgtggatattaatgagcccaactctgggacatcttttcctaccatcaccctcagccttcagagaacaatacaatgaaacttcttagtgatgcaggtccctgttgccagcacgttcctgaggctctggtggaaggtgggccccctgggtcctcttataaagcacggttccggtgggctttccggcctcacgtaatgtctccatcccacaggccaaattcccccagcctcattattccctcttctacatgttccggggcaactaagtcaggtctagcttgtgagataccggcatcattttttcccagtctacatggatcaccccagcagtgggtttgccccatgccctggggtctttgaaaaacccatgtgatacggttggctgtgtccccaaccaaatctcgtcttgaatttccacgtgttgtgggagggaccaggagggaagcaattaaatcatgggggcaggtctttcccatgctgttctcatgatagtgaataagtctcatgagatctgatggttttaaaaggagaaatccctttcgcttggttctcattcttctcttatctgctgccacgtgagacatggctttcaccttctgccgtgattctgaggcctccctagccacatggaactgtgagtccattaaacctcttttggtaaattgcccattctggggtatgtctttatcagcaacatgaaatggactaatacatcatgccttgagaaagtgttcccaagtcaaaggatttttatctatctagcttgaaattctgtccctttgatcaaatgccctcaaattccaatcccagaagtgttccccaggatcctatgtggacatgccagctagttcctgcaaagctcctgagtggaattcccgctgcattataagggtgaggcttctgcagcatcttccagcgtaggaagtgggaactattactggaaaaggcgagccttctctgcatgcccagagggtactggagggcacccatctgataatgctgtcctagtttgcagaatctcatgtttccccaccagggccctgattttccacaacaggcctgccttggctgaatgtcaaacatctctggaggtctgtaaccctcacaatgatatcttcagctaccattccacactatctaccctttcgctacaggaaacaagggcctctccatgagacactgcagaggccctcacacatagccagtgacagctgttagaatccctcagattctcattctccttttatagggcatcaacacagctgagcagtaaccagccagcttccctgttgtaggttttccctcccaccctgtcattattgtgtagaggcttctatcacaccacctgccatagcacccggtaaccagggcatcttctcaggtcggtgctggggatatccacagcagctcagctgcaccttgtgccatggactttctctgtccccaaccaacgtggatggcattcttggcctgccaggcagtgggcaagctcaggcccaatccccgtttttgtctgtgtctatggaccactcctgaagccacttgtgttggttagcatcccctgaggagcagactgcaatacagaattaaatgtgccaggatttattaggggaaatagccatgaaagaaattggggagcaagacagaaaagactgggaaagccataagactgtgatgcaagtggcttttttatttttattttttgagcaatctcagctcactgcaacctccacctcccaggtgcaagtgattctcatgcctcagcctcccaagtagctgggattacacgcatgcaccaccaaacctggcaaatttttgtctttgtagtagaggcgggttttcaccatgttagctaggccggtctcaaactcctgacctcatgtgatctgcccaccttggcctcccaaagtgctgggattacaggcgtgagccactgtgcccaaccagactgcaatgcaagtttaaaccccagtgaaggagagagggaaggaagtttggctgaaagtatcctagacccagtgcaggttaagagaagttcagtaatggtgagccctggagcctcagtgggcctttaaaggagagacaatcctgtctttgtttctcctgttctctcaattattgaatcgaagaagccaatggcaagtatggtctgagagcaaacgtagcaatagatttcaggcggcaacagctggagcatcatcagctgtgcttcctctagctgaggggctgggatgtgcattctcaagactgccacaacaatccagtggggagaaaggacaaagggtaatgatcaaagagaaaaaaaggtatgaactgatgaactgatacctttaagtagatgagaaggatgatgtttgggacaccagtagagggactgcctctggctgggagcgggaaggttaacccacaacaaccatccatgtggtagaagacccagcatgcagtgcagctgcaaatgcatgagcagatggaatctgtgaaattgtcttctagtgtgttcagttttctcagtgaagtaggaagcaaggtcatcagctgaagtaagaatgcagatagaaggttggatgtgtgagcagagagaaggtgtgtgagagtcacccagaccagtaggaggctgagggtgagccatgcttggagagggtgattgctggtcgtggtggggggtccccatgaggtttgggtcatgaagttagagagagaagtcagcatgctgtgtgctgctttccagcctccttcagctcatgggggcaggtgcagcgtaggcagaggtggattccaccagctgtgtagttttgccaaacaagtatggcaacgcaagggaggggacatcaagggtgagggacagtgagtagatggcaggatcactggattgggaatcccagagtgggtggaaggattgttggaattgatgtactacagggcagactccaagcctggaaagcaggcacataggcaatgagtggttcactgatattacgtcacagcatatgataaaatgatagtataagtatcctcagagcctgtggcctccgtgcaaggggatgagtggaaagatggtcagagaatgggaagtgtgagatagagagtatggaagggctggggttcttggccatgatgagacctaggactctttaggggagaacaacaacaaagcaacaggatcctggtgtcagggacagaccatggccatggcgggatgatagcagctctcctacaaaataatgcttatatgacaagggcatgagattcaggcagagggaggagaaggtcatggaggagaggagtcccagcatctgagaagccagagggcgatgcatcctctctgctctatgggtgtttattgctgccataaaaattaacacaaaacaagtggctttaaacagcatctctttatcatgtcacagtcatgtgtgttacaacttcaacagtctcatggggctaaaatcaaggtaaggggaggtctgtgttccttctgactctgaggaaaaatctactgtcaagctcattcaggttcttgtctgaattcacttccttgcagataggactgagatccccacttccttgctggctcctgtccaggggccacccttagctcctagagccctctctcagttcctcacacatatcccatgcaacatatccaatcctcctgcttggaacctctgacctcccccttctgcggtgtctcctctgccttcctcctctgcagcatctgactccagccagagcagcttctctgcttttaatggcttgtgagatttgatcgggcccacacagatagtccaaaataatcttgcaattttaaggtccttaatcttcatcacatcagtattttcccttttgccatgtaatgcaacctactcgtgggtgcccaggattgagattggacgtctttgggaaccattactcggcccatcacatctgagtatgttgaagtcaccgaggatcaaggagacagcactgctggagagggcgatagtgaaccaggaactacaagagtcaggactgagaggaacggcctggggcccacagggaatggctgcaatgaggggagtggggcctgaatctgatgacagctttgggggcttaggaaggaaggaggcagaaaggtctgagaaccacagtgaggagtgaggatgccaccccacctctgggccaagggtacaaggtccctgtgcaaactcccccatgtgggaggactttggaagggaccacatcctctggcagacacagacatcgctggagctgtgaggtccaggaacatcctgagacaggatgtggaggttttgctgatcatgggctgagaattccaaggggcacagcgggaagacttctggatttgggaatggggtatggggagacaaaataggggtgtgcagagccttgtggggatgtgaatgcagggtgtttgggggacccagtgtgactgacacaaacagggaaaaggcatgatgagctcagtcctggtggactcaaggcagatgatggtgctgaggctgtgggagacgagggaggaggctcaggggtggctttcacctgggctctgtccatggaggtgaggacagggagatagttgggcctcagtgctgtgtggaccctttcttgtctccctgatgactggatggagggcctggaggaagaggggtcttagaggattcactcatgtccctgggggagggggactcactccaggtctcaggtctgcactgacacatttgtttgtggcttggggctgcctgctataaactattgggggttcgtccattttggagttataacctaaggcagaaactcagatggttcaaatgtcctcttcatgaagcaatgttatcagcgtatcatttagattgtcttgcaagagtctcatttgttgtttttctaaatgcctgccaatattgtttgaaaatctacaaatgtgataaatgtatcttcaaagttaactggttgcaggttgtttaaccttatatgtacagtttcacatatgtataaaaacagtagtttgggcctcttatattctaatgattaagactttaagctgtgtacacattgcaatgcaagtatgcgtcatgcataaccctagcactaagagtcaagagggaaagtacctctcccctaacattttacaaagtttctgtgttctttttccactgagtgggaacaagtcagctagtgaggaacatgaggcctttggcctcatctaaagttactttagctaccaattgtgagaagcactgaccaccgggaaggcctccctgcctggttcctggacctctataccatggcagaggccatcttccctcctagtgcagagtgatgtcccaggtagtgacctggttagccattgtccactctcgggcagttttgccttctaagacattggtttttctctgaggacctccctgttttcagatgatcaaaactggggccatccactcccttctgaaccacctctgcccagtggcctgtggctgtgccctcagtcacaacaggacaccccttcagaacacgctgcaggaagccgacatctctacacaggctcacacatgcacagtgtgtgcacggagctttggttctagttcaggaagaatgggaggaggctcactagtccaacagagcttgagccctgtaccagtgtcatattccaggagccagagttacaagggatacaaagtgcccagacctaccagagaaggcaaacccctacagcatgcagggctagacaggggcaagaaacaaggtcattctgggccagcaagaagagggaaagggaaattacagtcatacttcagatatatgcaggtttggctccagaccatggcaacaaagcaagtcacacaaatttttcagtttcccagtgcatataaaagttatatttacacttgactgtagtctcttaagtgtacaatagcattatgtacaaaatgaactatgtacataccttaatgtaaaactactttattgctaaaaaatgctaacaatcacctgaggcttcagctaatcctaaccttcttgctgtggagggtcttgcctcaatgttaataattgctgactgatcagaagggtggttgctgaaatcgctgtggcaatttcttaaaataacacaacgaagtttgcagcaagattattctcctcacttggacacttagaggccattgtagggttactaatcggcctgccttcaatatttttgtgtctcacagaatagggaaggccgggagagagagagagagtcaagaaaccagccagttggtggagaagtcacaacatacacaacatttatcaataaggttcaccattttataagggtgtgggtcatggtgtcccaaaacagttacgagagtaacttcaaagatcactgaccacaggtcaccatacaggtgtaataatgaacaaggttgaaatacttcaagaattaccaaaatgtgacacagagacatgaagtgagcacatgctgttggaaaaatggtgccaaatagacctgcttgacacagggttgccacaaacattcggtctataaataaaaaagcaagaaaaaagaaagaaagatggaaagaaagaaaaagcaaaggaaaaaatgcagtgtcagcaaacagtaataaaggaaagcacagtggaaggtgcacctgcaaaggggaaatcagcactgaagcaaagtcaggaaaagctttcaagtcagatgggcctggacctgggcatgaaccctccaggtcctcccaccagccagctgaagaggcctgagcacatctgacccagagctggccccgacagacacttgcccagtgagtgagtgctgaatgaaaccatctgagccagtttcctcatctgcaaaccagtgacataattcctgccttgcagagtttcagaagaataagtgagaaaagacacagtgccaagagaaacagacacaagacctgtggcgggctggacaccagggctctaaagcaagttctgcctaaactggcaagaacatttttcaggtcaggaacaggagttgttctggattctgtctggggtcaggctgggagggagctgggggtggcagagtaggatgggggcaagggctgtggcagggcctggcactgaagtgaggccaaagcctggagagagtggctcctggtggcttttgggcagctcacgcaactccctgcctcacccactgtgtgagtcagcgttctctagaggagcagaactaataggatgtatgtacatatgtaagggagtttattaaggagaattgactcacacgatcacaaggtgaagtcccacgacagaccgtctgcaagttgaggtgcaagaaagccagtgatggatcagtccaagtcccaaaacctcaaaagtagggaagctgacagtgcagccttcagtctgtggccaaaggtgtttggctgcagattccaggacaggaccttcttgtcctctgcagtgaccccccacctcgcctgactatatctgtccaacttgatggtgccaccgagggttctgatgcagggaaggagctgtgtgctctgtgtgggaggatgccttctgcctttctagctgggcctcaggtcagggctttgagcctgagcagggagaggagatggaagggagatggccttggagcaaacgtctgcccctgccagtgcatcccgtaggtatcatcccatccaccagtgccttggcaggaccccactcactcaaccctccccctggtggtagtccctggtggtgcctcctcaggacctcctgcctccagccgcacaaatccccaagaatggcacgtgggtacaagggtgttgggaagtgtcatcctccagtgctgacttgagtgtgtgtgtgtggctgcacacgtgtgtgcatgtgtgcacaagtgggaattggagtgtgtgtacacgtgtgtaagtgtgagtgtgagagtggagcatgaatgtgcaggtgcccacaggcagcagttggggtgccagtgtcctcactcctgcctgctttcctttctctccaaaacgtgaccacacagcaacttagtgactatctagatttaagtctatcaaacagaagggaaacacaactaggattcctgtagtgtagggaagggaaatgcctagcccagctctctgattccccttttaatgggtttgagctgcaatatgggtgcagaagagcctcccacagcgccactggtggtggaggaaatagcccctctcattggcccattttcacgctgctgataaagacatactgggaagaaaaagaggtttaattggacttacaattccacatggctgaggaggcctcagaatcatggcggcaggtgaaaggcacttcttacatggcagtggcaagagaaaatgaggaggaagcaaaagcggaaacccctgataaacccattagatctcgtgagactatcacaagaataccatgggaaaaactggccccagtgattcagttacctccccctgggtccctcccacaacatgtgggaattctgggagataccattcaagttgagattcgaatggggacacagccaaaccgtatcactggatgagagcaattagattgatgtcatgatgtatatgggtccatgggaacttgaaaaagtcttccccttccacctagtttaacaagataaacaggaaaggaacttcccttaagggaagatattgactctatccctgaaattaaatcacaagaaaataagaaatgcatgagatctaaactaagccatttgggtaaactgtctcagaatttaaagcatcagcagtcacaagctatcagtatcagtgacgattctttcactccatggtctagtccaacgagactggtcagggcttgccgcctgctcctcggtgctgtcctggtactttgaaagtatctgtgattctgtgaactgcaccgccagctgcccaacaacttccctttgctgatctgagccagactctgcttttatggcttacacccaaataattcaagttattttaaaaaaataataataaatcaagttattcatttatgagttatacagtcccatgtggggaaagggaaggagagtgaggtaatactcaattttactacctgctatgcatttataagtgagatacttctttttaaagtcatatttttggattagaacaaactctggtatatttaagtaaattccctgaagaatgtgaacaccgtaagcaggtgagtgcattattctctgcttcccctccacagagctgtggttcactctcctccatcctgccccctgcactgggggcaccacagagacagcacggcctgtgctcctgcaccacctgcttctgcttgggtgtggatgataacaggcacctgcaggagatgggagcgtggggggagaagtaactcagggttttcacttccctcactccctttggacagctctgcggttctgtaatcattgccgtcctctacctacagccacaggcctgcagggctgcccctagtgaaagctacagatttccgtgagttctggaaactgctccctcttccttgttctttcaactcagagatggaaacagtttcctgccactgatcatcccagggagcttcagcaccccttgtggctttcttaggcctgccagcacctctgtaatgtgtgtcttctttctttgtcatctctttcctgccag

SEQ ID NO: 1998 - DNA, 13672 bp, Homo sapiens; identical to SEQ ID NO: 1997

SEQ ID NO: 1999 - DNA, 2314 bp, Homo sapiens
ccccgagtggcccggcgcccgctcgttccctcctctcgcccctttgccgagtctttgtctggccccagccccgcggggccccgggtccctgtgccctcgggggtccctagaaggcgacaatggctcgagtccaggcgccgaggctggcgagcgcctgcttggcgcacagctgcccgttgagcggcggcggctgctccgaggagtccggctgtcggctcaccagccccgagaagccggagccaaagatggagatcaagtttgagatgttggacgcgtccggggacgagtccgggcagaagtcctcgaagcgggcgcgcttgcagggggcgaacggggcgcccccggggggctcggcccccagcccgcccgcatcctcctcgtcgtcttcctcctcctcctggccagggagccggctcaggtgtctctccctccaggaagtggggcttgtgccctttggatacctgcactccccatcaccgcactccccatcgtggcacttcccttgttgcagttttatggagtgtgcgtctggctctccaactagacttgaaccgcttgagtgcataactcgggacttgaccatttgcgtctccctacggccagctcagcctccgcacacagggacctgcagagagtggatgtagccactgccccagcgtccctgggctctgaagagaagccattgcccttcaagagccaccctcatttcctgggcactggttggaaaaaacgaagaaaaagagacacccagctcacctccaagtttgcctgcaggtagctgatggttccagaagagggactcatggagctgacccgaatctgatccgtggcctgcagcgaaatcgagctgacccacagaatgacccacccccgctgacccacaggcctatgagagatggaaataaacatggcaagctactggcttggtggggttgtttgttacacagtcttatcatggcagaaacctgaccattccacatgtataataatagcactcactacccaggattgtttgaggattaaatgagatcatatatttaaagttacaaatttaatgtattaaaatacccgtgttagagtggggcatggaataactctatacaatatgagatattattaaacacggccgaatgtggtggcccacgcctgtaatcccagcacttaaggaggttgaggtgggtggatcacatgaggccagtagttggagaccagcctgggcaacatggtgaaaccctgtctctactgaagatacaaaaaaaaaaaaaaaaaaaaaaaaaattagctgggtgtggcgcacacctgtaggcccaactaccctggaagtagaggcaggagaatggcttgaacctgggaggtgaatgctacagtgagccgagatcacaccactgcactttagccggggcgacaaagagagagtccgtcaaaataagtgtaagagtagagtaaatgtttctcaatgtataacacgacacgttgacacattcatttaactcattaagattattttttctcttctaagccttgaagcacaggctaactgtgttacctatagaaacattgcctatagctcacagcctgggacatgactcagagaactgaaagctctcagcatggagaccctaatgtccctctccttcacccccatcccatgcatgaagcctgccatcctgtccatctctgggggttcctcaacctttgcttgaatccttccagtgatggagatctccctacttcccatgccaatttcagaatctccctcatggtgagataggctctctctctctctttttttgttttttgagacagagtttcgctgttgtcacctagcctggagtgcaatggcatggtctcggctcactgcaacttctgcctccagggttctagtgattctcctgcctcagcctgccgaatagctgagattacaggcatgcgccaccacgcctggctaatttttgtatttttagtagagacagggtttcaccatgttggtcagactggtctatgaacttctgacttcaggtgatctgcccgccttggcctcacaatgtgttggggttacaggcgtgagccaccgcgcctggctggctctgtctctttgactctcttgagttggatgttggatgactctcttgggcagggctggggatgattaacaccaggtgtacatgctctgggtcagatctggattaaatactggaatccacacttacaactgtgtgaccttgggcaagtgtattcacttctctgagactccgtgtaaagtggcgttaggggagacagaaaatccacctcccggctgggcgcggtggctcac

SEQ ID NO: 2000 - DNA, 2066 bp, Homo sapiens
ccccgagtggcccggcgcccgctcgttccctcctctcgcccctttgccgagtctttgtctggccccagccccgcggggccccgggtccctgtgccctcgggggtccctagaaggcgacaatggctcgagtccaggcgccgaggctggcgagcgcctgcttggcgcacagctgcccgttgagcggcggcggctgctccgaggagtccggctgtcggctcaccagccccgagaagccggagccaaagatggagatcaagtttgagatgttggacgcgtccggggacgagtccgggcagaagtcctcgaagcgggcgcgcttgcagggggcgaacggggcgcccccggggggctcggcccccagcccgcccgcatcctcctcgtcgtcttcctcctcctcctggccagggagccggctcaggtgtctctccctccaggaagtggggcttgtgccctttggatacctgcactccccatcaccgcactccccatcgtggcacttcccttgttgcagttttatggagtgtgcgtctggctctccaactagacttgaaccgcttgagtgcataactcgggacttgaccatttgcgtctccctacggccagctcagcctccgcacacagggacctgcagagagtggatgtagccactgccccagcgtccctgggctctgaagagaagccattgcccttcaagagccaccctcatttcctgggcactggttggaaaaaacgaagaaaaagagacacccagctcacctccaagtttgcctgcaggtgaatatcttgttgaaagagaggggactccctgagtcttgctgggttgaggaagctgattggatttccggactcagaggagggctgcagagagggaggaatgggggggatgggcagctggctttctggatgggtgcaggacaatgacattgatggggaagcttggggtggctctgccgttgcccactgcttggctggtgaacttgctacatcttggccagcactatcctcttctggcctgcaccctgccagacacaggcagtaccccaaataccctgtccctgtgccccgaagtctccatgaccttcagatcccaagggacaagtggctccacgaggcagggcctgtccctctggctcacactatggagtccacagaacctagcccggagcctagtgcacagtaggtgctcaatgtattctatttgaatgttgcatgagtgaataaatgcaggaatgtcaggctggaaaacaggtatttgtacacctgttttcatagcagtgttattcacagtagtcaaagggtggaagcatcccacgtgtctgctgatgggtgaacgagtaaacagaatgtgccccagccatacaatggaatgcgattcagccttttttttttgagacggagtctggctctgtcacccaggctggagtgcagtggcacgacctcagcttgctgcaacctctgtctcccgggttcaagtgattctcctgcttcagcctcctgagtagctgggattacaggcatgtaccaccacacctggctaatttttatatttttagcagagacagggtttcaccatgttggccaggggctggtgtcgaactcctgacctcaagtgatcctccctcttcggcctctcaaagtgctgggattacaggcgtgagccacggcgcccggccacgattcacccttaaaaaaggaaggacattctgacacatgctacgacttgggtgaaccttgagtacctgagtgaaataagcccatcaaaaaaggacaaatattagccaggtgctgtggctaatgcctgtaatctcagcactttgggaggccaaggacggaggattgcttgaggattgctcaataccagcctgggccacaaagcaagaccacccatgtgaggtgtttagagtagtcaaattcatagagacagtaggatggggagtgccaggagctggggagaagggggaatggggagttagagtttaatggggacagattttcagttttacaagatgaaaaatgttctggagatgatggtggtgatagaggcacaatgtggatatgcttcatgc

SEQ ID NO: 2001 - DNA, 1079 bp, Homo sapiens
ccccgagtggcccggcgcccgctcgttccctcctctcgcccctttgccgagtctttgtctggccccagccccgcggggccccgggtccctgtgccctcgggggtccctagaaggcgacaatggctcgagtccaggcgccgaggctggcgagcgcctgcttggcgcacagctgcccgttgagcggcggcggctgctccgaggagtccggctgtcggctcaccagccccgagaagccggagccaaagatggagatcaagtttgagatgttggacgcgtccggggacgagtccgggcagaagtcctcgaagcgggcgcgcttgcagggggcgaacggggcgcccccggggggctcggcccccagcccgcccgcatcctcctcgtcgtcttcctcctcctcctggccagggagccggctcaggtgtctctccctccaggaagtggggcttgtgccctttggatacctgcactccccatcaccgcactccccatcgtggcacttcccttgttgcagttttatggagtgtgcgtctggctctccaactagacttgaaccgcttgagtgcataactcgggacttgaccatttgcgtctccctacggccagctcagcctccgcacacagggacctgcagagagtggatgtagccactgccccagcgtccctgggctctgaagagaagccattgcccttcaagagccaccctcatttcctgggcactggttggaaaaaacgaagaaaaagagacacccagctcacctccaagtttgcctgcagacagacttcctgctccatgtttctgccttgtatttgtcctggagagctcgctcagtctggatcctgctggatttgtccccggggtggtgtgtgactgcatctgtgctccctgtatgtcctgtagattggcatttggtggagaggcttgatcagattcaggtatttgcccggcagcctgtgggggctgagcagcttggatgtcagacaatctgggtcagaatcccaggcagaatcacacaaagcagctatgtgaccttgagccagtggtgtgaggccctggattctcacctgtgcaacctcttggg

SEQ ID NO: 2002 - DNA, 1079 bp, Homo sapiens; identical to SEQ ID NO: 2001

SEQ ID NO: 2003 - DNA, 1079 bp, Homo sapiens; identical to SEQ ID NO: 2001

SEQ ID NO: 2004 - DNA, 1079 bp, Homo sapiens; identical to SEQ ID NO: 2001

SEQ ID NO: 2005 - DNA, 3328 bp, Homo sapiens
ggacgctgggctgggaaggggcctggtgagaggggttaactccctcagcccagtttccacactgtcccctccctctacagcacctgcccagggcaacgcccacccggccctcctctgcttccttctccgaattcacacatcacttccccgccaaaaagtagcaacaaggaagacagaaccacatcatattcacggcattccaacgagagggtcacagcagctccctgatgaaaacacaactgtcaggatcgctattcacgtcatcccttggtgtgcacccatgctgaagccacgaagagccgccctatgaaaccctctgagccacagcaacaatctcactgctaattagctctggctaatgcaccctaacaagtcctggaagtgagaagactgcagtgggaaatgcaggcggacagctacttagccggcactcagacacagggtgaccgagataactggtgtcaaatggaatctgaacaaaccttctccgggggtttatccgtacctcgaaatgctgaagggaggctgccagggccaaagatccaggagaaacaaattaagtggaaacccacggccccaccctccccctcacctccattgccagcagctgaaggtaaaccaagacgtggggctgagccttcacccttcatgggccacgccaaattagacactcattctgcaactcgcgtgtctgtgcacagagcagtaagcctctaagtgggaaattcttcctccaggcatcgcagcgctgcagaagccgtaaggcacataaacagagaagcaccagggcctgaaaggaaggcagcgctggctgtgatcactcactagagcctgatcccttagggctgccaagaacccagaagtctgttccatgtgtacaaagcaggcaggatgcaatcctgacagagcccaagggggtgcaggaattgataaccaagtcgagaggggacagacagaaagaactcagtatgagcatttttgcagcccaccaccaatttcacgcatttacctattgtactttctctctcttttcaaattaaaaatagttttaaacaaatgattgctttaacgtttagaaaaacgtttgcagcctaggcacggtggcttgcgcttgtaatcccagcatattagatggctgaggcaggaggatcatttgaagccaggagttcaagaccagcctgggcaacatggcaagaccccatctctacaaaaatttttttaaaaagccggacatggtggctgtcgtgggtgcgactggctggggccagcatcacaggtggtagaagattttaccaagacagttgtaagtaaagaaaggccaatttattaggtaaggtacagagaaatgttgcaagggtttaatggacagcacagcagagaaagggctgtgtgcagagaggcaggggctggagggaagttttataggttcacactggagggggctatgtgcagaatgaggttgtgctgctggcgctgtgtggcgcgaggtatttgggaacaggatgttgtgctagtgggttgtctgtgattaccggtctctcagaacaatggctgtccccacagggggcccctttctcattgttgcttactaatttggactccacagtggtgcatgcctgtagactcagctactcaagaggctgaagcgggaggatcaactgagtccaaaggatcacaccactgcactccagcctgggtaacagtgagagatgccatctctaaaaataaaaataaaaaactttaccctctcaataaccacaacattcagaccgtggctttggtttgattgcaggctacttgagatataggaaaaaaagatgcagaaaataaaatagggctgaaaaaagaatcggggaaagctagaaaaaactccagggctgccctgggtgctggaggaggggagcaaacaaatgtcctccagcctggtcagtgtcagcaggcttgtccccaaagattaggggtcatgaggggtcatctggggcgggagcagggctcaccaggtcgggaccaggactctcagggcctcctgtctcaggcctaaaggaaggagcttccagccactgtgggtgactaccttgctaccacatgctgagcccagtgtgaatgcctgtaaggggttgaatagtatcccccaaatttcacatctacccagaacctcaggatgtgaccttattttaaaatagcgtctttgcaaatgtaattagttgggggttgagaggatgtcaggcctctgagcccaagctaagccatcatatcccctgtgacctgcacatacacatccagatggccggttcctgccttaactgatgacattccaccacaaaagaagtgaaaatggcctgttcctgccttaactgatgacattatcttgtgaaattccttctcctggctcatcctggctcaaaagctcccctactgagcaccctgtgacccccactccggcccgccagagaacaaccctcctttgcctgtaattttcctttacctacccaaatcttatgaaatggccccacccctatctcccttcgctgactctcttttcggactcagcccacccacacccacgtgaaataaacagccttgttgctcacacaaagccggtttggtggtctcttcacaaggacgcgagtgaaattttggtgccgtgactcggaacgggggcctcccttgggagatcaatcccctgtcctcctgctctttgctccatgagaaagatccacctacgacctctggtcctcagactaaccagcccaaggaacatctcaccaattttaactccgttcctttccttttctggtagagacgaaggagacgcgttttatccgtggacccaaaactccagcgccagtcacggactcaagaagtcttcccttggtgtttaatcacgcggggacacctccctgattattcacccacgtttcagaggtgttttaccacgggacgcctgccttggtccttcacccttagcggctggacctgggcaggaccagcccggtcatctacagctgaggtgaggcctgggcagatttcccctcacagccccagcaggaaccaaccccagggacacctcaaccttggacttccggcctctaggaagatcagtaagagatttcagttgttcaaaccacccggcctgtggcagtttgttccagcagccccagccaactcctgacctgaaatatgtttatttgtttacattttctttgctgctttttagagtctaagccccacgtgggcaggcctttttatattttaatcactaccctatcccaagtgcctggacggtgttgttggtgtaaagcagttgcttaataaatatttgtggaat

SEQ ID NO: 2006 - DNA, 4713 bp, Homo sapiens
ctggcggccccggcggcggcggcaggtgtggatggggcgaaggtgcgggaacgtccactcccgcgcgcccctctcggggaccagggcggcctcccaggaggagcttggtttctggtcctcataccgtgtggttgagtgaaatcaaaacttccacgatagcaatgctgattggacaaagaatgtgttgtggacacaaaaccaaactctggaggacagaggattcattccaagggtctgcttgtattcaatgactggtctacgtgggggtgtgaagtccccttactccacctgtgaagagtcttcccagtttcagaccaccctcccagcctcctgttattggctaaggccattttgtgactacactgcaggtagagatggattcctggaaatacctcctcaaggccagtgtagagccctcaatcacccactgcccccagcttctccttctcccatctcctgcaccaagcaggtctccaggtgttccagctgctgatgacgtaaagtgtggagttggtccaggaaggtcatgttccatgcagcagaggagcgctttgtgtgagaagttgaagacctgctgtaacacatcatagaggaaagacatagcctgggccttctgcaactggctgacttccaccttctcctgggggaatctgaagtcacttctgtcctttagacacaagaagggagagattctcctcatttggcccaaaagcaccaaggtgttcctgcctagcaggccatggttctgaggtcttcatagaaccttggatcctaggttctatgaagacattctatctatgcatggctttaatggagcacaaatagttttcatttttctgagcatttctctaaatttttaattccatttattgttttcatttacatgtcttctatatcagcatccacaaccttttggccaccagtttggtggaagataatttttccacgaaaaatggggtcagggagggaatgctttcagaggcattagattctcattaggagaccacaacctagatccttcgcatctgcacttcacaatagggttcctgctcttttgagaatccaatgccactgctgatctgacaggaggcagagctcaggcgttaatgcttgttggttggcctgcttgcctcctgctgtgcggccctgttcctaccaggccaggaccagtaccccggtccatggatgggggttgaaaaaccttgttctatatgacctaaaaggaggtcatcactctacactcttgatttttgcaatggatgttcaatattcccagtaaacttaagatatatcaatccaaatgaatattgatcaatcagatgagaaacatctttgtgctactgttagaagtatatacttttagcccagatcctagcctccagttttaccctccattttgcataggaaatcaggatccctgggccctatgggtttctgtattcagttaggaaattacctatctctggaaattaaactttttaggactatctttgtttgatatttgattcacagaagacgttgatggttattagtgaaagaacttctctggtgcttccctccttctagaatatattcattcaggttcatgtggttatgcttccctgggggctcaagcttagatcaatgaacattgccttttttgcattattttcttactggagaaatatagcactcctcaggctgcgccaatacccctaaaagaaattctgttggtttgtttttttttcttttttaagatgcatatgggtgtggaaattttaatcttaaaataatgttatttcctcagcagtgatgattcacaaggtatttatcacatcaagtcactccctaaatgcaggctcaccacatcctgatgactttagaactccttttccagggaggttcttgcttctttgttgccaaaacaataaatcctttgtgacctttgtccttgctcctagaatatttgggtgaaggagtatatgctgtcagtggtgacctcctcttcttctgacccatgccctaggtatcaaagtctcaacagccctagaacgctgataacaaaggtttgttttgtctaagtaggtaaaggaattatccaattgtaatcattttatcttcagtagttaaataatttttatttcaccaagtacagcttttattctttctttaactcttttgctatctttaattcttttaaactattaacagtttttatgcttaaaatttatgagctatgcacaggagagtcaaagatgctgctgcctctctttagaggctcatattacagaaactggcgaccctcagttgttcactagttcagtgtgatctgttgaagtttcttacatctctgtctacatgaaactttgacggtgcagggcagtgagccccatgctatcacattaaatagtcatagccatctttcctttactgatttgtgattcttcattttaaatttaaagctcaacaacaaatgaatttttagaacacctttttaacatagtggtttactgggcagtttgtcttgctgctaccacattatattctaattcatgatgaagtaacacaaacaaaggaaagtaaaagaaaggcaaaagagctacactgcttttctctataatttccaaaattcgtgtttttcttgtttctcatttaaacttttgtagaaagtactacttgacagttgtttgtagggagaaagaaaacagaagcaattctgattgtcatgaaattgaaataaggggagtgactttccccttactaactgcaaagtgtaagttagcaaacttcaatgcagcaaaaattggggactagagagttttcgaagatcagctacttgactttctttcacttaatccacatgtgatcagctctggagagaaggcagaagtcacaccaaccaactcccaaaagattgacaaccaggctgcagttgctagaacaccaacaatgctctctggcagggtgttagacattaagcttgtctgaagactctacctagttaataaatccacccaggcaatgataagataggcttgaggaacctggaattaatagaaatagaattggatgatcccaaaagtttctattttaatctggatgatgataataataatactaatattaaaaatgataacaccaacatttattgcatgcctaataggaaccatccactgttttaagattttcttttttgagacagggtcttactgtgtcacctaggctgcagtacagtggtgcgatcacggttcactgcaatctgaccttctgggctcaagcagtccttttacctcagtctcttgagtaactgggaccacaagcatgcacgaccatgcttggctaatttttcaaattttttgtagagacagggtttcaacatgtgcccagcctggtctggtgctcctgggctcaagcgatcatcctgcctcagtgttccaaagtgctgggattacaggcatcagccaccatgccaggctgttttaagatatttttaaaatactaactctgtcttctcagtaacactatttggattacacccttttatacaactgtttggagagaaatataaatctggagggatgaactattctgaccacaccaattgtgcaaggtgaaaactttagggagaatcaatataatggcttttctggaagggtcctttaaaggaagtgggggatagatatgaacatagaaagtaaagaagaggacatcaaatcaatggagcagggagagtgagatgactaggattctgagatgcattttgaatgtcaaatggttgctgtctattgctttacagagcaacagggggtgtagtgtaaatgaattgaactgactgccttaagttcagtggaaaagtagatgaaatacattccttttttttttttttttttttttttttgagagagagtcttgctttgtcacccaaactggagtgcagtggcgcaatttcagctaactgcaacctccacctcctgggttcaagtgattctcgtgccttagcctctggagtagctgggactatcagtgcacaccactatgcccggctaacttttgtatttctagtaaagacagggcttcaccatgttggccaggctggtcttgaacccctggccctaaatgatccgcctgcctcagcctcccaaagtgccaggattacaggtgtgagcctctgcacccagccaatgaaatatcttttaagtagtaaaatgaagtagatttgtctgccaattaaaaaaataaatcataacatttaattagtgatttcttcaaaaatatactaaaacaactctattaacctatcaactgcaaactcctagaagccaatttattttttactcttgagttttcttgtgtatttaagaataaagagaaaacaactaataatttctgggacagcccagccatatggactctgactttctcctccttcaggactcacaggtcagcctgctgctcttattgccaaggagaaggatatttctatccccagcccattcaggacttaatcttgtgtactgattgtgtccagtgaagaatctcttcccctctttctctttcggtccattggttgagttgtgagtgctgaaaagatcattcatatgaccaagattgtgatgcttagatgtttatccccagcaaacatgtaaactatagaaatctcagttgtctccaccaaacatctaaactgtatagcatctaagcagcctgaggctgcttagatgctatacagtttag

SEQ ID NO: 2007 - DNA, 10480 bp, Homo sapiens
caggcaggcctccttgagctgtggtgggctccacccagttcgagcttccctgctgctttgtttacctaagcaagcctgggcaatggcgggcgcccctcccccagcctcgctgccgccttgcagtttgatctcagactgctgtgctagcaatcagcgagactccgtgggcgtaggaccctctgaaccagaatgtgattttgaagaaaggaggaaagatgtgaaaagtgattggtcagccacattcatggtgttgagaaaagaatttgcttttctggaacatagcctgtgatagcagaacaacacctggcaagaaacaggttatgtttggctggagagtcattggcactatcaagaaatattaaagtgtagatttgagagaggaggagaaagacccaagcaaaattgaaaaccaggtgggacccagacagcagcaaagcaatggaagcatgtattttggtcaatatagagttaatacacaattttgcccctcttcttctgatcatgggactcatattaccagtcttcacatttcctttaaattcaggaatcaggaagaatttccagagtttgcagatggacacatttgctgcttccattctaaacataagttagaagaacctttcaactggattccaactttaatatgtcacaaacataaaaaagaaagctatttcctggacttttcttcattagaaattaatagattgtcaattggcatagggaaaagataatcaacagatgccaaccccaagttaacagaaatgctaaaattataagacaaagacttcaaaatagctattttaattttgcctagtgaggtaaatgcaaacatgctcactatgaatgaaaacaggtaatctcagcagtcatgtaaactataaaaataagcaaatataaattttagaattaaaacacaatatctaaaaataaattcacctgatattctcaatagaaaaaatggtaatgcagagaaaaatgtatgaaaatatggcaatttgaagaagagagaagagatcaataaaataaataagtatatccttggagacctgtggatgttttttgaaaagtgaatcatgtaagtaattgaagtcccagaagaaaagaaaagaagaggatgagcagaaaaaaatttctgaaaaaatatctgaaagcttaaacactataatgaaagacacacatttacaaactcaagaagtttagtaaaccaaaaacaataaaatcaaagagaactgtgccaagcgacatcattttcaacctgctgaagatcttgacagcagtcagagaaaaaagacacacttattacacagagaggaacaatacattaaatactagcacacttctcatcagagatcattaagcccagaagacagtggaatgagatctttaaagtgctgaaataaaataaatgttgattaaaaaattctatagctaatggaagtgttcttctttaaaaattaattgaagccatgtgttttgatctatttctgaactctgtgtttggttccgatgatctgttgatgtatccttgcaccactatcatacagctgattgcggcagctttatagtaagtcatggaatcaggcaataagttcccccgatttgttcttttgtttccccgagtcataaaactgccattttttgatggtcttccttcatgtgctgcaacatggaaagttcttctagtcagaagtttgggtaaattatagggcttgctttggttgcttctttctatcagagatgttcttgtgctgctttgttgtttgtttaggtttgtttgtttgtttgtcttttggtactttgtctaagaacagttttattctgtattttttcaaatttgtacatatttatagctaattccagcatcaattacctcaccatagccagaaatggagtttgcatgctctcacattgcagtatttaccatacttaagatattcactctcatcttatgacccatacgattttgttgctcacttttcatttatgtttgtaatacacgtgcagaataatcatcccccaaatttttcatatttaatttccttagattgttctgaagtcaaaataacaataattactccaaaactgtgtttccatctgctatatttggccctgccaagtatgatgctgaagtttgatcccgaatgttggatgtaggatctgttggaaagagtctgggtcatgggggcatatctctcatgaatagctggatgctgtcctcatgataataagtaagctctcactctattagttcccaaaagagctactcgttaaagagcttggcacctctctctctctctctctctctctctctctctgcctgcgcgccccccaccccaccccgcaccgcccccccacccggccaaccctttctgctttcaccatgtggtggctcccatttaccttctgccatgagtggaagcagcttgaggccttcaccagatgcagatgctggtgccatgctttttatacagcctgcacaaccatgagccaaataaacctctttttataaactactcagcctcaggtcttcctttgcagcaacacaaatggactaagacagcacctttgtaagctttctttacaattataaagaaagaacactttttcaggtataattcataattgattataattttaatgaacaaactaatttcttaatatatttttaaccttatgagaatgtcaccattttgcattgtgtattactaggctaatgacaagaaagatgagcatattgagatgagcacaatatgtagattagaatttttggttaaattaaataaaaataattttatgcattatataaatagagtttttatgtttcagatagacaacaatggtgagagaactgagtcagtcatggtacaggcaaagaaaaagattatttttacagtgacagaagtattggacattggagtgtcataaaccatttcacattctctttgcccaaatctgaacatcacatgtaagtgaactgccaagctgggcctccttcccttcttttattgcagttgttttatttccagtaaatcttccctgacagccctaagacatttggcaagtgtgagtctagaaggcaggacaagggcatgtagataaagaatgacttgaaggaatggaatgacaggcagcaatagactatttcacttagcacatgaaatcctttccattgttcctcctctgcctttctggcacttgtgctctcaagacaacttgcaaattatgggatcatctattttcacttgaatgcaaaaagatttccagttcaaaagtttatttctaaaaataaatagagctcttcaccaacatcacacgcatcatgagttaccaatgtatgttatctcagaaaaatgaccagttcttcctaagtctttcattttattgaatatttcatttaaaaaccacaaaagaactctggtaacactatcacctacattcaagtctaacatccgagctagagaatgaacaaggtttattccctgacatttctctagtgagttgaacattgctaaggaagactgggcataaccattttaagtaacatgatgtcagccctagaaattattagtctgaaatttacttgtgttatttttctcatctgggcatatgcaacagcatggctaattgacattaaatttttattttgtttcaaatcttttaattggagagaataatgtagttttccttcagtggaggtggggggcggaaagcattgctggaaaggatttcaagatcagtcctttttgttgttgttttctgggggcatggaaataattgtgatttgaagtttctgtttgaaaaataaaagcgtccagggagagaggctaggaaaaaggcagggaaataagtgatgaatcttgaagtttagaaatgtgggtcacatccctgagaatgttgtcataagtgacaccctggtttcaaaagttttggatccaggaacaagaagaaccatgaagatgaggattatgaaagtggtgaagggaactgactctaactctatggtctagaaaataactcacagggacagcttgcccacggaacaggaataaatattgtctcatatgaactttatattataacccaggtgagaaattaccttgaaatcttggcatagaagcagcctcctaccagttctttgtgtccctgcattcttaattacatggctattctatgggaataatttctttttgaatgactgaagacccttgggtccaaaggacacaactgcacatcagtcatggtaaggaggagggcaatttttttcctgtccattagggctgaactgagatttgctaagacatcctgagtaggtaaggaaggggagcggacaccgatattcgccatcatgtaggagacgttccttgttttgctctgaggctccataacccctgctgcactggcagtaagctgatttttctttggggtattactcattcctgcccaactctcagactggagaaggtggcaagggctaaaagtacccacaatgacatttttttaagtctctaataatgtatgctctgtctataactaagtcttaatcctgagttttcagttagttaagccaataatttcgcatttaaagtcaatttgagttggtctttctgcttgctatttgcctctaaaagagattctgaactgatacatataatatttatttttggttattaactgtcactctcttgaacactctgtaatctgaggaacttttagaacctgaagttcaaataggtctacccattgaacattggaacccctccaaatacaatgccacagtaaacacataaaatacaggcaaaggcaagaatttggatccatatattgcccagtctattcaccacttattcaatctccttacctattgctttaggatttttttacccctgggctctttatacttttgctttctctatctgctttcagcctttgttttgaaaagatgctagcctttccctctgtggcctactgtccttagctcaactgtactctgtattcatagagtgtctggggtgtaaactcttgtctcctggttttgggagctaatccccagtctcttcattgcatcccaccctcaacaagaaacacccttacctagataagaggatttctgcattgagttttagagatgtcactcttcctgtggaaagacttaattattaacttagaaacattcaactgtataaagctaagggaatcttagagattattgtatacatttcttactttagtggagagaaatctaaggtttagagcaattgtatggattgttgagatcacaaaattagttgtaggtatcataaaccattactgaaggtgattttattgcatttaaaatgtaatttatgtcctctcataataatataaaaagcaccaaagcactaattgggagcaggggacttctctgtcttgtgtgtacctgggagcgaataactgagtactgagtgaaattggaagctctttttatctggtaatactttctaacgctatctatgtttagacagagaaagttagtgacgttaaggctagtttaaatcgtcaaagctttctgggtaatcttatgacgatcttctggcttatctcccacttcctgctgctcatattattttctgcttaaaataaggactttataactagaactgacttggagctgtttctcaagaaattatcacctccttcaatttctgaccttaatatctagtctctattcaagcagaactgttaacttgccaaaaacacaatattcctcatatttatcctatttatccatactgcatttactttttggttcatttaaaagagctccttggggaataatagatgaactagctcaggaacacacacacacacacacacacacacacacactaaactggccatgtctatggaaagagaagggaaagtgtaaaaatgaaaaatgttcatcttgctctcaaagtgaatttgtccttttttggatgaaaacctggggcaagtcctggcttcaaacttacttattttgtgtctctgagaaactgttccacctgtgctctgaatcacatcccctcctcccttctcaagaactacagataatttctttcttatatcttttacctcttgctgcttacccaatccttccaatcagcatttaagtttctcaattgtctcctaccttaaaatcacacactcattaaacaaacaaaaatacaaaaattctctcccctcaattattatcccttgtctgttttctccctcctatagacaaatttcctgaaatacctactcaccatatccagttttattcttctcctcacttctcagcacactccttactgacttctgtttccaacacacactgacaacatcttctcactggtcaccaatgatctctgtgttgctaaatgctattggtctatttttatctgattattctgagacatcttagactacatattgcacagtagctctcttctggagcatcacactcttgtggttttcccctgttctgacacttccttctaagtcatctctgctgactaacacacatccacgttgtcatcaacctagcttctgtttttataaaatggcagctattctacttaattgcaaggattgttataagaaataaatgagatactatataggaaattccctagaacctactcacagaatataattgactttcaaatgttacttataaaaaataagtaaaaacaaagatttaaagtctattaaatctattgttaataataatgtagcatatacttgaaatttggtgaaagagtagttcataagtattctcaacactacacacacacacacacataaacaaggtaactatgtgaagtgatggatatcttaattaacttgattgtggtaatcattttgtaatgtatacatatatcaaagcatcacagtgtacatctttaacatatttaatttttttttttttttttgagacagaatctctctctgtcacccaggctggagtacagtggtatgatctcggctcactcgaaccctcctcctcccgggttcaagcgattcttctccctcagtcgcccgagtagctagtaccacagttgtctttgataacgtaagtcaccgtatcgcaaggccctttggcaaggaagtgagagcggcctcctcataatagtcagcaagaaactaaggccctcagctcaacagcctgcaaggaagcaagcccagcccacaaccctgtgagcttcaaagtggattcttcttcagtcaggcttccagatgacagcctagcccttgatcgcagtctgtgacagacactgaagcaaagcatccaactaaactgtgtctggattcttgtcccactggagttaaaataataaatttgcattatttaaactgctacgtttgtggtcatttgttacacagcaataaataatacagcatgagggcaaatcaaagctcttcctagaaatgtatgaacagcaggatagcaaagcctgtttccccttgggtaaagaaaccttgcattctggcgtcacaatgtaggaacaatgtctatttacagtaggagacattaaatcctacatttaaaatgtagaagagacaaatggacagatgaagtggaaaaagaggaaggaaaaagagggagaaaaaatgttggtagctgaccctgacaccaggattcttccagtttgtttttatattattgttagttctctgacaaaattcctcagccattgtctcagtttcatgagtcaacaaatgtattgcattgcttaaactagtttgagttgagtttctaccacttaaaacctaaatttttctacaaagagaaagggatgttaatgaagaaaaacagaatggtattcctccaaattgtataactatcctcaaagttagtgtatttatgtgagttcagaaagtcatgcacattactattcccttaagaacaacttgctgtctaagtattaaaaacatcatcctaattctgccacttatggctatgtgacttggttaagtcatgtaacttctctatacttgtgttttctcttcaaagagtggaaataatattactgtaacttgacaatgttattgtgagatataaattagtacattatttttatgcaatattactgtgtcaacaccagagatgaaataaaaactaaagaaatgttagctgctatcattactatcccctccaagaatgcaaaaaagggattctcccactagaggtatgaagtttattgaagattacggaattactggtagaaactagtgactattgtaatgtctactgttcttacatcttttgtggtattttgggggcaaatgacaagaggtattttcattggacctcaggattcttcactggacccgaggattttcatttgtcagaggataggaaattcataaatagaaatttgcatgcttaataagcaccactttctacataaaacatttctgaatgatttgaggaccttaacataaagctcctttaggttggggggtggcatctaatacatcatgaatacataaaggtaagtattgaataccttaactccccttaagtaaggcattcctcaactaatgttttgttccatatgtgtttaagtgaaagaattagggaacttaaaatgggccacagacataaatacaaaagctaactgtaaaatgtgtggaagaaaatacaggtgagatttttggggactgtgggatagacaaaggtttcataggcacaaaaatcaagaatgtataaaaattatcaagtggactttgtcaaaattagaaacttttcctttttgaaagctattgttaggcaaataagaacacaagccactgactggaagaaaatatttgtaactcattggatacaggaagacttgtatctaatatataaagaactcttcaacactaaaactggaacaagaacaactcagaaaacattggcaaaaggtttgagcagacataagatacaaaaggcctatgaatggttgattatcatgtggaaagatgccaaaaatcattactaattaaggaaatgcaaattgaaatctcagtgagataccagtgcatgttcactagaaaggctaaaatcgaaaccaaccaacaaacaaaaataatgaatattgattgtttgtgaggatttggagccactggaactttcagacatgacaggtgaaatacaaaatcatactataatacttgtttggaaaactgccctgaagtttcttaaaatgtttatatatcttaccataagatcaaggcattccactcaaagagaaatgaggacagatgttgcacaatgtcttgaagacaaatgttcttaagagccttcttcacacaagccaaatactgtaaatgactaaaatgcccacaagcagatgaacagataaacagaacaagatctatcatacagtggaatgttattcagcaaaaaaataaaaaaaaatgaggggaaaaacagtgactagtgggatgtttgtaaagatgtattcatttgtcaagttcactgaattctgcatttcaatatcatgcacaccttaataaagttgatttgatgtttaaataaaaatagtttttctatgcagattgttaattgagttttaatatttctgcagaaatattgttaaatgaatggtctgctgcagcttgcagactctaggacagttaaaccactacataacccagccggcatgcatttgggatatatctgggtcaagtgattttcaaactgtgggagaacaactttcgtcattaaatttttactcaataaatcatgcctggtgttggttttgaatccttttacttcaccaatcttaaattccacttaagtaaccatttttgttctaaagcagacagcttggcatgtctaactttttcttccaatttgacatcaggaaactgtaacctcttattattagcaaaactaattcaaaaactctctaaagtgtggtataaaaataatctctttagtgatgcaacaaaaatccctcgagaatttaaaatgcgattcaagcgacattatagcaagacctataaacatttctatgcctgcaagatagaggatccactgcagtaataacttctactacttgcacaggacttcacaatttaaaaaagcacttctaccttttatctctcctgatcattgtaataacattttataagaatattattaaatattaaagtattaaatgtttttaccaagaactaaatattgattattggtgaagatttggagctccttctcatacatggctggtagaactgcaaaattgtacaattacttcttggaaaattgctctgcagtttcttttatttttctagatgaaatgatttttattgtagagataggtgtatacatacacctaatcaaattgtacactttacatatgtgcagtttttatatattaagtatgcctcattaaacttgttttcagattttgcattaaataaacaaattctgcagtttcttaaaatattcaatgtaccttaccataagaccaagtcattctgtttctag

SEQ ID NO: 2008 - DNA, 10480 bp, Homo sapiens; identical to SEQ ID NO: 2007

SEQ ID NO: 2009 - DNA, 818 bp, Homo sapiens
gccattgtcctgaattcacctactaattttaccctcagagaaagagagagtctttggagagttgtgaggagataagtgacataaactggcatgttctgaaagaatcactctggatgctgtgtggagaaaacactgaaaagaattctagagtgaaagtttcatgaatataagaagcaagacaaggaagtggcttatgcttaaggccttaaaggcaaccactgtgacaatccagccattctctggagaattcagcagaaagccagttggaaggtttgaaatggaaattacaagcgcaatattacagaagtgtggattttagttacaatgtctctatgagaaagtctaaaagttaaacataagcaaaacaacaaaaacatctaaataccagacactatcctcagaaattagatttgaaaaatgagcttcattttcgaagaacatattggggagaataattgactccattcaagtgttcgctcctgtttcaatcaactatggctgaagagtgaggagacatttggaataaatatggcttctgggggcccattcctatggatcagcagctggcttctggaggcccattcctgtgaatcgtcgatctcatagaagataatattgttagaaggcttacctcattgatgctgaacatcctaaaaagcttctgctgctttgagtcactgaaaaagaccaagaaacatgaatttaaaaaaaaatttcaaatgttataaaataaataatatgaactcattatacctacaatgaataatttaaattcttctttggtagtccaggaaaggcaaggcagggaggatcccttg

SEQ ID NO: 2010 - DNA, 867 bp, Homo sapiens
ttgtgatgcgtcacatagttcctggcatgccattgtcctgaattcacctactaattttaccctcagagaaagagagagtctttggagagttgtgaggagataagtgacataaactggcatgttctgaaagaatcactctggatgctgtgtggagaaaacactgaaaagaattctagagtgaaagtttcatgaatataagaagcaagacaaggaagtggcttatgcttaaggccttaaaggcaaccactgtgacaatccagccattctctggagaattcagcagaaagccagttggaaggtttgaaatggaaattacaagcgcaatattacagaagtgtggattttagttacaatgtctctatgagaaagtctaaaagttaaacataagcaaaacaacaaaaacatctaaataccaggaatttgttatctcgattatggagggcgacaagtcccacagtctgccatctgcaggatggagaaccagtctttatagggggagaataattgactccattcaagtgttcgctcctgtttcaatcaactatggctgaagagtgaggagacatttggaataaatatggcttctgggggcccattcctatggatcagcagctggcttctggaggcccattcctgtgaatcgtcgatctcatagaagataatattgttagaaggcttacctcattgatgctgaacatcctaaaaagcttctgctgctttgagtcactgaaaaagaccaagaaacatgaatttaaaaaaaaatttcaaatgttataaaataaataatatgaactcattatacctacaatgaataatttaaattcttctttggtagtccaggaaaggcaaggcagggaggatcccttg

SEQ ID NO: 2011 - DNA, 1316 bp, Homo sapiens
caagtgtaaaagaaatcagatcttattttttcctgatctgtagccaaacattcagttaaaaggtgaacttttcttccagcaaagaaatgtttcttgccaggaatgtggagaatgtgattttgaagaaaggaggaaagatgtgaaaagtgattggtcagccacattcatggtgttgagaaaagaatttgcttttctggaacatagcctgtgatagcagaacaacacctggcaagaaacaggttatgtttggctggagagtcattggcactatcaagaaatattaaagtgtagatttgagagaggaggagaaagacccaagcaaaattgaaaaccaggtgggacccagacagcagcaaagcaatggaagcatgtattttggtcaatatagagttaatacacaattttgcccctcttcttctgatcatgggactcatattaccagtcttcacatttcctttaaattcaggaatcaggaagaatttccagagtttgcagatggacacatttgctgcttccattctaaacataagttagaagaacctttcaactggattccaactttaatatgtcacaaacataaaaaagaaagctatttcctggacttttcttcattagaaattaatagattgtcaattggcatagggaaaagataatcaacagatgccaaccccaagttaacagaaatgctaaaattataagacaaagacttcaaaatagctattttaattttgcctagtgaggtaaatgcaaacatgctcactatgaatgaaaacaggtaatctcagcagtcatgtaaactataaaaataagcaaatataaattttagaattaaaacacaatatctaaaaataaattcacctgatattctcaatagaaaaaatggtaatgcagagaaaaatgtatgaaaatatggcaatttgaagaagagagaagagatcaataaaataaataagtatatccttggagacctgtggatgttttttgaaaagtgaatcatgtaagtaattgaagtcccagaagaaaagaaaagaagaggatgagcagaaaaaaatttctgaaaaaatatctgaaagcttaaacactataatgaaagacacacatttacaaactcaagaagtttagtaaaccaaaaacaataaaatcaaagagaactgtgccaagcgacatcattttcaacctgctgaagatcttgacagcagtcagagaaaaaagacacacttattacacagagaggaacaatacattaaatactagcacacttctcatcagagatcattaagcccagaagacagtggaatgagatctttaaagtgctg

SEQ ID NO: 2012 - DNA, 1316 bp, Homo sapiens; identical to SEQ ID NO: 2011

SEQ ID NO: 2013 - DNA, 1316 bp, Homo sapiens; identical to SEQ ID NO: 2011

SEQ ID NO: 2014 - DNA, 1579 bp, Homo sapiens
gtgaagcacaacatttcatctctttgattctagacactatcctcagaaattagatttgaaaaatgagcttcattttcgaagaacatatttctttatagggggagaataattgactccattcaagtgttcgctcctgtttcaatcaactatggctgaagagtgaggagacatttggaataaatatggcttctgggggcccattcctatggatcagcagctggcttctggaggcccattcctgtgaatcgtcgatctcatagaagataatattgttagaaggcttacctcattgatgctgaacatcctaaaaagcttctgctgctttgagtcactgaaaaagaccaagaaacatgaatttaaaaaaaaatttcaaatgttataaaataaataatatgaactcattatacctacaatgaataatttaaattcttctttggtagtccagcataggtttagaaactatgaaaaccctagaagaaaacctaggcaatgccattcaggacataggcacggacaaagatttcatgacgaagacgccaaaaacaactgcaacaaaagcaaaaattgacagatgggatctcattaaactaaagagcttccatacagcaaaagaagctaccatgagagtgaacagacaacctatagaaagggagaaaaattttgcaatctgttcatctgacaaaggtctaatatccagcatctacaaggaacttaaataaatttacaagaaaaaaacaaacccattagaaaatgggcaaaggacatgaaaagatacttctcaaaagacatacatgtggccaacaatcatacaaaaaaaacctcaacatcactgatgattagaaaaatgctaatcaaaaccacaacgagataccatctcatacctgtcagaatggctattaataaaaagttaaaaaacaacagatgctggtgaggttgttgagaaaaaggaatactgttatactgttggtgggaatgtaaattagttcaaccattgtgggagacagtgtggcatttcctcaaagacctagaggcagaaataccatttgactcagcaatcacgttactggatatatacccaaaggaatataaatcattctattataaagatacatgcatgcgcatgttcactgcagcattattcacaatagcaaagacatggaatcaacccaaatgcccatcaataacacactagataaagaaaatgtggtatatatacaccatggaatactattcagccataaaaaggaatgaaatcaagtcctttgcaggaacatgaatgaagctgaaggccatcatcttcagcaaactaacacaggaacagaaaataaaataccacatattctcacttacaactgggagctgaatgatgagaacatatggacacatataggggcacaacacacactggggcctgttggagggtgctggggggaggaggcagagcatcaggaagaatagctaatggattctgggcttaatacctaagtgatgagatgatctgtgcagcaaactaccatagtacatgtttacctatgtaacaaacctgtacgtcctgcacatgtacccctgaacattaaaa

SEQ ID NO: 2015 - DNA, 8337 bp, Homo sapiens
gcccttttgacatggatcctgcagtaatttaggggctttctctaactcacgttctcctgaaataaatgccaaggtcttcgctgaggagctagatgagcttgggggtttggtttccccaatttgaagcacctctattttaggttcctccattttgtggcttatcaaaaagtctgtgacatttccttcaggagatgaagtacaagggaacctgggacgtcatgaatttggcctgtggagttgtgcgtgtcaaccccaagagaagcgtgagtcattattggaagacaactagaaagagggtccacggatgactccaggagtctgggttggctgaaaccccgggaagaaagacttctccaatgtacactgatggtgggctcttcgcctttatggctttctctgctatcagcaagggctgactcagcatcctctggactgtgagccaatgctgctatttcagagggggccaattcaggcacaacagcatctgcctttagactatcaggtacagcccagaccttgtcaggaattatgagaccaccgtctgatgccttgctctcagaatttgtcagttgtcgtggtggccagatttcagaagcggaagcctctagagttataatcttcagcttgttgcctgcctcccaatttccaggtctatattctttagactcttccaaaaggatatcagagagagatggaacgttgctcagagcctgactgtcttcttccccagcagtttcagccaccacggagaccctcgtcccccaacctgagcgctgccctgctccttccctagagcttgcgggtgagtgggccgtgggcaccaagtttctttcctcttgtgcagcagatgtcgtaggcaaactttgttggaaatcaggtgcagaaagagaaccctgctgggacaggctctgctgctggaccccctgctttgtttcacttcctctttcttggaaattctcttcatagctcctaaagtctgctctgtccacagtctggctcttatctccagacaggttatcaacctgaagaggggaattactgcagaaaccctctccctctgggagctgcaggacatggtgtgggactcctggcacactgggtgccctgcaaagtagctcttttgtagatttgatggtagcaccacttaaaatatgatccaactgcacttgggaaggaaattgggaaaccttttcatgggatgcacgagggaacctctcctcagtgccacctgcatgcttgtcctcaggaattgacacagcaaggtatttggctgggtggacttcggtggcaatggtaacagttgatgtgtcctcagtctccctggtcgcttgaaagcactcattattagcagttaatgttgttggcttctcccaaggaaaactcacaattgaactataactggctggtgtggctgtggtgtctgcggcactaggactggggctcttgtcacctccttctttaaattgcactaaaggattgttctcagaagaaaggagctgtgtttcatcaagccctcctgagttgctggggcttggctgctcctggccagcatgtactgtggaggccagtgggtaggtggaattctccaccttggctagattttctcctgtggcaccttcactagctgtgtgtgaaatgttcaaggtgaaagtactggtaaaaagaggggacatgactgagttgccgtccttgctgcttttgcacgtagacactgaagtctcagacacttgtgtctgaaaaaagacttccagtgtcttgtcattagaagaacataaatcagatactttgttttgaccttctgccagttccgtatctacagagcaaatttcttgaggcgaatatttatcaactggtctcccaacaagagaatctatggtatcaaaacacgttccttggtcaccagcctcaaaacactccattgcacacactgcttctctgtcccttggctcatcacacacattttccagggtgagggcagtatctgtgggttcaggggaagcaacagagacagccacaggctccctgaagtcagcacgagcatccttggggagatgccttgagaacacacctggggacatagtctcatcattggcttctgagatgctctgctcatattttaggtcttccctgaaattgtcaggtatgttgccatctctgtcttgtttttcttcatgctgtggaccacaggtacagggtttgacctccgagtgttgagctaatgatgcattttccttgtggacccctcctaagtttgagaaggaaattgttgtggtcccagtgaatggggactcctccccagcaggctctgagaaagctggcatctggctgcaagagattgtctctctgactgtttcctgaacttgtacctaggaagatgaaaagtgatattagtagaattgttcatgggagagcccacaatagggcataactgcaatcccaagagtgttaatcctcaatgaccgtaataatggacaagaatgattgaaatctaaacattaatcccccaactccctctagctagaaatagatggaaataaatcgaatgttaactgttttgatcaagtaagtcacaacaagagctgtgcgcatctttccagaaagatgaatctcacatgatcataataaatgaaataaacagtacttgcaaaacagcaataagcaatctttgtccccaaaatataacagcttgctggttaataattgctatggtttggatatttgccccctccaaacctcatgttgaaatttgatcctcagggttgaaggtggggcctaatgggaagtgtttgggttatgggggtggatctcttacgaatagatttatgccatccctcaggggtggggggaatgagtgagttctcaatctattacttcctcgttgttaaaaagagtctggcaccatccccacccccaccctgcttcctctctgtccatactatctctgaaaatgccagctcccctctgcctcccatcgtgagttggaagcagactgaggccctcaccagatgcagatgcctaatgttgaactttctagccaccagaatcatgaaccaaataggcctcatttcttgataaactacccaatctcaggtattctgttatagcaacatgaagtgcactaagataacaatgttactaaaaaacagagagaaggctgcctttgaacccacctctaatgaataaatggacttatgattggccaccagcactgccaatcatttctttcctagagaagcttataaacatcccagaatgtatcccagactttaaaatagatgcccagtggcaggcagaccacctctacaggaaatagaagattcaggactgcttaggtttttgagaaaaggggagagggggagggagggaggaagagaggaaggcagagaaaaagaaacctcacattctgaggattgagcctttcatggtactatatgaacgttccatgatattggatattgttcaaggaagcagcaaactctttgactaaatccttgtctcatgaaacttttagctcattgattatttcaaaacaaagaaaacttatgtccagccaaggagaagaaaattacttctaatttctgaagcaactcagtctttgctcccaggactcctgccttggacagccacattcagatgtgcagggaacagatgactggccttggcgggatggggttcaggggtggggatgaagtctgtctcccagcgtatgacaaaacagagctgaaatgttcatgggcatattatggctccaatgtcatgagattgattctcataaatcatacatgacagtcagtcttactaccttgtggtcaatccctgtatgtactgcccgtgggaagcaggacaacagcataatcacacctctttccacacttcccccaggctgcttacagcctgtcagtcatgcatctctcattttctcttttaaagctactttgaggttcatttaactcatatttgatgggcataaaaatgctaactaaacaagaaagaaatttaatataaactccatgagggctaggactacttaatcttttcaacaaatatttagtgaatgcctccaaagtactagggagtgttttagataatggggatacaagacaggcaaatgctcatctacaaggagctcccattctgtgttctagtgaaggcctgttatagcgattagcatgcggtagatgcttactaagtgtttgttgagagaatgaataaatgaatgaaccatgtaccagttgagacagctgtagccaacttcacccattaaagctctacacttgaaagggtttgaactttcatctgctcctgactttgcaacaaccccattttaaaagagactttgaaccctaagcactactggttatcctggtgttcccggaaagaaaagtatatttattccctttctatatccctttttcttctttattaaaaagaagaaatatcatttctgggaaataagggataaggtatttttttaaaagagtttgatgtgcatatgctttcctctctatacctcaatatctgtaacacatgtaaagagtacttttctggtttggtattttggttcagccttttaagaatatgctatagcacaaatagactgagtcattaagcacagaaaacatggggaacttcctggtcattatgtgaaatgtatagagagactgccccatcaaaagcaccaccacccctctctccggcctttctatcctgcctgcatttccactacctatgtcagtcccttattttaaggtcctggtattatcacagtatcatcagtgtcaacagacatttatggagtagctgtcatgtgcagaattctctgtcaggcactgggcaattttttccaaagggcttcagttaaaaagttactatgatatttactgggatggtacctttattcttccgtgattgattactattacatcagcaaagtaataagcgggtacctagaagagactgacctctgaagagaattaaacacaggacaagttttcattaggatgagcttggtcactggaatagatcatcatagtatcatgccgtgatttacaaaataatcatattccattgagatttatttgcacctttcctcttgtattagtcagttcttgcactgctataaatacctgagactgggtaatttataaatgaaagaggtgtaattggctcacggttccaccggctatacaggaagtatggtggcaactgcttctggagaggcctcagggaactttactcatggcagatggcaaagctgaagcccacatcttgcccgacaggagcaggaccaagagcgagcaagggggaggtgccgcacacttttaaacaaccagatctcacaagaactcactcattgtcacgagaccagtaccaggagatggcgctaagccattcatgaggaaccacccgcatcatccaatcacctcccactgggccccacctccaacattggggattacatctcagtgcaagatttggtagagacacagatccaaaccatatcgcccctcttacttttaaattaaaattctacttcaaaataccctagtgaatctccacatgtaaaaaaattggttgaatccttgaccgtgtaaattcatacatttgacacacatttagtgaccatctactttataccaggcactgttctaggcagctgggaaacatcaatgaacataacagagattgctggcctgtggaagttacgttgaagcaacaaaccgtacaactggcccgctgctgataagcaattccataaatttgattttaaccaatggggttttttttgaagtgaagcctttaacagcccagttcatatttgtacttgcttacggcatcagtttcaagagcaggctcctcggttctcatccagaggccagctcacagagaaagggaaaccacagactcacaccttcccaatgagtcagacctttcttttaggaggagatttcttagttaagtcattacaaaagaatgctagcaaatgattcttctgctgtgcacctattctcagcatagaatgagtgctgaaacttcgagtgagtgctgacacaatttccttatgtagggaaattgtactcattcaagtgaaaaaaggagtgtttggggctctaggagtaagcccaacatagtgtgtggtgcgtggacttggaggactagcaaccagcgtttgtagcccagcttaattggatatagcatgcatgaccacgggtaacctctttagcttctctgaccctctgtctcctcctctaagactaaccacatgcatgtctgcaccatcttgtcaagtgcctgacatattgcctggtgcccagaaggcactcactcactgatactaattttccttcttctctgtgaaaaaacagcagtagctcaggaaaagaggaagttggggagctctgacaggcagagccttgagctatgagctttatgagggttttctcatctgatccgtaaaataaatctgagaaaaagatgttatcatctcttctttactgatgagatgaatagcctaggtccaatcatagaaaccacacagtaggttatataagagaagttcaatataaagaactattgactgtgatagaagagtgctataaggtataaggaaactgtctatagtactctaggtaagggaaagtaccaaggaaggacaaagttggaagaggtttagacctacttggagaaggtgtggttaggccaccagatagcacagaagttcactggtgcatccagaccagagctggcctggaattgccgagaaaagcaatagacctcccttccaagtgcaggccaggagtaggtggtcagcatgcagtggcgtgggtgtgcaggggagtctgggcatgggtggtcacaggggctgaagccttcagagcttgtgggctacatgtggtgtgggtcaggagtttgcagagtgctagtttgaatgtccactcaaaactcatattgaaacttaatccccagtgtggcaatactgatgggtggggcctttaagaggcgattgaatcatgggagctctgccctcatagagggattaatccatttatggattaatgaattaatgggctgaaggattgatacgttatcaagggaggggacctggaggcttcataagaagaggaacagagacctgaggtggcatagagcgtgcttagccccctcgccatgtgatgccctgctctgccttgggactctgcagagagtccccagcagcaataaggcctgcacaagatgcaggccctctgcctgggacttctcagtctccagagctgtaagaaatacatttcttttctttataaatttcccagtttcaggtattttgttacaagtaaagaaaacggactaagtcacagagggaacaagtgctctgtgcaccagacctcaggcggctatgtgtagaccacacaggagcttgtggaggcagtctgtgcgttgatacaggcaggaggctttaagagctgggggccatgcggggctctgggttccaaagagagagggcagcagaaagggtatcactacactaaggctacaaggttgcagatgaccacgttctggggcccatggctgaggcaggatgaccacaggctctccaactccaccaatgctgaaatgacaggaattctcttcctcctgcagtgtccttccagtgccttctgctgagaaagcgtaatactgtgcttactttaaagaagaataatggaatttcgttagtacagggcacatattaaagggtgaattcagagctgagaggaatgaattaaaaaccgacacatgaggtcaatgatgtttggggatgagaagtctccccagggtcccacagtcaaaggcagagccaggatttaaagccaagtctgtgaggctacagagccctttccaacccagcatttctaatcaggtaagttggaataaacctcacctcaccaagggctgggaacttcccctaatttaagtccagaacttctaagctcctgaaacactttggatatgaaactgcaaatgtccttcttaggtgcaacatggccatctctcaatttctctacttccctacaaggtctaagggtagggactcagttattcatttctgagtctccagagcctagcacatagggactcaaataattttgctgaatgaataagcagatgaatgaatacaggaggggaaagggtaaaccaaatttagtaatgtttccaagcctctttttgaaagcagcattaagcttggaaacttaacgcttgaatagcatttttcaattgaaaccccattcaacatgcctctgattccacaaacatattattttcacttattggcctttccaaagttctgcctcctaggaa

SEQ ID NO: 2016 - DNA, 8337 bp, Homo sapiens; identical to SEQ ID NO: 2015

SEQ ID NO: 2017 - DNA, 8337 bp, Homo sapiens; identical to SEQ ID NO: 2015

SEQ ID NO: 2018 - DNA, 8132 bp, Homo sapiens
ggctggagtgcagtggtgcaatcttggctcactgcaacctccacctcccaggttcaagtgattctcctgcctcagcctcctgagtagctgggattacaggcgtgcgccaccatgcccagctaatttttgtatttttagtagagacggggtttctccatgttggtaagtctggtctcgaactcccgacctcaggtgatctgcccgccttggcctcccaaagtgctgggattacaggcatgagccactgcgcccagcctacttctattattaaaagaaaagacagagaattccaatactatgacactgctaaaaaggagcctgactttgatttgctaatatcaaaagattaaagtgaagatgtacgaagtgggaaaaaaaaaagttgcagaaatgtattgtcctgcaaggctccaggtagcaccaaccccaaggctttgatgaccaaaaagctttgggcagaggccaaccggtgtgctgatacagaagggatggtccaccccctttgaaaccaaagaggcagccctgatcatctctgaattgctgttaaggtcgctcttcccttgtcatgaagaataatgtccagatcattcttcccttgccttgaagaataatgtacacttgcagcccaatagctctacggtcttgtcctgtaaaataaaagaactccgacctctatttctccttcattccatccagtctccctcccttttagttcaacctggcagtttcctgctgggggctggtgatttgattctgcagttctcacccacacaaatcttatcaagtggttagtctaccatacctttagtgttctcttgtgaactttcttactttttgttatgtggacaggctgagaattttccaaatctttaagttgtggttcctttttgcttaataattccatcttcaattggcttccctcttttcaatttttactataaacaatcaggaggaaccaagccattccttcaacattttgcttagaaatctcctcagctaagtatccaacttcatcactcacaagttctacctcccacccagaaaacactagaacacaaacataattcagccaagttctttgctactttgtaacaaagattgccttttctccattgtccagtaacgttcttcatttctaagaccatatcagaatggcctttattttctactaaaattctgtacatgattatttatgtattctgtaagatggaagcttgctctaccattctcctctcttcttgctgagctctctccaaaatcacctttaatgcccttacttctaccaacagtccctcacagcaaatatcagcttgttctagcatgcacttaaaaactcttccagcctatatccattacacagttgcaaagtcacttacccgtttttaggtatttgttatagtagcatcccactttttagtaacactttttgtcttagtttgggctgcaataacaaatactatgggccaggtagcttacatacaaacatttatttctgacaactatgaaggctgggaaatccaagatcaaagttctagctgatttggttcccagtgtgggtcctcttactggcttgtagatagaggtcttcttcctccatcctcacatggtagagaagaggatcatctcttttctgtctcttctaatatgggcactaatcctatcacaaggcctctaccctcatgaactcattaccttccaaaggtcccacctccaaatgctagcacattggggattagggaattcaacatatgaattttggggggaaggtacacaaacatttagtccatagcatgtatatatactatgatcccttctatgtaaaacaaaaatataaactatatacatacgtatatgcatattaaatttctagaaggagccaggcacggtggctcacgcctgtaatcccagcactttgggaggccgaggtgggtggatcacgaggtcaggagatcgagaccatcctggctaacacagtgaaaccccgtctctactaaaaatacaaaaaaattagccaggcatggtggcgggtgcctgtagtcccagctactcgggaggctgaggcagaagaatggcatgaaacagggacgtggagcttgcaggagccaagatcgcgccactgcactccagcctgggagacagagtgaggctccatctcaaaaaaaaaaaaaaaaaaaaaaaaaattctagaaagatgtgtgtctatactttccaaaaacagccacagaattaaagccaaacatgctcttctagaatcttgccactccccattgagaggtgaaatctggccagactctgtggctcatgcctgtaatcctaacactttgggaggtcaaggcaggaggaacgcttgagcccaggctatggtcaagccattgccctccatcctgggtgacagagcaagaccctgtcaaagaagaaaggaggaagaaggaagaagaaaggaaagagggaggaaggaaagagagaaatctgtttgccctcctcttgaacctggacaggcctgtgactgctacacccaagaatataggaaaggtgttatgacttcttacactaagttctctccctctcccatctcctctcaggagggatgttctcccttggaaccaggccaccattctatgaggaagccaagcagccacatgaaaaggccgtatgtagacattctaactgacaatactagctaaggttccagctactcaccagcatcaactatcagacaaattcctatcattaatagaagaaactatatgccaagtgacagccagtgaagcagaacaacaggagaagacggcgaagccagaagcaaattatttcaatggaagaaaaatcccctctccaggttgttttcattggtataaggatatgagttactttttaaaaaggaacactaggcggccgggcacagtggctcacatctgtaatcctagcactttgggaggccgaggtggatggatcacaaggtcaggagttcgagaccagtctggccaacatagtgaaaccgtctctactaaaaatacaaaaaattagccgggtgtggtggcgtgcacctgtaatcccagatactcaggaggctgagacatgagaggcagaggctgcagtgagccgagatcacaccactgcactccagcctgggcaacacagcaagactctgtttcaaaaaaaaaaaaaaaaaaaaaaagaatactaaagtagttacaaggaaatatctgatttttctttttcttgttttataaagaatactagacaacttaaaacaataatttatgcaaggcacggtggctcacacctgtaatcccagcactttggggggccaaggcaggtggatcacctgaggttgggagttcgagaccagcctgaccaacatggtgaaatcccgtctctactaaaaatacaaaattagctgggcgtggtggcgcttgcctgtaatcccagctactcaggaggctgaggcaggagaattgcttgtggaattgaggtggaagttacggtgacccgagaatgcgccattgcactccagcctgagcaacaagagcaaaactctgcctcaaaaaaaaaaaagaatgattcatgattagacggggattttgtgtaggcaactttctatacatatactagtattctactactacatcactaaaaatccatagttatcggctgggcgtggtggctcacgcctgtaatctcagcacttcgggaggccaaggtgggcggatcacctaaggtcaggagttcgagaccagcatggccaacaaggcgaaaccccgtctctactaaaaatacaaaagttagccgggcgtggtggcaggcgcctgtaatcccagctacttgggaggctgaggcaggagaattgcttgaacccaggaggcgtaggttgctgtgagcccagattgcgccattgcactcccgcttgggagacagggcaacactctgtctcaaaaaaaaaaaaaaaaaattccatagttatcacggggcatattcctatattaaataacacagaattatatgtaacatgatgaagatacccagattgtcactgaaagagactcaccgtctatccttatctacctttttaagtccttttaggcagtattataaagcactaaatctctaattaaagtacagttgtcccttggtatctgcaggggcttggttccaggaacccccctcagattccaaatccagacactcaaatcccttatataaaattgtatagtatttacatacaatctatgaacatcctcccatagacaaattgtctctaggttacttataatacttaatacaatgtacaggctatgtaaacagtggttatgctattgttttattatttgtattattattttttaaatatttttgatttacagttggctaaatccatgaatccagagagcacaggtatgaagggccaactgtattagattaggaaagaaaaaagtccgtgatatgagataatacctcaattttttaagtgtttctgaacattcctgagacaagcagaagtatacatacacctggcaaaatgcaactgcattaagaatagtctaacactcgctgtaactcggtgatgtaattaaatcatagaaaggacccatgccaagtaagtaagtaaaaccttgtcaccagcaccccaaaacgggcattctttgtactgcaatcatatcagtcttgaacttgaacactgttagtttataatatgtactttttttttgagacagtctccctctgtcacgcaggatggagtgcagtggtgtgatatcagatcactgcaacctccacctcccagactcaagtgattctcatgtctcagcctcccaagtagctgggattacaggcacccaccaccaggcccagctaatttttgtatttttagtagagactactaccaacagggtttcaccatgttggccaggttggtctcaaactcctggcctcaaatgatctgcctgcctcagcctcccaaagtgctgggattacaggcgtaagccaccccacccggccctataatgtgtactttaaaataaccctataataacatagtcagagaagcttagtgaggtggctcacgactgtaatcttagcacttaaggagggtggaacaggaggaagcttgaggctaggtgtgtgagaccagcgtaggcaacacagtgagaccccatctctacaaaaaaaaatacaaaaattagccaggcacaatggtgtgtacctgtagaaccagctactctggagactgaggtgggaggatcgcttgagcccaggagttcaaggctgcagtgatctattacaccactccactccagcctagatgatacaatgagaccctgtctcttaaaataaaaataaaggaaaaatatagatagatagacagatagatagatagtcacagagatggtcatttgcctctttttttttttttttttttaagacagggtctcactttgttgctcaggctggtttctaaatcctgcctttaaacaatcctcccgcctctgcctccgaaagtgctgagattatgagcatgagcccagccagatttatagtctttgtactaaaacttatatataaccagtgatgaggcagtagtaagagaagttccaactgctgttagtgcccataaagctttatgagaggatacttttcttctatttttatagattttttaaaacattctgatgagaacaaatcctaccaatttataaatcaaggtaatgagaagttttattaagaattattgaacagctacattgtagtgtacattttcttttcaaatcatataactatggtgcatttaaagattttcttcttcagaaaagagagaagaatcaaatagacgcaataaaaaatgataaaggggatatcaccaccaatcccacagaaatacaaactatcatcagagaatactacaaacgcctctacgcaaagaaactagaaaatctagaagaaatggttaaattcctcgacacatacaccctcccaagactaaaccaggaagaagttgactctctgaatagaccaataacaggctctgaaattgtggcaataattaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccaaatccagcagcacatcaaaaagcttatccaccatgaccaagtgggcttcattcctgggatgtaaggctggttcaatatatgcaaatcaataaatgtaatccagcatataaacagaaccaaagacaaaaaccacatgattatctcaatagatgcagaaaaggcctttgacaaaattcgacaacccttcatgctaaaaactttcaataaattaggtattgatgggacgtatctcaaaataataagagctatctatgacaaacccacagccaatatcatactgaatgggcaaaaactggaagcattccctttgaaaactggcacaagacaaggatgccttctctcaccactcctattcaacatagtgttggaagttctggccagggcaattaggcaggagaaggaaataaagggtattcaattaggaagaggaagtcaaattgtccctgtttgcagatcacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacagttgcttcaaagagaataaaatacctaggaatccaacttacaagggatgtgaaggacctcgtcaaggagaactacaaaccactgctcaatgaaataaaagaggatacaaacaaatggaagaatattccatgctcatgggtaggaagaatcaatatcatgaaaatggccatactgcccaaggtaatttatagattcaatgccatccccatcaagctaccaatgactttcttcatagaattggaaaaaactactttaaagttcatatggaaccaaaaaagagcccgcattgccaagtcaatcccaagccaaaagaacaaagctggaggcatcacggtacctgacttcaaactatactacaaggctacagtaaccaagacagtatggtactggtaccaaaacagagatatagatcaatggaacagaacagagccctcggaaataacgccgcatatctacaactgtctgatctttgacaaacctgagaaaaacaagcaatggggaaaggattccctatttaataaatggtgctgggaaaactggctagccatatgtagaaagctgaaactggatcatttccttacaccttacacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaagacacatgaaaaaatgctcaccatcactgggcatcagagaaatgcaaatcaaaaccacaatgagataccatctcacaccagttagaatggcgatcattaaaaagtcaggaaacaacaggtgctggagaggatgtggagaaacaggaacacttttacactgttggtgggactgtaaactagttcaacccttgtggaagtcagtgtggcgat

SEQ ID NO: 2019 - DNA, 8132 bp, Homo sapiens; identical to SEQ ID NO: 2018

SEQ ID NO: 2020 - DNA, 4033 bp, Homo sapiens
cgcgtcaagctcccctcggagttggcctccatggcggcctgggcctcggcctcgcgctcctccttcttcttgatgccgtactgcgggggaggcgggggtcagggcgggggtcccggcggctcccgggcgggccgcagcctccctgcgccagggactggcccaggaacccccgaaggcgtgggtgcggccccctaccccaccaggcacacaaggaccccagaaggagaagagaccccaccccggggggtccctggaggaatgggaagcccccacggagaatgggggccaggagctgacatgggggggagcagggagggggaggctcccatcttccttgagaggagagagggctgtggccccacctctggctccaaacccagcccagcccctggcatcctgccttccaggaagcctccggcccggggcagggaggggtgggcaggatgctgcgtggcagaggtggggagaaacagtcaacccgcagctgaccctcctgcccagtgcctggtccacgacctgcattcacactcccgggcctggccaaggctgcctggatgcggccgcggccccagcagggccactccctggcaggccgctgcagctccgtgggcagccggcagagggtcctgggctgcggtcacttccaggcactgggtgtcctggaatcccgcctagtcgtgccctcagccagtatgcctgggcctcaccgaccccctgcccacccgcgtttctcatctcccgtgagtgcgtctgccctccgtagtagctgaatattgtccccctcaaattcatattgcctggagcttcaaaggtgatctcattcggaaacaggtctttgttgatctcataatggtaaggatggggacgaggccatcctggatttgaggggcctcaagtccagtgagagtgtccttgtaagagacagaaaggacagacacccggatgggggcgggcatacgaaagcggaggaggtcgcgagtggtcaagaaacaccagggattcggggccgccagacgcaggaaggggcagggaagggccctcccccagagcctccagagggagtgtgggattttgttcttctgccctccaggcctctaagtttttgtcaggccccggggttttggtttctagatcaatacgcctccccacgccacactcctccagccctcccgtgagccaccagcccaggaagcctgtggtcatggtcaggccacggaactacggaacagcctcctgctgcccaggaaggtccaaggtcctggatctgagattacaggtgctctggagtagtgaaggcgtcagcagctgcgtccaggagaaaacttaggaggggagtgggcaccagcactctacaggacggaggagcacaccgcgggatcaccagccacagggaggggcctttctgcccaggaggagcccctcccctgccatctcctgctcctgtctcagcagcccctccccatagaagcagttggttctgctcctggtgctgggcaccccctggatctccaaggaggcccctccttcctcccaaatggagggggggctgcctgtgtgctccccaaccccaccgagggcagtctcggcacctctcccctcccctagggctgcaggtggctctgggtgtggggggccagggccaccttcagtgagatggaaaggagggcgccacgttcccagccgcctgtggccagaccaccacctggccactgaggagagaggggccgtgggctcgccctagtcctcagcagcccctgcgcactcttgacagagccgggactccaggggtctcctcagtgaaacgaagagcacagggtaggaacgttctccgcacaacaggggcgacacccagagggccctgcaggcccagaacaaagccctgaccctgtggggcagcaagagcagattggttctcgtcctagccatccacagcgggaagggcagcagctccaggcacggaagtggagggagcatgtgctcttcgtcctgtggggccaggggtgtgctggggagagcgatgccactggaagctaggtccggccagagagcctccctccagccaggggtgtgggggtctgtgcatgtggcggcaacatgtgtatccagcccaggaggctgtgctgcccacagcaaaagcactcaggaacatgtgtgtgctcagaggagcatgcctgtaacggcggaacatgagttgtgtgagcaaaggaacctcccaggtcaggggagtgacccttggggcttgtgggaccctgtctgcaaacggtgtgggatccttccttctgggcccaggaaggagaccccaggccctgccaccaggttgtgggacactcggagcttggcctgaagtgccagttgctgcagtgaggctccaggtcattctgaggctgaggtcacgccggacttggcctgagggccagggtcactctgccgggaaaacaggctccggggctgggctgcacaccagagcctggcttccacgtggtctggctgagacccagttctgaggcgtctgctccagagacaaacgcccaggcacacccagccccaggcccaccgtgatgctgggcagcagctctccaggaagtaacacctgaggatgggagtggctgctgggggcgcccaggaggccctgacacgtctgagacgccggagcggcgagaccggcgcagaacgggcggccccgagcactgctgcgaccccgccggcctcgacctcgacaccccgcgaccccgccggaccctggaagcatgagctgcatcccgcatccgcaggagggcggcgctgcgacccacccccgcccccgtttccagaggaggccgctgcggcgcggggcggtcccacgtggtgcctgaggctgggacaccccgactctgattgcaggggggtcggatccgaggctgggggtcccgcagtctggctggggtccgctactggcctcgacgtacaggggccgaccccacccctacctcgttctctgagcctcagcttccccccgtgagaggtggaggcggtgggggggcgcaccgggcacgaccccgcggcaatgacggggctggcaacgccccccacagcggcacaggcggataaaccctctggggagggagttcagtcccagcgggaggggcccttcccacccgggagctcgccccaaaccgggtggagagggggtggggggggggtgcagatcgcggcgcctccctgccctctggccctgctgagactccaccgcccaccccacctcccggtagcagaaggggcagaagcagagacgtttcctctgcagacatcggggagggtggggtcagggccgcgcgtttccagccctgaggctcttcccgggaacccacctcccagacctttgctggagtggcacccacgctcccgagacgcccaggcagtttctggggggatctgcttatacagagcagccgcccctgaggtcaaaaccctgcccagggttcccttacacgatttacggaagagtcacaaagattgtataagagggctccctagacgctgacattgcagccaccgagtgttcgtcaaagctgagacctggacatggtaccagcgaccaccccactgaagacttcatggtaactccacacgtaaagacgtccatcctccccaaactccgaagaattaagaagaaaattctgtgaaatctgacaagctgagtgttgcatacagacctgcaaaaggcccatttgccaggacagacacctgaaggaaaaagaggagagtgaggtccaccagataccaagacagaatgatgatggtgcagtgggaggaagacagacaacgggcccagagtggggagcccatccccagacccccacagacacaggacccccacgtgggaccagagacagaggtggaggctcaggaccctggagaaagaatgcagtatccccagatgggacaggatacttaatgggaaagaataaaactggacccctgcacaacacacagacacattcttattgattgtagaactaaacatgaatcccaaataaatgtaggcaaagaaaaa

SEQ ID NO: 2021 - DNA, 4033 bp, Homo sapiens; identical to SEQ ID NO: 2020

SEQ ID NO: 2022 - DNA, 5308 bp, Homo sapiens
gggcaagtaccagcacctcagcctagtcggtgcaggtgatagttatgaagctaagtcctaggccaggaacaaggcagccagtccagccagcatagttgacccctctatggactggggccagtgcagccacagcattccagtgctcagcccctcagctgggagatcagcgactgctgccacgtgcccagaaatggctcgtcctttcactacagcggaatgcaatgagggtgggtgagaagatgatgggtcggttatttcattccttttctttttacaacttcactttcagagacttcagcgttccatgtctgctgtgctgtggaacccagagtgctcttgcctggatggctgagaatcccttggaccctggaagcacctactccatgatggcccggtatagtgcaggctcaatataatcttcccggtatcttgacaggaggaccaaactggagacagtcctggctctgaggaaacaggaaggaaggagggtgaaaggaacgtccacctgcacacaaaggaaagatgaaaaagagtcacctaccatgggacctggcaaagtacttcagaacttttattccttccagaagcaggtaagtaccccaagtcctcatcgtattcccagcatagggcttggtatacggggggatatttcattcagcatattggctgaatgaaaggtctgataggtatacctgggagaaggtccttagggacatggcttaaaaaatgagagaggggcagggcagtgagtctaaaaggatgtggatgctcacatctgctcttacaatcatgctacagttcatttattgagtggaaacagttccctacttattgacaattcatttactgaataggtaatcagtaaatacattttgtatcaatctaacaattaggcataaactacagcctcctacacccaatatctgaggtgttctaagatttaactactcaaatgtttgatatttgataaattgtttaagttctctgcaattcagttccacctcctataacagcacttctgaaaatgtggtctgtgaacctctgaggggttcctgagacactgtcagggagcaagtgagacatggctatttttataatattaaactattagcctttgtcactgtgttgtcatttacctaggataggtacaactgctggcacctgagcacagatcaaggcactgaccctaagctctactagttgttattgcatttttcaccactgtacactcataatttaggagaaaagagcaaaaactctagattgcatgtaacaatatcccttgatgaagcagtaaaaaattattaatgttgttaaatcttaatcattgagtacatgtgttaagtcctcataagacacttttggttgtctcaaagaaatctatctgtgttgtttgagttgtgaattacactagctgctttgttcatggaataccagttttatttgaaaaaaattactaggccaggcatggtggctcatgcctgtaatccctcactttgggaggcagaggtaggaggatcgcatcagcccaggagttcaagaccagcctgggcaacacaggggagaccccatctctacaaaacataaaaaattatccaggtgtgatggcacacgcctatagtcccagttactcggaaggctgaggactgcttgaggccgggaggatgaggctgcagtgagccatgaccatgccactgcactccagcagtggtgctgcgcaacagagcaggaccctgtctttaaaaaactctatgaaaatttaaaaaaagaaaaaagtgactgacaaactatggcttttcagacttaggtatctggcagacatcttcttgaaaatgcatgaagtgaacgcctgtcatgtcaaggaaaacaaaagtcagtatctgttgccaatagtaaaattcaggctttcaaacaaatattagcatttcagagaagcggcattcacaactgtgagcttgaaacttcccaaaattccaagttttttgattattagtgatactaacaaatgtaatttttaaaatatttatggccgggcgtggtggctcatgcctgtaatcccagcactttgggaggccaaggcgggcagatcacgaggtcaagagattgagtccatcctggacaacatggggaaaccctctctactaaaaatacaaaaattagttgggcgtggtggcgtgcacctgtagtcgcagctacttgggatgctgaggcaggagaatcgcttgaacccggtaggtggaggttgcagtgagccaagaacgcaccactgcactccagcctggcgacagagcgagactctgtctcaaaaaaaaaaaaaaattaaatttataataatatttaacaacatttggaggctgtcgataggccagtgcaccaatattttctaaatgaccaaagtatgatgttataaaaggatgcatgggtgaaagatccattcagaagagaccaatgggttttagtgttaacagtatgaaacgttcactgacctttcagattccacactgcaactaacttttaagaacctgccaggagcagtggctcacacctgtaatcccagcactttgggaggttgaggcaaaagaaatcgcttgagcccaggagtttgagactacctgggcaagatggcaagaccccatttctacaaatagccatgcatgcctgtagtcccagctactcgggaggtgcttggtcaacaaagcaagacatcatctcttaaaacaaacaaacaaacaaaaaaagttgttacttccattgagttttggtggatatcagagaataataaacacaattacctgaaagactattaaaatacctcccttggctgggagtggtggctcacagatgtaatcccagcactttgggaggccgaggtaggcggattgcttgagcccagttttgagaccagcctgggcaacaaggcaaaactccatctctacaaaaaattaaaaaattagctgggcgccagtgacaagggcctgtagtcccagctacttgggaggctgaggcagcagaatcacttgagcctggtatgtggaggttgcagtgagttgagatcactgcactgcactccaacgtgggtgactggagtgaaaccctattttaaaaaaacaaaaacaaactcctttttccaattacatatctacgcaaggctgaattttcttcctatacttgaacctaaacagtgtatcacaatagattgaatcaagaagtgacattaaggccagcgcggtggctcacgcctgtaatcccaccactttgggaggccgaggcgggcggatcacgagatcaggagatcaagaccatcctggctaacatggtgaaaccccatgtctactaaaaatacaaaaaattagccgggcatggtggcgggcgcctgtagtcccagctactcgggaggctgaggcaggagaatggcgtgaacctgggaggtgaagcctgcagtgagccaagatcatgccaccgtactcccgtactccagcctgggcaacagagcaagactccatctcaaaaaaaaaaaaaaaagacattaaagagatttgcaaaattgcagggaaatggcaatcttttgtttttgttttagaaaagttatttttaatctaaaaaaattgattattttaaatcaatctgctttaatttctaataagaataaatacgtttagatgtaacccagagaaacacaggctctttggggtctctaacttgtagaaaatggagtcctgaaaccactgtaagttagagataataccacatccttctcacagtgggtatgagaagataaagagatacttgaaataaccacttagcatagtgcctggcatactgtaccagcttaataaattacagcaagggccaggtatggtggctcaaactcttgtaatcccagtggtttgggggcccaagatgtgaggatcgcttcaagctgcgagatcgaaaccagcctgagcaacaaagcaagaccgttgttactacaaaaaatttaaaaattagccaggtgtgactgcatgtgcctgtagtcccagctacctgggaagctgaagcaggaggatcacttgagttcaggagtttgagattgcaggagctatgatacagccactgcactccagcctaagtgacagagtgagacctggtctctctcaaaaaaaaaaaaaaaaaaataaggccaggcacagtggctcacgcctgtaatcccaccactttgggaggccaaggtaggcagatcacttgagcccaggagtttgagaccagcctgggcaacatggcaaaagcccgtctctacaaaaaattaaaaaattagccggctgtggtggtgcgttcctgtagtcccagctaccagggaggctgaggtgggatgatcacctcaatccaggaagttgaggctgcagtgagctgagattgtgccactgcactccagcctgggcgtcagagtgaaaccctgtctcacaaataaaatataaataaatgatagctatgctactgctatgagtactactaatgtcgccttttctataagtctaccttataactaatgaatgtgcttttagcaactgagtggctaatgtggtataaacatgggacaatacctgatttgttaaaggaaaaaatggtttcattcctctctactttggtggtcagtctaccaactgaaaaggcaaggtgggggtaggggaaacctgaactaagtcctcactaccaagccagacctaggactgggtccatgtggggccactgtgtctcaggtgttgataacataaacaggccaagggtgtctccaggcagtttctacttagccctaaagcccactgtgaagagacaaaagcagattctatacatctactaagagggcctgatagaaaagagagttggataattcccctaaaatcacacagctactaggcaatgaagctggtattggcatatttgattccaaagcctgggctctcctattgcactagaatgccctcaaggataatttagacggcaacagatgcaggtttcaaggaattgcagaaaatactgattcccaggtacttctagggaaaatagggtaccctagcagcacgcagttttctttgcaaagaaagactggtacagatgattctttctgtttgaggacatggtgatgggaccagggacctggctagaagaagcaggcatacacacacagtctgccagccagaccttagaaacatccccccattccaaactgcctgagaagctccttgcagatattaccactatgtcctcaggataaagattgtcgctgaaggagccatcatcaaagttgacttcatagaaggtctcggtggtg

SEQ ID NO: 2023 - DNA, 3382 bp, Homo sapiens
gggcaagtaccagcacctcagcctagtcggtgcaggtgatagttatgaagctaagtcctaggccaggaacaaggcagccagtccagccagcatagttgacccctctatggactggggccagtgcagccacagcattccagtgctcagcccctcagctgggagatcagcgactgctgccacgtgcccagaaatggctcgtcctttcactacagcggaatgcaatgagggtgggtgagaagatgatgggtcggttatttcattccttttctttttacaacttcactttcagagacttcagcgttccatgtctgctgtgctgtggaacccagagtgctcttgcctggatggctgagaatcccttggaccctggaagcacctactccatgatggcccggtatagtgcaggctcaatataatcttcccggtatcttgagttgataactcgttgccgtttcttttcttgcttaacctctttctctgtgaaaatctcattgaagcgcatgtctgaggctactgactatagaagaataagcaagccaagtgtcagctaccccaggaacaatacaaagggatgcatccttgacttgttccctccctccaagacaggaactggggggacacagaaaatactcaccagtctagatttgactctcttgggaagctcttcatccagtgtgtatacatcatctctcttaaccacaagttgtgagccatcctcaaactccacctaccaaggaaacaaaggccttttggctaggatatccctgactctttccctggtccaccatgcacagtggcagtcccctacagtcaaaggaaggagttagaacactaaaataacaactaccttacttcacatttggcagactggaaacagggcagacccctagctctgaaagggttaccaacctattagttctcctaagagcaaagactcgcctctggcccaacaggaagcacagaattaatcaagcaccccccactccctagaaaggtagaactttggatacctggtacatttggatagggtgggaggccacaaacttggctccatagacttggccgtctgtccatctcacttggaccacttccccttcagcaggaggaccaaactggagacagtcctggctctgaggaaacaggaaggaaggagggtgaaaggaacgtccacctgcacacaaaggaaagatgaaaaagagtcacctaccatgggacctggcaaagtacttcagaacttttattccttccagaagcagtgtatcacaatagattgaatcaagaagtgacattaaggccagcgcggtggctcacgcctgtaatcccaccactttgggaggccgaggcgggcggatcacgagatcaggagatcaagaccatcctggctaacatggtgaaaccccatgtctactaaaaatacaaaaaattagccgggcatggtggcgggcgcctgtagtcccagctactcgggaggctgaggcaggagaatggcgtgaacctgggaggtgaagcctgcagtgagccaagatcatgccaccgtactcccgtactccagcctgggcaacagagcaagactccatctcaaaaaaaaaaaaaaaagacattaaagagatttgcaaaattgcagggaaatggcaatcttttgtttttgttttagaaaagttatttttaatctaaaaaaattgattattttaaatcaatctgctttaatttctaataagaataaatacgtttagatgtaacccagagaaacacaggctctttggggtctctaacttgtagaaaatggagtcctgaaaccactgtaagttagagataataccacatccttctcacagtgggtatgagaagataaagagatacttgaaataaccacttagcatagtgcctggcatactgtaccagcttaataaattacagcaagggccaggtatggtggctcaaactcttgtaatcccagtggtttgggggcccaagatgtgaggatcgcttcaagctgcgagatcgaaaccagcctgagcaacaaagcaagaccgttgttactacaaaaaatttaaaaattagccaggtgtgactgcatgtgcctgtagtcccagctacctgggaagctgaagcaggaggatcacttgagttcaggagtttgagattgcaggagctatgatacagccactgcactccagcctaagtgacagagtgagacctggtctctctcaaaaaaaaaaaaaaaaaaataaggccaggcacagtggctcacgcctgtaatcccaccactttgggaggccaaggtaggcagatcacttgagcccaggagtttgagaccagcctgggcaacatggcaaaagcccgtctctacaaaaaattaaaaaattagccggctgtggtggtgcgttcctgtagtcccagctaccagggaggctgaggtgggatgatcacctcaatccaggaagttgaggctgcagtgagctgagattgtgccactgcactccagcctgggcgtcagagtgaaaccctgtctcacaaataaaatataaataaatgatagctatgctactgctatgagtactactaatgtcgccttttctataagtctaccttataactaatgaatgtgcttttagcaactgagtggctaatgtggtataaacatgggacaatacctgatttgttaaaggaaaaaatggtttcattcctctctactttggtggtcagtctaccaactgaaaaggcaaggtgggggtaggggaaacctgaactaagtcctcactaccaagccagacctaggactgggtccatgtggggccactgtgtctcaggtgttgataacataaacaggccaagggtgtctccaggcagtttctacttagccctaaagcccactgtgaagagacaaaagcagattctatacatctactaagagggcctgatagaaaagagagttggataattcccctaaaatcacacagctactaggcaatgaagctggtattggcatatttgattccaaagcctgggctctcctattgcactagaatgccctcaaggataatttagacggcaacagatgcaggtttcaaggaattgcagaaaatactgattcccaggtacttctagggaaaatagggtaccctagcagcacgcagttttctttgcaaagaaagactggtacagatgattctttctgtttgaggacatggtgatgggaccagggacctggctagaagaagcaggcatacacacacagtctgccagccagaccttagaaacatccccccattccaaactgcctgagaagctccttgcagatattaccactatgtcctcaggataaagattgtcgctgaaggagccatcatcaaagttgacttcatagaaggtctcggtggtg

SEQ ID NO: 2024 - DNA, 271 bp, Homo sapiens
gcgaaggcccgcggcgggtgttgatgcgatgtgatttctgcccagtgctctgaatgtcaaagtgaagaaattcaatgaagcaggtgtagaataagtgggaggcccccggcgccccccggtgtccccgcgaggggtccagggcggggtctgccggccctgcgggccgccggtgaaataccactactctgatcgttttttcactgacccggtgaggcgggggggcgagccctgaggggctctcgcttctggcgccaagcgcccggccgcacgc

SEQ ID NO: 2025 - DNA, 3715 bp, Homo sapiens
ctcaactctaccgttgtagcgtgaatgttccgagaaaacttacaacactaggcagtgggccacatttgatgcatagaaaactgcttgccaacccctgatgtaacagattgccaagaggttcaccatcgcttccagaaaaagatcaatactcctgacgtggcaacctgtcgagactcaggaccgctaggaaatcagctcttgtttacccctctatccattacactacgatccagctgggtttaggcatcacttcctctgagcaatcctccctgatgtcatgaggcagtgctgagtgccttctctggaccctctgtttacttgcctgttaaatcctgaacatctggaagggagtcgtgttcagcaacatatctacgccttgcagcacggtgcctggcctgcagctggtgttccgtaaacagctgctgactgacgggatgcatcggtattcacagggttactaagaagtgcttgtcctcggtcaggccaggaaagagagatgacagacttggtcccatcggcaaactctttacagacaaaaaatccacctcactcatctctacagctccagggctcagcacaggggctggcacatgaaggctccctttccttaccttttcctggcacatgcaaatatatgttttttgagtatataaatcaatgaatgatgagaatatcttgcaactccttcaaaccgacaggtccacagagatgatcttgctcctgaccttgacaacagaaatacattcttagagactctgtagtcctaaatagaactttggggaatccttttaaaaatcaaacgcatacttggtaggagaactgacaatggcaaccagttgctcagagttatttgctcaaaggcctacctgcctcctaagcctcactgttcttcattaactgtcaggggttaaactttcaagagctactcccaaaagagctgcaggaaaattctgtctaaacagccatgcaaaagtgtctggggatcactacggacagaggatgatgacagagggcccatgacattgggccttgtcatggctgaacactgaccttccactgtcatggctgaacactgaccttccagtgcctacagcttttaaaaagagtaaaaactatgttcatgggtacacaaatacaaacatgcactcccccacacacacacatacatggacacacacagaggcatatcatgcattatcttctctcattcatcgatattctcaaatggcttattacacagatttacattcacaaatattctattatgtaaatgtaaatctattctattatgtgaatgtaaacctatataatatatttagccattttctcagttggatattttggttatttctatgttgtcacaattttaaatcacattgaaataaactaggcccctttgactcctttctttctctcttactccatgtggtagactaaatgtggctgctaagtttatttctcccactatgtcttccagccaattctagatttgagtcaattctagagaccaccatggtggagagtgcatatgcaggcacgccagttaactgatctggctgagcccagccctccagccatccctgccaaggtgtcaatgtgagtgaaaccatcttgaactctgcatattaacttattctccagctgaatatcaccaagagacctgtcttctgatgctacatggagtggaacaatctcccagctgagctctgtccacattcctgaccacaaaatcatgagatattaaataaaatggctgttgttttaagcatcaaccagtcttctcaatgctgccacaatcctcacaatggcccataaatctctacgtgatctcccactattctctttgatctcatctttggccttcccatggctgaacctgctccagccccactggcctccctgttcctccctgaacataccaaacatggtcctcccacctcacggcatttgcacttcctttcccctctgtgaggataatcctcccccagatgtcagcacggcatggtccctggcttcatgcaggcctttgcatacatttcagtcaatcagagaggtcttctctgatatcttacctaaaacaggagtccttttcttccacctcagccctctggagagccagggaacacctctctctccttatcatgctttatttttcttcataccactttcacaatattaatatttatatgtttattgtctatttagacctcctctcctccccacaaataaatgcacattctttagtacgaattctccgcaaacagaaacgttgtctgcttttatcattgctgtattcccaggacctaaaacagtgtcctgggtgtaggactgatcaataaatatttgtaaatgaatgaatgaattaattagcacacgttcttggatagaaatctctctattcatttctaattattcctcaaaataagttcctatgagttaagttgtggaggtgtaggaataacacatttcaaaatcttttagcacatattggctaaaattccctacagacaggctgcactggtgcttacccatcctgctagggatgtgtaagagtgctaatttccttgcatcatcaccaatataggataaagtcactcaaaaatatttgctacgtggatacatggaaaaaaatggttaccctttattttaacttaactttcttgatcctgtgtgaactgaactccttgttccacgtgcttattggccactacaaagtaagttccttgacagcaggggtttagatttgctcactgctatcccagcatcccagatagagtctaggatataagagatacatgataaatatttgtagaaagaatgaattaatatagatgttttcttttgttattgaaaggctattgactcatgtgtcctctgagaagtctgtctcttttttcttactgacttgaaataactccatgcatatagaatattttactgtcatctaggttgaatttttaatgtgtcatttgcactctattttgtatatgctattttttgacattcagaaattctagcattttatgtagttacatctatcattttattttagttcctctatttggtaccatgtttagctacagtcataatagttaacactgtatagcacttcccacatgccaggcacttttctgaggattttacatacattgtttattaaattcctacagcaatcctataaggtagacactatcattatctaatcatataaagaaactgaggcaatgagctatgaaatcaatcatctcctgtacaagattttatataaatttacctgtagattgctttatgatttcagtttttatatttgtgattattatgtaataatagaaatctattgggttactccatggagaagtgagggtctaattattttttcccaattaattgtcaagtgctccaacacagtttattgtaacaatatgtaacatgtctgtaacatattgacatatatatatgtatgaatagacatatgtatacatacatacaaacatatgtacatgaacacaatcacacactatatagcatttgctggtattcttactcagctcacttgtactgtcggtcctttttagttgtttagtaatttttgtggtgtgttcagtgaatcaaatttataaaatagaaatataaagaagaaacataaaaggattaccagcgattccctacaaatcctgattaaaggcacgttcaatgttgttctcatgaaatatgc

SEQ ID NO: 2026 - DNA, 3715 bp, Homo sapiens; identical to SEQ ID NO: 2025

SEQ ID NO: 2027 - DNA, 831 bp, Homo sapiens
ctgatgtaacagattgccaaggcctgtcgatgttaccttctaaagatctcctgaacctgcccacttttctccagcgcccacaccctcgccacactagtccagccacaatcttctgttgcctagatgaccccagcagctccctccccgcctgcctcctccattctgctttcacttttgtctcctctacccagcagccagagtgagcatataaaatgcagttctgatcctgtcacctctctgcttaaaactcttcagaggttcaccatcgcttccagaaaaagatcaatactcctgacgtggcaacctgtcgagactcaggaccgctaggaaatcagctcttgtttacccctctatccattacactacgatccagctgggtttaggcatcacttcctctgagcaatcctccctgatgtcatgaggcagtgctgagtgccttctctggaccctctgtttacttgcctgttaaatcctgaacatctggaagggagtcgtgttcagcaacatatctacgccttgcagcacggtgcctggcctgcagctggtgttccgtaaacagctgctgactgacgggatgcatcggtgagtcaatcaattaactctctctcacaataggaggatgaagctcagagaatatccaattggccatccttccccagaggccagaaaatgctgtggcttgagttccctggggctttgcctgccctggttgggatggctttctgccccagagttctctggaacttgcaagtctggagttttctgacccaggagttatctgtgtcagaaaaagaacctggctttcagaatcttctgtgtattataaggtgg

SEQ ID NO: 2028 - DNA, 1058 bp, Homo sapiens
tggaacattcaccctactcaactctaccgttgtagcgtgaatgttccgagaaaacttacaacactaggcagtgggccacatttgatgcatagaaaactgcttgccaacccctgatgtaacagattgccaaggcctgtcgatgttaccttctaaagatctcctgaacctgcccacttttctccagcgcccacaccctcgccacactagtccagccacaatcttctgttgcctagatgaccccagcagctccctccccgcctgcctcctccattctgctttcacttttgtctcctctacccagcagccagagtgagcatataaaatgcagttctgatcctgtcacctctctgcttaaaactcttcagaggttcaccatcgcttccagaaaaagatcaatactcctgacgtggcaacctgtcgagactcaggaccgctaggaaatcagctcttgtttacccctctatccattacactacgatccagctgggtttaggcatcacttcctctgagcaatcctccctgatgtcatgaggcagtgctgagtgccttctctggaccctctgtttacttgcctgttaaatcctgaacatctggaagggagtcgtgttcagcaacatatctacgccttgcagcacggtgcctggcctgcagctggtgttccgtaaacagctgctgactgacgggatgcatcgatgtgtttcccaagacatccaggagaggatattggcgcaaacaaggccttgaaagctccatgatagagatgacagagctataagatgaaagcagcccaaatccctgagtcaccaatgtttgaagaagagcttcccaggagaggtaccagacccacatgagacttcacatgattataaaatgaacttctattgtgttgaatctctgaacttcagggttgttttgcagcacagactacattatagtgacaagtagaggaaggtacaggcatgctaatttcattttaaaattaatcaaggattgtcaatggaaaataaagatttcagattccttgcaccttaaaaaagacgaaaaatatgtcttttttc

SEQ ID NO: 2029 - DNA, 1098 bp, Homo sapiens
ctgatgtaacagattgccaaggcctgtcgatgttaccttctaaagatctcctgaacctgcccacttttctccagcgcccacaccctcgccacactagtccagccacaatcttctgttgcctagatgaccccagcagctccctccccgcctgcctcctccattctgctttcacttttgtctcctctacccagcagccagagtgagcatataaaatgcagttctgatcctgtcacctctctgcttaaaactcttcagaggttcaccatcgcttccagaaaaagatcaatactcctgacgtggcaacctgtcgagactcaggaccgctaggaaatcagctcttgtttacccctctatccattacactacgatccagctgggtttaggcatcacttcctctgagcaatcctccctgatgtcatgaggcagtgctgagtgccttctctggaccctctgtttacttgcctgttaaatcctgaacatctggaagggagtcgtgttcagcaacatatctacgccttgcagcacggtgcctggcctgcagctggtgttccgtaaacagctgctgactgacgggatgcatcgatgtgtttcccaagacatccaggagaggatattggcgcaaacagtgagtcatcactctccacccaccttccagactccctcctccatgcatatccagctcttctcaacctggggctcccttagaaaatccagacaaaacaattgccacagagccaacatcttccttttccctttgtcttatggtaaaaacatatttgtagaagcaaatccaataataaaagattagcacataaatacactgaaaagtaagatcactgacaaatacaccaagtgtcggcaaacagttctcagtgtcttggcacatgcggagcccatgttgcaggtggcatcaggcagacatggggcctaatcagaactcccactgaagctggacggccttgagtcagcaatgttctagttaatatctctcctccatttgtccccccgctctgcatttcctggttttttcaacagagtcatctggggaaaacccacacattttatgatattttgtcttccccttcctctctgttaaaa

SEQ ID NO: 2030 - DNA, 976 bp, Homo sapiens
gcctagatgaccccagcagctccctccccgcctgcctcctccattctgctttcacttttgtctcctctacccagcagccagagtgagcatataaaatgcagttctgatcctgtcacctctctgcttaaaactcttcagaggttcaccatcgcttccagaaaaagatcaatactcctgacgtggcaacctgtcgagactcaggaccgctaggaaatcagctcttgtttacccctctatccattacactacgatccagctggggcatcacttcctctgagcaatcctccctgatgtcatgaggcagtgctgagtgccttctctggaccctctgtttacttgcctgttaaatcctgaacatctggaagggagtcgtgttcagcaacatatctacgccttgcagcacggtgcctggcctgcagctggtgttccgtaaacagctgctgactgacgggatgcatcgatgtgtttcccaagacatccaggagaggatattggcgcaaacagtgagtcatcactctccacccaccttccagactccctcctccatgcatatccagctcttctcaacctggggctcccttagaaaatccagacaaaacaattgccacagagccaacatcttccttttccctttgtcttatggtaaaaacatatttgtagaagcaaatccaataataaaagattagcacataaatacactgaaaagtaagatcactgacaaatacaccaagtgtcggcaaacagttctcagtgtcttggcacatgcggagcccatgttgcaggtggcatcaggcagacatggggcctaatcagaactcccactgaagctggacggccttgagtcagcaatgttctagttaatatctctcctccatttgtccccccgctctgcatttcctggttttttcaacagagtcatctggggaaaacccacacattttatgatattttgtcttccccttcctctctgttaaaa

SEQ ID NO: 2031 - DNA, 4286 bp, Homo sapiens
ttgggccgcgtcaagctcccctcggagttggcctccatggcggcctgggcctcggcctcgcgctcctccttcttcttgatgccgtactgcgggggaggcgggggtcagggcgggggtcccggcggctcccgggcgggccgcagcctccctgcgccagggactggcccaggaacccccgaaggcgtgggtgcggccccctaccccaccaggcacacaaggaccccagaaggagaagagaccccaccccggggggtccctggaggaatgggaagcccccacggagaatgggggccaggagctgacatgggggggagcagggagggggaggctcccatcttccttgagaggagagagggctgtggccccacctctggctccaaacccagcccagcccctggcatcctgccttccaggaagcctccggcccggggcagggaggggtgggcaggatgctgcgtggcagaggtggggagaaacagtcaacccgcagctgaccctcctgcccagtgcctggtccacgacctgcattcacactcccgggcctggccaaggctgcctggatgcggccgcggccccagcagggccactccctggcaggccgctgcagctccgtgggcagccggcagagggtcctgggctgcggtcacttccaggcactgggtgtcctggaatcccgcctagtcgtgccctcagccagtatgcctgggcctcaccgaccccctgcccacccgcgtttctcatctcccgtgagtgcgtctgccctccgtagtagctgaatattgtccccctcaaattcatattgcctggagcttcaaaggtgatctcattcggaaacaggtctttgttgatctcataatggtaaggatggggacgaggccatcctggatttgaggggcctcaagtccagtgagagtgtccttgtaagagacagaaaggacagacacccggatgggggcgggcatacgaaagcggaggaggtcgcgagtggtcaagaaacaccagggattcggggccgccagacgcaggaaggggcagggaagggccctcccccagagcctccagagggagtgtgggattttgttcttctgccctccaggcctctaagtttttgtcaggccccggggttttggtttctagatcaatacgcctccccacgccacactcctccagccctcccgtgagccaccagcccaggaagcctgtggtcatggtcaggccacggaactacggaacagcctcctgctgcccaggaaggtccaaggtcctggatctgagattacaggtgctctggagtagtgaaggcgtcagcagctgcgtccaggagaaaacttaggaggggagtgggcaccagcactctacaggacggaggagcacaccgcgggatcaccagccacagggaggggcctttctgcccaggaggagcccctcccctgccatctcctgctcctgtctcagcagcccctccccatagaagcagttggttctgctcctggtgctgggcaccccctggatctccaaggaggcccctccttcctcccaaatggagggggggctgcctgtgtgctccccaaccccaccgagggcagtctcggcacctctcccctcccctagggctgcaggtggctctgggtgtggggggccagggccaccttcagtgagatggaaaggagggcgccacgttcccagccgcctgtggccagaccaccacctggccactgaggagagaggggccgtgggctcgccctagtcctcagcagcccctgcgcactcttgacagagccgggactccaggggtctcctcagtgaaacgaagagcacagggtaggaacgttctccgcacaacaggggcgacacccagagggccctgcaggcccagaacaaagccctgaccctgtggggcagcaagagcagattggttctcgtcctagccatccacagcgggaagggcagcagctccaggcacggaagtggagggagcatgtgctcttcgtcctgtggggccaggggtgtgctggggagagcgatgccactggaagctaggtccggccagagagcctccctccagccaggggtgtgggggtctgtgcatgtggcggcaacatgtgtatccagcccaggaggctgtgctgcccacagcaaaagcactcaggaacatgtgtgtgctcagaggagcatgcctgtaacggcggaacatgagttgtgtgagcaaaggaacctcccaggtcaggggagtgacccttggggcttgtgggaccctgtctgcaaacggtgtgggatccttccttctgggcccaggaaggagaccccaggccctgccaccaggttgtgggacactcggagcttggcctgaagtgccagttgctgcagtgaggctccaggtcattctgaggctgaggtcacgccggacttggcctgagggccagggtcactctgccgggaaaacaggctccggggctgggctgcacaccagagcctggcttccacgtggtctggctgagacccagttctgaggcgtctgctccagagacaaacgcccaggcacacccagccccaggcccaccgtgatgctgggcagcagctctccaggaagtaacacctgaggatgggagtggctgctgggggcgcccaggaggccctgacacgtctgagacgccggagcggcgagaccggcgcagaacgggcggccccgagcactgctgcgaccccgccggcctcgacctcgacaccccgcgaccccgccggaccctggaagcatgagctgcatcccgcatccgcaggagggcggcgctgcgacccacccccgcccccgtttccagaggaggccgctgcggcgcggggcggtcccacgtggtgcctgaggctgggacaccccgactctgattgcaggggggtcggatccgaggctgggggtcccgcagtctggctggggtccgctactggcctcgacgtacaggggccgaccccacccctacctcgttctctgagcctcagcttccccccgtgagaggtggaggcggtgggggggcgcaccgggcacgaccccgcggcaatgacggggctggcaacgccccccacagcggcacaggcggataaaccctctggggagggagttcagtcccagcgggaggggcccttcccacccgggagctcgccccaaaccgggtggagagggggtggggggggggtgcagatcgcggcgcctccctgccctctggccctgctgagactccaccgcccaccccacctcccggtagcagaaggggcagaagcagagacgtttcctctgcagacatcggggagggtggggtcagggccgcgcgtttccagccctgaggctcttcccgggaacccacctcccagacctttgctggagtggcacccacgctcccgagacgcccaggcagtttctggggggatctgcttatacagagcagccgcccctgaggtcaaaaccctgcccagggttcccttacacgatttacggaagagtcacaaagattgtataagagggctccctagacgctgacattgcagccaccgagtgttcgtcaaagctgagacctggacatggtaccagcgaccaccccactgaagacttcatgtgggcctcaccacttttccagatccgcctcccgggttcacgcaattcccttgcctccgcctcctgagtacctgggactacaggcacgcgccaccacgcctggctaatttttgtattttcagtagagacgggtttcaccgtattggccagggtggtctcgaactcctgactgcctgatccgcctgcctcggcctcctaaagtgctgggattacaggcatgagccactgcacccagcccaatgttaatttttaagaatggaaaaatgctttttaacttgaaataaaactacggggaaaattatagaattgaatgaaaaattaaacaatatctaaataaagaaagacacttgttatttttctggccagggtaactccacacgtaaagacgtccatcctccccaaactccgaagaattaagaagaaaattctgtgaaatctgacaagctgagtgttgcatacagacctgcaaaaggcccatttgccaggacagacacctgaaggaaaaagaggagagtgaggtccaccagataccaagacagaatgatgatggtgcagtgggaggaagacagacaacgggcccagagtggggagcccatccccagacccccacagacacaggacccccacgtgggaccagagacagagggcaggactcaaatcttcccctgacttcctgttggtgagt

SEQ ID NO: 2032 - DNA, 1094 bp, Homo sapiens
gttccatctctcggctttggagcccccctccctctgtctctgtacaagggagtttcttctttctttcttctcccttctttcttgcctattaaactctccgctccttaaaaccactccacgtgtgttcgtgtcatcttatctaattcgatgtgagacaagagccctggtgttcctccactcatcagagccatatcaacagagggtgactgtctcaaaaaaaaaaaaaaaaaaactcctctgaaaaacagaatttaaaactttaagtgggcaaacatcatttttatttttttaaaaagtcaacaaattcttataaccaacattcatggtctcaagtaacaagttgacagtttgagcatcagctgcagaagataaaaaaaaaaattgaggtatttgcaagaagctcttgctagaaggaataagaggggctgagcattgaagcctgggccagagatggagcccatccagaacccagctgtgctgctgcaaggtacattctgtctccctctctctttctctctttccagcacaccaaattccctacattccagggagggagttatctcagtctccaactgccccagagtggtgagcagcattccacacactccaagcatataaggaagaagtgcagtaggctggggactggcagaaggagctccctgggcagaagagccaggaagcaggaaaagctaggaacgcagacgcattgaagggtgaggggaacagaatttattgggtgaaaaaggaaaagaagaaaaaaaaatctctcagcaaagcaagaagagttcctgccaacagcacccccacccccagactgattccaggctacacacaagaactgaagaggccaggctcctccccaactgcacatggcacgaacttcccgtggctccacccccttctcccaagtgcataggcaggtcagagattctctggggaccctttcccttatctacctcctgcatctatcaatatggtgaaaccctgtctccaagaaaattgtgaaagttaactgggcctggtggtgcacggatgtggtcccagctacttgaaaggctgaggttggagaatcacctgagcctgggaggtcgagg

SEQ ID NO: 2033 - DNA, 4764 bp, Homo sapiens
ttttgtacgagtcattcaaataatagacgcaatctaggtaacttcaagagaagatgggaaggggaaggggcaaagcatggaaggcaaatctaaagattatgggcggggcagagaaaggttcgcacttagtacgcatgcgcataccaggcgcgacaggtgggcggacacagaaggcgacgcctagggctgtgttgtcccggaagtgccttctctcctcccgggtctgcgcggacgcggcctccttacctcatttgtcctcgcccctccccgtccctctacgcgttttggtccctgtttggtgctttctgtttgcagctacggcagtgagtatgtatgtgacggaccccgagtcacccgcggcctgggacccctgcctaccctccgtctcgccagccgagctgtggaactagcgcgtgccccctcgccgacctcggcgtctccggtccgcccctcacttgtggtggggcgcagctcctggtccctcagctgcgcgccgccccacgcggccgggctgcgggtctagggggtccgcatctccctggctttccaagggctaaggtcgtgattctagggcggctgggcgtccagggcctcggtgggggtggcgtgtctgccctttttatctccccgcaaggcccccagtcttctagggaagccagtcagtgaagcgcggaggtccgggcgcgccgagagagagtccagtctttgaggaccgagtagtcctgggccacctcccgcctctgctgtcagaagcagcagctgccgccgtggaatccaaaatttcgggagctgtgaccctttcctcatgtaaaacgagtagtcttggacggctggagtgtagtggcgtgatcatagctcactgtcaactttgaacacttgggctcaagctatcctccctcagcctcccaaggtgggaggtacagatctgggcataggaaccaatcagaaacaatcgcttcagcaatcaagaccattgttcatcatggaggaacccatggatacctctgagcctctatctgcattaccattcactgggcagcagtcttttgagccaagtggcaaatttggacagtatccatcgatgcagatgaaccacatccaggcactggggaagtggaggacatagaacagctcaatcagtgtttgatccaacacttccatctcattaagacaagtttgatttttctttgctttttatttcatggaatacatgagaatctcttaactgttggagtttccaaggaggcatacctcatgacttcagttaatggaaagaacaaaactaaaatgctgtatggccaaagccacaaagggaaggatccacaatttacattcttggagctatcatctgtactgtactgttgtgatctactgattggcattggcatagtagtaggggtcaagtgacagaatccgtgccagcagtctccaggttcagaagcaattcaagaccctgatgatagctctccagcaaccaacacatggtgattgtgccaacttgttgctcagttataatgcagggccagtgattggtttaagtgaagaccatggttgagatcatttgtctttggtctaatagaatttgagtctagtagaatttgagtctccagggaaagagctacttgaccaaattaaactagtagcaggtagagcatgaatgacagcatattataccatcaagatgttcttagagcagtgtatggatggatcgattgtactgccatcagttgtgactgacgttgtattcaaggagaaagagaaacttgtttagaaagcactttgaaagttttttgagtacgggggtgccctgtatcaccccgttatggttgaactttctccttcaaaattaccagacttggcagcagtggcaaattattgggctaaaagacttaatcagacatattctgggttcaaggctcctaatataatacctggtgcaaacattatacttccactcattcagatggttgcatcctgccaggcatccagtgggactgggaatatggacacttgaacattaaacatcctgaagaattttggaatgacaggttacaagtgaacataatcagttctctatattaaaaaaaaaaaaagatttgggcatagattgggctcacataatctttagagagattttttcatttttgtgaaagtacagaaattcttaactgcttatgaaatgctgattgttaaacagcatccacagctattttgtgttgtttccctgaccccaccctgaagaaaagaaaaattatggcatattgaaaacagcagtatgatgtaagagaaaagatcacaaattccttgagggtgggtcttttccatactcataagcctatttataatattcagagtaatttattgacacatattaatattccctcctatcccattaattgccaaatcatcaaacatttattgagcacctactctgtgtagggtgtaagcagtactggggacttacagtgataaaagacatagttttagccttaagtgatgtactgtttcactgaagagatggaatataagaagccaagtaatttatggaattctcttctttgtttttcttttttttttttggcagtggagtcttgctctttaaatagagcaaggctagtctggaactcctgggctcatgtggtcctcccgccttagctttcagtgtagctgggactacaggtgtgaacacagcttggaaatctcttaaccatgggagttaagtctcaaaattctggtgatacaagtggttgaaacttaaaactgtatttaaaaaataggattcgtgaatttgagatagttcataagtctgcaaaaggctgtataaatacatattttacatttactattattaattttgtagtaaatttgagtacagcactctctttatctgtggaaacttcagactctcccctattactttaatttcagtgagacattattaaatataagtgggcttacacatttgttttgctttactgacaaataatacacaacttggaggcttttttttcctttctattcttcctctaaatgttcaacacttttctgattttgtgatttgaggttgtttaatagcttcctgaggctccattgagaccgtatatacgtgacacttaacagtctagccttcctcggtacatatagatatatgatggtggctttgcctgtagtaaattcatgccaaaacataggctttcagtgcctattacatatggctttcagctctctctactgagggatgtaggagtttatttctgaggtctgagcctcttttcctttacttcctttactctttcctaagccttctttataaaaactatgcatgttctattgttttcctttttgattccctttcttttattatccccagtaggagtgacttgtaattctcatatgttagaaaggcagatctcctggttgaagaaaagatccacccaagcaagtcagcatgtttaataatttttgagggggatctcaaatgtgggaaggattgttatataagacaaccaaatgatgacatgagacaataaatgctataggaattatggaggaataattagctatttattttcttggttagggaagagatattattagttgtagaagtaattactaacttctacattttttattgtggaaatcaaaaatatatatatgaaaataaaatgttataattgacttcagtgtcccataaaccagcttcaacaattaccaaattgtgaccaatctttacacacatgcacaggtgtccctcagtatctgtggggcattggttctaggaccacttatggataccaacatctatggatgctcaagtccctgatataaaatggtggactatttgcatataacctgtgtacatcccgtattatttaaatcatccctagatcacttataatacgtaatacaatgtaaatgccatgtaaataactgttatactgtattaaggaataacaacaagaaaaatgtacatgttcagtacagacgcaattttttttgtgtgtggaatattttcattccaaggtcagttgaacccatggacataggaggctgactgtgtgtgtgtgtgtgtgtgtgtgtgtgtgtgtgtgcatacagacacacatatttctgaaatgtaaatattctcttcttaaaaaaattattatcacagctaaacaaattaccagtaattcttttatcctcatatacccggtgttcagattttctagattggctcctaatttttttacagattatttgaatctgattcaattcatgtactgtaatgtttgataacttaagtaccctttataggttctcttttacctcttctttattaaattccttgtaatttgttgtactaaatagattgtcttctagaatttcctgtagtctgaattatgtagtattgtttcacatgttccagtgtcctcttatttcctgtgagttggtagttagatctagaagcttgattaaattcagattttctctctttagatcatcaactttagatcatcaacttggatcatttgtttcattttgcttttgatatgttgttttttagaattacctcttaaaattttgatttaattttataatcatgtaaaatgtttataaatttccaaattcagatcagcaaaacacaataaaatctattcagagaaggcaaaccttctgtccagtctccatcctgttcctgctcttccccttatgggtaaccattaagagaaaattggtggttggtccttacatttaaaaatatatataatcaaaaaactgtat

SEQ ID NO: 2034 - DNA, 4002 bp, Homo sapiens
ggacacagaaggcgacgcctagggctgtgttgtcccggaagtgccttctctcctcccgggtctgcgcggacgcggcctccttacctcatttgtcctcgcccctccccgtccctctacgcgttttggtccctgtttggtgctttctgtttgcagctacggcaatctgggcataggaaccaatcagaaacaatcgcttcagcaatcaagaccattgttcatcatggaggaacccatggatacctctgagcctctatctgcattaccattcactgggcagcagtcttttgagccaagtggcaaatttggacagtatccatcgatgcagatgaaccacatccaggcactggggaagtggaggacatagaacagctcaatcagtgtttgatccaacacttccatctcattaagacaagtttgatttttctttgctttttatttcatggaatacatgagaatctcttaactgttggagtttccaaggaggcatacctcatgacttcagttaatggaaagaacaaaactaaaatgctgtatggccaaagccacaaagggaaggatccacaatttacattcttggagctatcatctgtactgtactgttgtgatctactgattggcattggcatagtagtaggggtcaagtgacagaatccgtgccagcagtctccaggttcagaagcaattcaagaccctgatgatagctctccagcaaccaacacatggtgattgtgccaacttgttgctcagttataatgcagggccagtgattggtttaagtgaagaccatggttgagatcatttgtctttggtctaatagaatttgagtctagtagaatttgagtctccagggaaagagctacttgaccaaattaaactagtagcaggtagagcatgaatgacagcatattataccatcaagatgttcttagagcagtgtatggatggatcgattgtactgccatcagttgtgactgacgttgtattcaaggagaaagagaaacttgtttagaaagcactttgaaagttttttgagtacgggggtgccctgtatcaccccgttatggttgaactttctccttcaaaattaccagacttggcagcagtggcaaattattgggctaaaagacttaatcagacatattctgggttcaaggctcctaatataatacctggtgcaaacattatacttccactcattcagatggttgcatcctgccaggcatccagtgggactgggaatatggacacttgaacattaaacatcctgaagaattttggaatgacaggttacaagtgaacataatcagttctctatattaaaaaaaaaaaaagatttgggcatagattgggctcacataatctttagagagattttttcatttttgtgaaagtacagaaattcttaactgcttatgaaatgctgattgttaaacagcatccacagctattttgtgttgtttccctgaccccaccctgaagaaaagaaaaattatggcatattgaaaacagcagtatgatgtaagagaaaagatcacaaattccttgagggtgggtcttttccatactcataagcctatttataatattcagagtaatttattgacacatattaatattccctcctatcccattaattgccaaatcatcaaacatttattgagcacctactctgtgtagggtgtaagcagtactggggacttacagtgataaaagacatagttttagccttaagtgatgtactgtttcactgaagagatggaatataagaagccaagtaatttatggaattctcttctttgtttttcttttttttttttggcagtggagtcttgctctttaaatagagcaaggctagtctggaactcctgggctcatgtggtcctcccgccttagctttcagtgtagctgggactacaggtgtgaacacagcttggaaatctcttaaccatgggagttaagtctcaaaattctggtgatacaagtggttgaaacttaaaactgtatttaaaaaataggattcgtgaatttgagatagttcataagtctgcaaaaggctgtataaatacatattttacatttactattattaattttgtagtaaatttgagtacagcactctctttatctgtggaaacttcagactctcccctattactttaatttcagtgagacattattaaatataagtgggcttacacatttgttttgctttactgacaaataatacacaacttggaggcttttttttcctttctattcttcctctaaatgttcaacacttttctgattttgtgatttgaggttgtttaatagcttcctgaggctccattgagaccgtatatacgtgacacttaacagtctagccttcctcggtacatatagatatatgatggtggctttgcctgtagtaaattcatgccaaaacataggctttcagtgcctattacatatggctttcagctctctctactgagggatgtaggagtttatttctgaggtctgagcctcttttcctttacttcctttactctttcctaagccttctttataaaaactatgcatgttctattgttttcctttttgattccctttcttttattatccccagtaggagtgacttgtaattctcatatgttagaaaggcagatctcctggttgaagaaaagatccacccaagcaagtcagcatgtttaataatttttgagggggatctcaaatgtgggaaggattgttatataagacaaccaaatgatgacatgagacaataaatgctataggaattatggaggaataattagctatttattttcttggttagggaagagatattattagttgtagaagtaattactaacttctacattttttattgtggaaatcaaaaatatatatatgaaaataaaatgttataattgacttcagtgtcccataaaccagcttcaacaattaccaaattgtgaccaatctttacacacatgcacaggtgtccctcagtatctgtggggcattggttctaggaccacttatggataccaacatctatggatgctcaagtccctgatataaaatggtggactatttgcatataacctgtgtacatcccgtattatttaaatcatccctagatcacttataatacgtaatacaatgtaaatgccatgtaaataactgttatactgtattaaggaataacaacaagaaaaatgtacatgttcagtacagacgcaattttttttgtgtgtggaatattttcattccaaggtcagttgaacccatggacataggaggctgactgtgtgtgtgtgtgtgtgtgtgtgtgtgtgtgtgtgcatacagacacacatatttctgaaatgtaaatattctcttcttaaaaaaattattatcacagctaaacaaattaccagtaattcttttatcctcatatacccggtgttcagattttctagattggctcctaatttttttacagattatttgaatctgattcaattcatgtactgtaatgtttgataacttaagtaccctttataggttctcttttacctcttctttattaaattccttgtaatttgttgtactaaatagattgtcttctagaatttcctgtagtctgaattatgtagtattgtttcacatgttccagtgtcctcttatttcctgtgagttggtagttagatctagaagcttgattaaattcagattttctctctttagatcatcaactttagatcatcaacttggatcatttgtttcattttgcttttgatatgttgttttttagaattacctcttaaaattttgatttaattttataatcatgtaaaatgtttataaatttccaaattcagatcagcaaaacacaataaaatctattcagagaaggcaaaccttctgtccagtctccatcctgttcctgctcttccccttatgggtaaccattaagagaaaattggtggttggtccttacatttaaaaatatatataatcaaaaaactgtat

SEQ ID NO: 2035 - DNA, 1063 bp, Homo sapiens
ctgagatctagagagagtccagagctggtctgaaaggctgatacaaaggagtctgctctggaactgaggtattctaagaacttggctatctcagcagccctacagatgggagaggagcccacagatgggagaggaagctattctcctggccaaggtcctgagacagtttgacagaagcctaggcagacttgaggccgactgcagctagcactggcactcgaaatgaaacctcccctgtagtcccatggatagttttttgtataaacatagaaattgaccattctggtcttaaagcttgaaacttttatttgttttctatgagtttcatccttggtaaaggacccctaggtccctcaaaaagtataaaagaactgaaattcaccagatgattccatccagatgatggcacaccagacccctcatacattatgattgcttccttaggtctcctgagttcctgtttttctacacatggttacttttcctccctgctatgtaaactcataattttagctggtcagggagatggatttgacactgaactaccatctcctctcctacagcatctgattcagccttctcccttggcaagaattgttgatatgaattggttttctgtgcagtgagcagctggagctagaccacacccctggtgtttcactaacagattttgattccccaaccaggaacactttggctcagctaccatgggcggggaatctcaaagtcctcctaagcagctgcttacccaattttggctagagatgagtaccctctctctagggccagccacagctggccccaaccatgttcctgattgccttgggagaactgcctttgaaatttgatatttgcatccagataggtgactctcctctgtgggcccagacagaaagatctcctcctcacagtttgggaaatttttaaaggaatttccacttgcaggttgaacaagcccaattgatgaagagagggaagtaccctgactatttcagtacggacactcttaggagcttgtttgtcattgtgtgtgtatccagataggtgactctcctctgtgggc

SEQ ID NO: 2036 - DNA, 1063 bp, Homo sapiens; identical to SEQ ID NO: 2035

SEQ ID NO: 2037 - DNA, 825 bp, Homo sapiens
ctgactctggagagatgtttgtgtccaggtgatgctgtccagtgagagggggttgcagtcagagtgaggctgaccggaggcctctgtccagttggtgccctgtggaatgtgattacatactggttgacaccatcctgaggaccatcaccagctgagtgtctcagccgccctgtgtccctgggttctgtgctcttgtgtgtggtttgacactattccagtgcgtggagaccctgcctcctcactgagaccttgcaagaaaaagaacctgcagtcaccccaaggaagaggagtctcggctgttccctggaggctgacccagccctggcccaaaggctgacccagacccaaggcccaaaggcccacccagacccaaggcccaaaggcccagctctaaggtccaaaggggctccaccctgttctctagccggactcagtctctggcaaggaccccggctgccagctgcactccctagacgcacgtggcccaccccctccttccagtaccggagccctaactggcggcacccgggcacccttttgactcagagccacgctccacgagggggaccgatctgctcacttgccccgtcctgggggtaccagagtagccagcgcgacgccttccgcacctcgcctaggctgcccttgtgcggccgccctcagtccccgccaccttgcggggccccaggcggcactggcatcttcttgtggttcttcctggccggggctcggtgcgctccgcattctgctgggccgtccggggcgtcgtctgcgggcctggaggcggcgaccagggcgctcacggtgccgagcgtccgcggcagg

SEQ ID NO: 2038 - DNA, 825 bp, Homo sapiens; identical to SEQ ID NO: 2037

SEQ ID NO: 2039 - DNA, 484 bp, Homo sapiens
cctgcagaggtaggctccgtggtgtctcccactccgccccaactggagaacggtgtaaagaactgtcagccgggtgcagtgggagacaccacggagcctacctctgcaggaggcatagcttggcagaagggagacaccagccagaggaagggtgcattttaggcaccgaactttaggtaaagcgctctgggtcaggcgtctcctccagagtggtctgtttaaagttaaaaaggtcgccttcaaaatagttgtaaaatctatacacttacccagacatacacatttttcgagacagggtcttgctctgtcgcgaaggctggaatgcagtggtgcagtcgcaagccatcttcctgcctcagcctcccgaggagctgggaccacaggcccgcaccaccacacccggctaatttcgttttctgtttgttttattttcgtttgtttgttttggaaggatggagtctgactgtgttgcccaggctagtct

SEQ ID NO: 2040 - DNA, 484 bp, Homo sapiens; identical to SEQ ID NO: 2039

SEQ ID NO: 2041 - DNA, 1070 bp, Homo sapiens
gttggaaacgcaaaaccaactcttgaaaaaccttgaaagggccagcacagcccacagtacaaaatgaagtccgaccctgaggagatctttaaaaacaaacaaacaaacaaaacaaaaaacacaacacccaagcctcccttctcccagtccagaaggagagcgaaaggttcacgtcccagtccactaagacagcacctgtgggcgcaggtctctgcggaaggcgcccgcgcccccggctcagactcctcggtgccgtccctgcacactgaaggcgatggctccccggggacagagtccctctccgggcctctcagcagcccgggcggcggcttctctccacggttttcgcgggcgcttcccccaggatggaggggggtggcctcgcctcaggtctgcgccctcgggccgacggttcgacgcgcgctctgggctccggcagcgccgctcggggtcctcagaaggccaccacggcccgcacgagcacgttgagcatgctgtccgccgggcggcaagcgggctttgcctcgcacgcgggcggcgccgtcggaggggccgcggggctgcagttcaggaggccggagaagcgcctctgcaggacgcgggccaggttgggaaaggcgccctccgcttgcgccggagggggctgcaggcgatcggcgacttcggatgacgctccctcctcttcttccttttcttccagacgggctttcttgctcgggaccagtccagcgtccccgccgtcgctcaggctgctgctgcgtcgtttgcggctgactttggcggggcgcggggcacagcaggcggagaggtagagctcccgggcgctgcgcatgaccagcgacagctgcagactccggtgcagccgcaggccaccgcgctgcatgcgggagtgatacatcttccacaccgacagggtcatgatgcgctgtgcctctttctgcacttccatggcgactcgacggcgacagcggcgggggctcccgggagggacagaacaggcagcaggtgcactccggacaacgggctcgctcacgcctctctacacaaaccaacccacgcagtgacactgc

SEQ ID NO: 2042 - DNA, 1070 bp, Homo sapiens; identical to SEQ ID NO: 2041

SEQ ID NO: 2043 - DNA, 1070 bp, Homo sapiens; identical to SEQ ID NO: 2041

SEQ ID NO: 2044 - DNA, 1070 bp, Homo sapiens; identical to SEQ ID NO: 2041

SEQ ID NO: 2045 - DNA, 4074 bp, Homo sapiens
tggccctgtagacagatgtcccactttgctgccccatattggctggactctgagtatgacatctctcctatgtgcagaagtctggttgccactgggagtaggtgggaccagggaaatctctgggacgtgagtgtggaggcctgttggtctagactctagactgtggagctctgagcttttgtgtcctctggaaggaagctggggaagaatcctctccattgttaagtgacggggatagaagctgtcctgcacaggaagtcacgaggggggcgtatcccacgaggaaggcaggagggggcgtgcccctcaccggaaattagcagaggggcgtgtcccacaccggaagtcagaaagcggagcctttcttacaccggaagtcaatgaagcgggtctttcctacgctaaaaaccactgagtggagtatttagtacacaggaagtcggccagagaaacatttctcatatttgaaggccggaaagagggacatttctgacaccggaagtcagtgagaggactctttcccacacaggaagtcagctagagagccgtctcccctctctggagccgagagaggccggtttcccccaccgtaagtagacgtggggccgtgaccggaagtccttgggaaagatccgtcccattcccggaagctagagggcgttagttgtcgggttgaaaaggggtgtggggaggggaagcagctttaccccgggctcggagtttgcaggagagagaagtggggagcaagaagtgaacctcaggggctcacagggttcccgcagatgctcaggccggccaggaatgcatctctggctctctgttcccacggacgtcactgcctcagccagcctcccccagagcccgccagccgctaagccggggccacacctgggggtgatttcatgcctcacctccagtaggcaccttggtttctttgggctaatctctggctcccttgcgctaactcttgctctcacccagctaatccctgcctcaccctgactgccccaggggctgaccactaacaaccaacctggccctgtctgggggttccaggctcctggcctggccctgaccggttcttaattaacctttccttcaccttgactaactcctgccttcctggtctgttcctttcagcagaaactaatggtttgtggatttttttctgactaacaacaggtctaacattcctcgttactgttaacagcttggatgtcggcatggctgggaaggggctaacacagctttgaacttggctaacacaggtttgaacttggctaacacaggtttgaacttgactaacacagggaaaagcatagctaacaattttgggcgtggtggctgctctgagtcagaacaatcagaagtcggtaaagatggtagttttctaaaggaggtgccagggctctggtgtggaccaggcctgatggagcagtggtacccaccaaggtggggtcagaagtatagccagtcttgcaaggttttggccattgggcatatcttcactcctcatagtctgcatttggtttcagttcttaaaaaaatatagccttatagctacagtagtttgcacaagtagatgcagctcttataaaccttaaaatacctgtctggtgtctacagagcatatgccattttgtatagagtcacccttccccaggccagggcctagagtcttcattttggggactttgtgttttggaagttctaggacataaagctttagatcagagtattcagaagggttataactccgtcagtcatttacatgttagtagtataaattatctgagcttcctgttctaacttttagctcttctagcataaactcttctgtgcaatttagctgcaccgaggaaacgggagtttttctggaagggacttttgatctctttagactgagggaacgtcctttgggagtagaggggcagggagcatacgcaagggattccaggtgcaggtaaaaggtggcactagttcaaggttttgctgactcagtctggtagtcagagtctgcaggagaagacagttcaaggcagggcctggaggattggatcagtttagggacaggtcaaaggctggcttacagaccttagaggcaggttgcttgggtcgttgaatgctagtctggtgctgagagcccttttctctggcaactgtggactcagagctaaccaattgtagttggcagtgggggtgaagggtgatccagaggcctgagctgcagagggcacaagagagaaaagatgtcttagaaagagctttgagaacatgccttggctgctggcagggaccttggatggggtagtctacacccggaagtgcctgcctgccatcctctagtggctgccttgctccatttcactcaaagcaggaagctcacacctcctattcctgaaactcctctttgtttaactgcaaagacttgatgctgctaaggatctactatgtgccaggcactgctctgggcgctgggacctgcacctgggctttttcgtcatggtgcttttatagcctagtgggagagttggtgaagtagatagtgattcagtgagatgggtgttatgattggtcaggggtctgtgggagcaccaaggagacagacaagattgatgtgcacctactctgtgccaggcgtgtgccaggcattggggatgtagtggtagttaaacaccatttggtcttcaggagctttaattctagtgtgttgggtgcaggggggtggaatggggacagagagacacctaatccaccctgtggtggctttctggagagggaggcatctaagctgagctgtggctgggtggagtgtgggtggggatgagttccgggcagcgagagtggtggacaccagtttctggggatcagagaggatccaaagaggttctggaaggttcatgtggaatgtagcaagagataggagacatggacatggtgccgggtctggttgccaagaagtttagattttatccttaggccttggggagcgacggatatgatctgagaaagggagttagtggatttgagttttaggctggccatttggcttttccagcccaggtggaactcagaggagtttgcaatggcctctggccacattttagacaactgagcagaactttttgaaactaggaagaccctttggtccatcttttgataaacagaatccatacatgtctaccccagttggaagtatctctgcaatgactggaaagtaaagaggaccaaggtgaaaataaaggctcggaaggggagcaatcttgaaaacatgtcatcccatggtggtgggaagtccctggagaagatcaggggaaacacagtcataggctgcaagtctataagataattccattggggagggagcccatttgtcatgcatggctgcaaggggcagatacaagtgtggagtaagcttgcaagagctgatcctggtcccagagagggaaaaatatgccttggtgggtaatgaaccttttgttcccagaggcagaaggattgggactaggccaacatagagattggcgatggttgtgagattctaagagtgtgtgtgcatcttgacaatattagaggaggctgagcccaagcaggcacattctcttcgacccctccctcattcagtctgctttggagtctactgaacatcaagcttgctatgagcaggatcttagagctgaggaattggcctcccaatccgaacaggtgttataatcctttcttaataggttgtgctgtggacccaatgtgagggctgtgctggtgtaaatggtgacatgttgagctggggggatgctttcggggtggggggactggttccattccatcaaaggccctcttgagagtctatccagggacccattgttttactttaacagaccagaaaagatgtttgttttccatgtcattacccccaggggataccgaatgtgtgggtagaaatttctctgtagattaaaaatcagatttttacatggattcaacaaaggagcgtcacttggatttttgttttcatccatgaatgtagctgcttctgtgtaaaatgccattttgctattaaaaatcaattcacgc

SEQ ID NO: 2046 - DNA, 4074 bp, Homo sapiens; identical to SEQ ID NO: 2045

SEQ ID NO: 2047 - DNA, 4074 bp, Homo sapiens; identical to SEQ ID NO: 2045

SEQ ID NO: 2048 - DNA, 4074 bp, Homo sapiens; identical to SEQ ID NO: 2045

SEQ ID NO: 2049 - DNA, 1180 bp, Homo sapiens
ggttttccaggcttcctgtgctgtcttggggacctgctcagaggctggaccgcgtcatgctcagaaggctgcctggaatttgaatgtggtatctggagcttcagtagtcatccaggactgtaagtgtgaaagccatgcactgagagtggtggaacagaagccctgttttctttagacgctgactcctgctgtctgccagatcctcgtggtacaatgactggtgtagactggcttgttgaagtcactctctggatctgagcaacgctggctgagccgtgatgaagtattcctatccatccactatgcttcacagtgggaatctctcactgttcatcaccgctgccctagcagccgcagggattcttcacccatggttgcttaggtttataagcaaggaagctgaatgaagtccctttcctctctggatgagcccctgggtttctggaagagtcttaaaatcacccctaaatggcttccaagcactgaagcccgagatgttagctggcctgtgtgaggccttgagacagaatgccacagccacaccccaaggatgctgaaggggatttccctcctctgtggtttttctcctttcttcccgcagcactcctcctacgtgctaacatcttctagtcaaacaactctccttttcaaagggaccaggcacagtttctgcttatccctgagtagcagtgttcagtttcctgccagcctgtggagtttttcaaacaagccaatcacctcctcctgtgggaactgagaagcaccccaccctctcgatactacaaagcccctgcttgttccctagtgcaactcccatgtggtcctgtggagcatatggtatcttcctcttctgggcagtgagcatatgtgactaataaactatctatctcatctgttcagtgccaggtgtcatttgttctgccatcccatgacctagggtggggattccttccacaccaacagggtgaatgcaaggtgattaaaacaagaagcctcttcaggatctatatcctagggaaaaaattaaacaacaacaacaaaacaagaagcttcaactctgaccctgtattccagatgtgttacaggggcctgtctccccagagccactctccaggtcagagcttacctccccttgctcagggttaggagctctgggcaggaaaaggacatcatgttaaaa

SEQ ID NO: 2050 - DNA, 1180 bp, Homo sapiens; identical to SEQ ID NO: 2049

SEQ ID NO: 2051 - DNA, 3656 bp, Homo sapiens
aaacattcagaccacagcagaaggttgccctaaattctggagtcggggaggggggaagtatcgcaagaaaacaggaacactgaaagacatgggctccttctcagatcttagagaacaaaagaaagaactaaatggagatgtgggaatcacaaggccatagtttagggtctcgcagtgccattggcaacaaagcctgagagcctaggcgatagaggcagaacacccagaggagaagccccttccccttgcaccgtgagcctggtgtttgcagcttggtagcagtggcaacagaacaatcagctctcctacaataaaccagggacggaacaaacaacagcagcagcggtcgcagggaaacagaatctgtgttggcgtgcagggagcaggcagcgtctgcaaagtagcgctggcaaccacaacagagaggccagcaacaggaggagcaggaggagcccaatgaagcgtgctgtggaggacaaagagcagcagaggcaggaagcagtgacaaggagtgagctgggaaattccagctgccctcctgtcctacttacaaggaatagcctggaacaagtacagttgactctgaacaagtcaggtttgaactgcatgggtccactcatatgaagatttctttcaacgaaagctaccccgagtgtgcctgcctttcctgcctccccttccacctcctgcacctctaccatccctgccacccctaagacagcaaggccagtctcttctctctccccctcctccttcagcctattcaacttgaagatgacaaggatgaagagctttatgatgatctacttccccttaatgaacagtaaatatattttttcttccttacaattttcttaatagcattttcttttctctagcttaccttattgtaagaatacagtgtataatacataaaacatacaaaatatgtgttaataaactgtttatgttattggtaaagcatctggtcaacagtaggctgttaggaaagtgtgagggtagtcaaaagttaagctcagatttttgactacgcaagggtcggcatccctaaaccccaagttgttcaaggtcaactataattccctattactcctcactcttcctccctccttcctcctcttcttccttatcccttctccttcattttccccacaggctaactgcaactcagcccacttcatttcctaatttttcctcctccctgcatccccccgagtctttgtgagatgctcttcccttcactcctgccagccctatggcatcatggcattatcatggtgtatggagaacttctgtcttatctgtttctcccactaacccagtggttttcaactggagacaattttgctcctcaggggacatttggaaaagtctggagacatttttaattgtcacttctggggaagggggttgatactgtcatctactgagtagaagccaaggatgctgctaaacatcctacagtgcacaggacagcccctcacaaaaaaggattatcaggccccaaaggccaatagtgctaaggttgagaaactgcactaggctgagttcctttaaaatatgaccctattcagcgctgttccagcagctccacagacagtgtccagtgcccagtaggaaggaatccaaacagttttaatattacatttgaaattttaattgaaaaactcttctgacagctgtatgttataactaataagcaatatgaccacataccacaattcaaaggaaaaccaatatccagaggtaaaggtggcttacacccatcagtctttgacacttcctcctatctagttctctgtatttcttccctttctccttttctcttgtccctgtgctcactgtccccctttactgtcatgtttgtttgaattccacttcaaaatgggaatttgaacagagtgcaataaattgtcccacatttgtttattttaggaaatcattgcatttaattttaacatttaaacatatcaattaggccaggtgcggtggctcacgcctgtaatcccagcactttgggaggctgaggcgggcggatcacgaggtcaggaaatcgagaccatcctggctaacacggcgaaaccccgtctctactaaaaatacaaaaaattagccgggcgtgatggcgggcgcctgtagtcccagctacttggggagccgagatcgcgccactgcactccagcctgggagacagagcaagactccgtctcaaaaaaaaaaaaacttatcaattactgggtgacatgctgtgcactgcaagaaaaacaaagataaataggaaactgggactatcctaactgggggagatttctgtagcagtagaaaagtagaggaaatatagttttatttcactaatgtgattagggaatatctcatggagaaagtcttcgatttaggtcttcacacatgtttcataaagaatgttaacacaccacacataggtaataatgttgtctttccttacctggcatcattatgagggccactttttggggcaatgattcctaaatttcagcaactcctggagggcttgtgaaagaaagcacagattgctgggttctgccctcatagtttctgaggcagtaggtcttcggtgaaatcagaaaactggtgtttcttttttctttttttttttgtgacggagtcttgctctgtcacccaggctggagcgcaatggcgtgatttcagctcactgcaacctccgccttccgggttcaagcgattctcccgcctcagcctctgagtagatgggaaacagtcgcgcgccatcatgtttttgtagaggcggggtttcactctattggccaggctgatcttgaactcctgacctcaggtgatccgcccacctcaacctcctgaagtgctggggttataggcgtgagccacggcgcctgtttgtttttttttttctaatcagaggttttgctcttgtcgcccaggctggagtgcaatggtgtgatcttgtctcactgcaacttctgcctcccaggttcaagtgattctcctgcctcagcctcccaagtaactgtgatttcaggtgcccgccactacacccggctaatttttgtatttttagtagaggcggggttttgccatgttggccaggctggtctcaaaactcctgacctcaggagttcggcctccgaaagtgctgggattacaggcatgagccactgtgcccggcctagaaaactggtgtttccaacaagtcctttggtgctgctggtgctactgcgggccttctgaggagactttgagaaccgctgcatcaggattatcagcctggtaactcctggccgaagaaatgcacacccttcatttggctaaaagaaagaatttccaatattcataaagaaaacacaacttgtgggttctccaagcaggagaggaaaaatcatgttccagtctattcctgtaactaatgaagggctcaggtttcaaagaccctctgtcctttggcctgtactggagtctgacttgtccagcagcacattgtcctcgtggtgaattctcttatcaggcctagtttacaaagaaaagtgtaagagaacctgcaatgactttacctgagttcttaagcagactaccaggttacctactttaaggaaataagcctggctcctttggccatggggatggttggaactcagacctgg

SEQ ID NO: 2052 - DNA, 1170 bp, Homo sapiens
atgttgctatgtcaaatgttctcggaactcacagatccaactaagtcatgaagccctaggaaacggggactgtagtctctcaggatgatgtactggcctaagcagaacaagtttcttttgacactgcttcttgttcacacctttcccgtgccctgttttctttagacgctgactcctgctgtctgccagatcctcgtggtacaatgactggtgtagactggcttgttgaagtcactctctggatctgagcaacgctggctgagccgtgatgaagtattcctatccatccactatgcttcacagtgggaatctctcactgttcatcaccgctgccctagcagccgcagggattcttcacccatggttgcttaggtttataagcaaggaagctgaatgaagtccctttcctctctggatgagcccctgggtttctggaagagtcttaaaatcacccctaaatggcttccaagcactgaagcccgagatgttagctggcctgtgtgaggccttgagacagaatgccacagccacaccccaaggatgctgaaggggatttccctcctctgtggtttttctcctttcttcccgcagcactcctcctacgtgctaacatcttctagtcaaacaactctccttttcaaagggaccaggcacagtttctgcttatccctgagtagcagtgttcagtttcctgccagcctgtggagtttttcaaacaagccaatcacctcctcctgtgggaactgagaagcaccccaccctctcgatactacaaagcccctgcttgttccctagtgcaactcccatgtggtcctgtggagcatatggtatcttcctcttctgggcagtgagcatatgtgactaataaactatctatctcatctgttcagtgccaggtgtcatttgttctgccatcccatgacctagggtggggattccttccacaccaacagggtgaatgcaaggtgattaaaacaagaagcctcttcaggatctatatcctagggaaaaaattaaacaacaacaacaaaacaagaagcttcaactctgaccctgtattccagatgtgttacaggggcctgtctccccagagccactctccaggtcagagcttacctccccttgctcagggttaggagctctgggcaggaaaaggacatcatgttaaaa

SEQ ID NO: 2053 - DNA, 1170 bp, Homo sapiens; identical to SEQ ID NO: 2052

SEQ ID NO: 2054 - DNA, 12721 bp, Homo sapiens
gttcatttcttcaggccatcaagcagccttcaaaaacataaatttcattagttacaatgtatttcatatagatatacgataactgccttcaccaatcttctatttctggacaatacaatttttattttttttcttgttttgcttttggttattataatcaatattcctgtgaatatgcttagtttagaaagccttgactcgctgttattataatttcagtttataatcaggaagagggaaagcctaactctaaggttgaaactaaatcttaaagctagtgacacagcctctctgagctttgctgtcctcttctgtcctatggtaagaatgatactgaggtcctagggagctgtgaagcatatgctgtgagacaacacagctgagcagcccagccagagccccctggggaagccgtcagaggtcagccgctcccgtctgcttccctcttgactcctaataggctgggacagaactttgccctcccttcttcctgtccaaaagacgcacaatgataatgatgctgatggttatttagtaagaaacttcccaacaggaacagttgtcaggagggggcacagttggattctctccagcaaagatgtcagggtggatagaaatgtcagcgtgatccaaagaggacacaaacactcctgttattttgttgtcaccatagaaaggccagctgtaggtttgacgaatgtttagtgaaagaaagtttgcaaaagtcaaaaagaaactgacataatgatagccaaacaggctttctctgcattagaagaactcaataggtccttgcacgtctgattagagcaaaacaaaacaaacaagcaaaagctcccctgatgcacagagttagtgctccactgaactagaccagaagagcttgtcctgccccttggaaacaggggccaacatgatgcggtgggcaaggacccatcatctgacatgaagatgccctgggggcaatggaaagcatggtgtgtccggagaagatggccctgacggcaggtgcattcgggtgctagtgagtgctgcagcatgttgggtctctagttttgtatcagtcagctactctcacagtcacactgtgtaacaaaccacccccaaactcagttacaaacgatagtacttatttctcattctcatgtccacaggtctgatggggttcatcacatctgagccaggactggcttttcttggctgcaagctgaaagttgggtccaggtctgctgtactgagggtctcctatcttccttggacagggacaaccagaggcctatttatctcatgatggaaggcaggagaacaagcaggcaagaccagctgtgctagcacatgccacctctttgcccacgtcacacctgctgacgtcccattggccaatgcaagtcacacaaccaaagccaacatcaacaggacaaggaaacagactctgcctctagatgcacaaactacagagtcacggacagaggacacggatccagggaaggaagatggagaatgagaacaatgaccctcaataacacagcctcccacaggtttccaaatccccaacccaggcatatatccaaggaaatggaatcatgggttcaggttttagagcaagcaatttctgctctccctgcctagtttccacacccttaacacaggggcaatgatgtcacatcaaaacatatcatacaaatttgtgatgatgtttcaacaactaaacaccagaaaaatgcttagggcagggccgggtaggaggggcagaagccaatagtaacttaacatcactgctaacccacaaagttctgggaatttctttgaatgtctaattagagaaccatgtccccaagaattaacatttcttttgcttttttttgaatctgagaaaatactaattgtcacagggtagaatatttatctgatgagcatatagaagttaagggctccttgaaatcacagtgctaggtttgggtctcattcctcctcctacctgcctctctgagcctcagtttctcatctgtagaatgggtacaatcccaacctcatgtgtttgtggcagtcagggttaattgggctaatgattctaaagtgctctgcgcaggcctggcaggtactgagcaaccttgggccatagagagagcactgacttgggagtcaggagctgggacctcaggtcctattccctggggatccgggaaaagtcccttggcttccctgagcttcatctgccccacgtgctagtgaggtggctagaccagtcaggccaaggacgtccctgcagctatctaacttctccttactccctgttcagcaaagggcaggagctgggcctggccaggctcccacaaagcccaggcgtggccgtgctcagctcacgacgggtgtgggggatgcgtttctgccctcaaaggactgagctccagtttctttcttcactgagtcctttactctctgcctgcgggtggttatttaagacatctcctgcctgcaggggcctcttagagaacaaacagatcgttccttcagctgcagtgcaggctttactgggcttgttcctgcatcaagtagacagatccttcctgaatggagtcgccccacaggccccacactcggagaggggcagccaggagcctccgaggctctgcccagcccgtcctgaatgtgctccctgccctgagtggagcgctcacagctccccgcatcaaggtttctgtctccccaaggatcttcctcataaaaacccttcttctcccagatcccacaaaccgacattataaaaaacacaaacacccaataagcaccatgtaaattgatcacatacaaataatatccaaaaataagaactcgtataaccactttaaactatagaacatgtctgttgggatttgtgggagatcatggatcacaggttccccctgctcctggttcagcactgtgagaaatggaagtgaggttcacccagggacgggaaagcgtcagctgccactcatgaggctggggggcaggggaagcccttcatccgtggacacaaacaggcatcctaacatgacttccatgagcagaagtgggcagacagggctgaaaagctgaccttacaaggctgaggacctgccttgagctctgcctgactgcagagaaggaaagttctcttcttgcaacctcaaatcttccagataagaaccaaacgacatccggcctttgcgttctctccaccagctcccggctcacccacccagcagctcagcacctgcgaaatccgtctcccgatgcacacttgctaaccgcgtgggagtgaacctgcctgaagagtggcgtctaacgcacacactgtggtcagctccaccccactatgggtcccgggaataggagcaagtatgtattttgcttgcagggcaggtgtttcatccacattattgcaggaacagatgaatttaattaaaagaacaccacagtgggcacctcttccagggatgcctccctctaagaacatgacactgagatgatcaaggttctaaaagggcgatcaaatcactctccgaaaatgaaactgctcagacagaatgacaattaaattaataacaaccaagacaatgcccagatttcatctccgctcacagcccctcctgtgtgctgtatgatcaggttcttgggggtggctccagatacagcaaacagtcaggattaatccacaagagtgagctgtcagcatgaggttcccctacagtggagcttgccaaggtccgtggctcccagggcacccgttccagggctaacagatgaagcatggaaatgctgtgtggagtgagctgagcagccattctcaggagaaaacagacaaatcctcctgcaccctggcaaaccagctttgtggcctgttttatgtcatctttgctgagctccaccgggtcacccctcctgctggctttgtgatattgacatttcaggcactggcacagatacattggccttcctggctgggatttcacggacggagtgagcagtgctggcttggaggagccgtggcggcacagggcctgtgccctcagctgatcagtgcctgtcctgaccccaaagggccctcgcagcactgtttgaaattgctcttgccatgtttggaaccgattcctcggtacgtttcagactcattgttgtgactttggtttcaatccagggacacaccgtggccaatggagtgtctcaacagcatctatgatcgctgtttcccagagacagcatctcagataccgatgctgaaagagaaacagcagcctgtccccaggtggcaggaaatagtccattttaacggcaatttcataagtggcagatgatttttattgtaattttctggtgagctgattaagtggaggcagagtcagttctgaggcgtcaatgtctttaacaactcggggagaccgaggccatgctcagcaggaacactaagtccatggaaaacaggccctgggcccgctgatgtgcataattccacgtttgccccccatgtaaccaggatggtaaattacaggtgtcagataatcacgctctggagtggctacttgaggatgcgatcgaccaatttaagctccgtctgacacatgatcaatagcccgtgatgctgcatggaattgcaggcacagcgtccaaacctgcagagcagtggctcccagctgtggcaactttgccccccagaggacatttggcaatgtctggatatgtttgcaattgtcacaactaggagagggggatgctattggcatctggcgagtgaggccaaggatgctgctaaacctcccatgatgcacaggagaagtccccacacagacacatcctgcgcagactgtccataaagcttaaatgagatgctctgacttagagccacagtgaacattccattccatcgtctgggtatctccagggatgtacgtagctggatgtctagcttttcatctgggtatgaccggcctcacgcagaatcaaaaccatgtgtaggtcgaatctcttatttgctctcctgcttcctttcattgtaatattctccttctcattagtattttctgttattggaggaatggtaagaaaacataaaatgctggagagttacgattttgtttctgtcaataaaaaagtaatttgccagtgactcataaaaagcagaaaattaattagagaagacatgagatctatcaaaaagctgatcagggtggctcacgcctgtaatcccagcactttgggaggccgaggcaggtagatcacctgaggtcagcagttcgagaccagcctgaccaacaaggtgaaatcctgtctctactaaacacatgaaaaaaaagttagccgggcatggtggcagtttcctgtagtcccagctactccagaggctgagacaggagaattgcttgaacctgggaggcggaggttgcagtgagctgagatcgcgccagtgcactccagcttaggtgacggagtgagacttcgtctcaaaaacaaaacaaacaaaaaaaactgatcacctcaggagagcagcagagagaagagtccagatgggagctggtcagtttcaggagagtgcacagagcaggacctcgtgggactggcctagagctcctcaaactaacgtcagttcagcgggtgcaactagcattttaaaacattaatcacagagttgagtagaaaatatcaaaaggtgaacccaccagcaatcctggggacgctgaggaccctccctcctcagcacatggccctcctgactgttgggggagccagcatgaagcccccgtcgccgaccggcaggcccgagctcctggactcagcattgaccgacactgactctgttcccacagcagccgctttgttcgtctcctttgtggacacttagctcagcgcctgtgctgctcggctgtgacctgaccttcgagggtcacctcctgaattcactcgctgtgacctgtgctgcggaccccgtcaggaagctcctggtctcccccggcccctcccccgcctcatttgcacaaaaggcctcattgttctgcagggtctgactcagacctgccctggtttcagtttccgcaaacacccagcactggctttgggtcaggggtcactctggagtgaacggggcgccctgagcaaccccacatcgctgtgtgatcccggctcatccacaggaagccccggcccagggacccaaatgggtcccagaagtggaccagatgcagcgccgacggtgatgtggggacgccggcatctccaacagtgggaaagaggaaactttctacttttcattaaccccgtcctcttctcccccagggttacggggacacagtgtcttcactggccatgttggaacgttctggggagtgaagggaacgtccccaagagcattgacttgaccttcgctttggctgagatttgaaattctcttcttatcaatctctatatctgtacacgcaggagtctgttttacatccagccatccctgtgacctcgggcgagttccttaccttgtgttttctcatctgtaaagtgggtataatgaccaccgcacggcctcgcatgcttgtcagaaccaaatcagacaatgcacgaagacccgttggcccggaaagctgcagctgggccctgacgatgccacgctgtccatctggggaggggaagttcattgctaattcgactcaaaggaggaaaaatgcacgtccccctgagctgaaagaaggaacgaagccaagtccatcaggccaccgggtctccttaggctgaggaaatggacaatgagggcgacatcgaaactgcagagagcagcaaagcccttcactactgctgcccgaaccctgcagcggctcctacagccaccacgggtcactgggccaggagcaagttggggaacagccacatcaccatccagggaagcccccggaatggtggatttgctaacagcagccacacagacacctcacctcacgccaggctgctgagctcagcggggggcacgattgcccaagcaggggtggggcagggcaaggcagaccgagtcacacggtgggaaaagccaaaaaaaaaacctgcctgatttggtaaaatgccagaaaactgcgtgaactgggcatttgaaagtaagtttttaaggcgtagccatttgttggggtttttttgccccgtactctcctgtctccctcctcgccacacaataaactgtgtccaaggcagccgccctcccgctgccaggacgtgcgaggcaggaaggtcaggagctctgctgtgagggcgccacccggcttccggtttgtgcatgaaaacccggctcagcttttccattccgtgaagactgggcttctccaggctgctcggtaaataatcacggattccactgggaataggaaacgtccccacagccccatctccattgtgcacccaacctccaggtgttttcaatctctcaaagagccccgacgcctgaaatttaacaactaaaatcttatttttcatttcctgagattctcttggtggaatcaggcagcctggcggtgcgcagcacctagggtggctcatgatgaaaaatccagaggggactttgccttcctgcatgtccttttgtcaccagaacccagggaccagcaggacccaaagctccctgcgggatcagctgggtctgggaatcactgtcctgggcccagttggacttttcggatgaggccggtgtttggcacctgggctgggcaggtgggaaggacagaggcactgatggagagagggaggagaaggggattcatggcggtcctgggggaaccccacgggtgcctttggcctctccctggtctgtctgcccctcaggatggttaaactgtcccctgaaagttccccattgggcaagtccagcaagcctgagccaggcctgtgatctcagggtgggtggagctctagaaggcctggccctcgctcctggagtccacattcaccctcaaggcagtgaacggcgccccactgcgcatctactcactaaccaggcatgggatggtttccatggttcctgtgtcttagaccagctcgctcacggtgacatgagatgccctgagaccccgccatggtgcagagtgacattaatgcattaaattagcagcctctgcaacacaaacacatttccatgtggagcctgtgacgttctttggtaaaagggatcattacgtgtttgcaaacattccataagctgaggaagggcctcaggttctgacaagtgatgaatgggaaaattagaggcttcaggaaaatgcaaatatcatcctttgtaattctgtcccttggcaggaaataaaaaaaggtttccccaaagcaccgaggcattccttctattaaacgccaggaagaatggctgtgactctttcaggcacttgcacggatcttgatttgtcttccacagcctccccaatgccctggcaatgtgtgggagagaagcctgtgatttcagcggactgtcctctaattcagcctttctcacctttaattcatgatcaacccctaaggaaccttcatagaggtttttttcttactcacccccaccatgaatttaatactacagaaataccgcaaaatggtttatgcactgtgcctacatctgtatttttacataatgagagaaaaatcttttcacctccaggaaccagctctggccctcttgggagcagtattccccgctgaggaagcatgtgctcattccttcttttgttcattcgttcaaatgtgcagaaaactgtgtatctggtgtaaattctgggccctggaaggaggtgtgggagctgcctggggcctgggggcagagcgatgcaggagaggggatagcgaggacagagtccagagacacgaggggagggatgaggctgaggagcagccaggagccccgtgtggctggggccaaggggtgttagaagatgaggccagaggggtgatgagtcacagtggggcagagagagagatgggtcatctcaggccttaggcgaccctgtgaagacttcagcttttactctgagggaagtgggagccattggagggtttgagcagagacaggatgtggtctggtttactttttaatgggattctgtgtctgaggacaggttgggggtgtggggcaacagctggagcagcaagaccaacagggaggccaggtggaggtgatggtgaccggagccatgtggtcaaagtggaggaggtgagggagtccaatactgcagatcccttgcaggtagagctgccaggacttgctgatggatgagaagcggagtgtggaaggcagggaagagtggaggatgactcccaggtgttggcctgagagctgggagggtggggctgcgatttacagagatgaggaagactgcgggaggactgtgctctgacaaggccctctgctgactctgagagacacaggagagcgggacagagaggatgagggtgactcttagtagatttattacattctcccagcagatccaagtacataattttcacagcctgtgcaaaatgaaaatgtaggccacatgctcaaaagcaagaacaaaatgtcattataggtactaaaataagaaagcttttgctttctttctgcagtctgtctcttgacctgtcatggtgtttattatttgctactcaatgttgcgttccctcggatatgacgatgtttgtagggtagctcagaccccccacagtcaagccctttcaggggcagaaggtgaaagcagtcaccagcagggttattctcctgagtagcatctccagggtggcaccttttcagtagccttttccaaaggaatgagttagtatgacagttgtcacaacttcaatgaaaagcagccagcgcaatgggagatgggagaatgaaccatcagtgatgggaatatgagacacctggggaaggtcaagggctagcagatcctttatatgggctcagcgcttctacaacctgcagcaaggttcagcccccaccatggcccctctccacagtggccccgccttcattctggccacacccccatcctggctacgcccctgcatgaccctggcccctgccttgtttggccctgccccactttggccctgcccctgtcaaaaccatgtccgtctccccccagcaaatctggtcacacctccaggctgtcaggcatcattgtggctagggtagaccctgacaaatagctttcgggagtgaatctcctctttctatgtagatgaaacctgtccaggcaggaattcttgcatttcttccccagcccagccgcctcctttgtggacaccctggaggcctcctcgtggtgtatgtgggacaggtgggctccgaatcactcaacagatacctactgagatttactctgtgcccaagtttcaggtcccggccccaacggtgaaggaagcgggcaaagcgccctccctctgaggtgacgtctccagggctggtcacagggactccagggccatgagcacatggttgaccactctgcagattagcccaccccagtcgtaagctcctggagcagctcccggctttctgggtggtttctacccctgtggggtgatttataaccgaagcccagagagcgagaggttgatggggggcctgtcccgtccccgtctcagagaggcaggaactgcttagagctccgtgcgcgtgggaccagtggctccgacaaagccttggccaaactctgcttcccgatccttcccctcacccagtcgcctccttcctacagcatctgcggatgctcagccccaggagatgtgagctgctcggggaccgccctgagtttctgagagtcctgggggcgatggcacctgggtcctgtgcagatgacactggagagcctcgaaggctttgactcgggctgagcgtgggggtgggcacggggcatgctcagtcctgaccccaccatcgcggcccgggggacatatgatgggggttgtgtcccctcagaaagagacagcaggtcccgctgtgagcacacgctgagaagagacggtccagcctccaccaagtggaaccctgagcccagagggatggccctgccccttccactaggtctggccagtcctgtctgtgggtttccattgtcagctgtgaaggggacttgagactcacaggtggggttaagcggagtgacgggaaggttaattctggatgcacagggaatctgaagatggaattgtgaaacattcatggatttgccccagtattccagccacccatgcctgtgtgggtctgtgtgtgtgtggggggggggggggaggggggcaggggaggtatgagtgtatgtatgtgttggtactggtgttgatggtgtatagttctctcacttgggactcttgcctcccaaccagatttaacacagattgagcccacatggcctagtggttaagaacatagtccctggagctaaactgcccaggctcaagtcccagcactgccccctgagcaagtgccttgaccactctgcctcagcttccccatctgcagcatggggagcttagtaatagtgccgtatctcatggggttggtgtgaggactgagtgagatcatagatacagggcacggggaatagtgcccggtgtgtgccagctcccaccactctgcaaagaggacacatcctgcctccccacggccaactcacacccaacagctgctgcatggacatggatagaatgaatctgctattctctggggacctccatgcacctgacttcagcctggccttcaggggtctttctcaggatgaactcaactccattcatacctaaaggaattcaagcactgactggggatctgctgggtcttcactgatgagcactccagaggaggcgatctcagcaaggttggaagaagaggagtatgattgtttctcttttgccaaagaagatggagtgactttctccctgcaatgggttcctactgaaggattacagcaacaattcaccaggcccttcttcacctgaccccaaatctcccagcacagtagcccatggccctgtccctgcccccagccccagcagtgggctgtgattggcctgatgcagtcagctcttcccactctctgaccttgactgattcaagaatgggcacctggcccaggtgggccagtgaaaggtaagatgttgcctgggagccctggcttttccatggtttgctctggacaaggtggatgggatgcagctcttagaaccactgcagccttctctgctaccacaagaaaagccagtctgaaatcatgacccatgagagaggacagtctgaaatcatgacccatgagagaggacagtctgaaatcatgacccgtgagagaggaaagaaccaagagaacttcagggaaactgagccacagcctgatccaatcattcctgatgctgtttatctctgggatttttgaaggctggagcccatgaagctccctcctgctcacacctgtttgcactgagttttccattccctgcaaccatagctctctatctgattctggctctcgtgtcgcatgatagtaaggggtagattattaagccaagaccttccctggctggctctttgtgtgcaatacgcatcttcttacagccaacctggttctttacatctaaacttcagagtcagacgagagaccctagaggtcatctagtgcagccccttagtgtaacccctgagcaaagtgaggcctgggaagaagtcgtgagcctggatcacagggctggactttctatccctgattgctcctgtttttag

SEQ ID NO: 2055 - DNA, 13108 bp, Homo sapiens
ctcgcttggagataccaaggccggtcggaccccccgctggccgaatggagcgagcagatccagcctgtttggacgtggtgaggacccagccgtggggtttaaggccaagttagcctctcccttcactgattacaagagccattgttacaggtgctcacatgccaggagaaataagctggtgatttatgtggcacagcaccatcgatcgacctacaaaggaagcttcagtgcagccgtgttgctatacagacctctctcaccaaggcgtcatgaactgaagggctgggagaggcctcgtggaggaggaagagtttcgctcagctgcttgggtgtgggactgaatgtggttccagaactggtcgctgccttcacccgctgactctggtctcggcgatgacaagcccatggaacagacttacggcgtatgacctcatcggagacttgtacatggggccaacccccattttcccacaggaaacccacactctaattaagggctgaccctgaacttgaatctgagtcttctctttcttcaacagagagccatctctccagcccagctggcaaggagacaggtgatgttacaggaaaaaatacacagcttgtgcccttggaattaccagagttcaaagcctgttcagcatctacccaccatgtgacccgggtcgaattcttcagtttctctaagcccattttctcatctgtaagatggggaagtgtaatcagttctgaacccacatatacctcactgggcttgaacaggcctgagcaggcatgtggggctttactagctagccatcctttctgccgctctccctcattctccttcaagccccccaaagtccttggtggaggaggaagtggagacagaacgtttggtgttgggtgaggtacgtgaggaggctgatttcagaacctccaggaaacaaagctttagtgttccgagggcagtgcccgcctgtgcctcctcctcacagggggtagtaggagtggggtggggccgaggcatttcccagcacagctcaatcacatctcctgcgcctgcccttgtgacctgctcactggaaaggaagaaatgaccgagggagaagggagggcatttgaggggagaagaagaggatggagaaaaaaactggatcatctcgtgacatggaaagaaaggtctgagctctgacgatcccctcacgtgattataggcatgaggactcactcttcgaattgtttgaaaattgaatggactggctcacaccttctgaaatttcttggaagctctggagtaactattccactaaagaacagcgtgtttttggctgaaatctgtgactgtttgtttttgagttattttaatctctgtgtcaagcatgaaaacctcagcagcctgggatttataattagatcccactggcatgccctctcacctctcaaacatgccacagtgctttggctctctccttgtgcaaacctccctttgatatttttggatatcgataccaagtgtatctgcatattttaaccaactgatatgcatatcctgtgatctgaggcattcgctcaatgtggggcatcaggccagctgtgaacttcctttaaaatttattttgtgtcaaatgattccctaatgctatagctcccttgaactgctagatttatgaaaattctgcacaacacatagctcagagaaaaaaaaaaaagagtgttgcaagaccagatataggatatcatttgatttgtttaaaacactctgtccagggggttttgacttgctaatttaaaaataattctaaaattaggtacagttgacccttagtatccatgggggattggttccaggatgccctgtggataccagaatccaaggatgctcaagttcctgacataaatggcttagtgtttgcatataacctactcccctcttcctatatactttaaataatctctagattacttataatgcctaacacaacgcctgtgcatcacttcattcatgtggattcaatgtagtacttggtgtgaagaaaatttaagtcttgctttttggaactttgtggatttttttttctggaatgtttttgatctgcagttggttgaatccacaggtgcagaactatggacacagggggctgactatgtatatttatatccacttgcaaaattaagaataaaaataatgtgcatcagcaggtgcagattctgatgctcggtggacagtatgaagtcttccatttttaatgaagtctcaggcgatgctgctgttgcagtcctgtccaatagaatgttctgtgatggtggaaagattctctatcggctctatccaatacctaagccacacctttcacacatgggggagtgggatgggcaatggaagagcccaggcagggtagggagggggcagaaggaaggacagcagcacaggtaggcttactaagatccctaacatttatttagtgcctgtaatgggcaaggcagtgtgctgggtgctttacacctgttcagccacattcttacatcagcttgtgcagagcatttactcttcctggaacaatcctcggtgcagcgggtacaacaatgtaaaaagatccagtccttgctgctgggaaatttatagacacgttaactgaaactgtggagtaggatgaagtttctgagagaggagtctgcatttttaccctggcctttctatttcgtctgcaacattaagcaaggtgcttcattgctctcagtttcgatttctttgtttctaaaatagagttaatcatagtacctactgttggcttcttgggagattatatgatgagatacattgtaaaggttcaggacagtgtctggcacccagcaagctctctgaaaagaccagcacctatgatggtattggtcctacccgtgaagacaagtgtatgctggcaccaagaactctgatccaagtgccatagttaatttcaaaatacctaataagcctcaactatgtgcaatactttaaatggtggagacgggaggatcgtgacaaaggggaataaaatggaagacctcaagaaacttactttagaaagggactcagagtgcttggtggtttaatggagttctctcagttactggggatctgggaagtcttcatggaagaggtggtgtgtgagctgcccccaaaaagcagatagaggaagagtacaaaactccataagcagaggcaaagggccttctggatagaggaggctctggaagccacagtgaggactagaggaattgaggtctttttggaaatattaaatattccagttttcctggagcacaggacaggggttgttggggagcacaggagaaaagattgaaaaagtagattaaggttaggctgcagaaggcattgatgccaggctgttgagtttatatgtgaatttgtgggcaacgaggggcttctgaagttatttttcctccgcaattttcatttattttcacctgaaatgtaatatgctcattttaaatttaattgtaaatgtagaggtctatgaatagttaaaaactcttgaagaagacaaagtgagagaagttccaaataaggtgtaagaaatgaatgggctttgcctggcagctcacgcctgtaatcccagcactttgggaggccaaggtgggcagatcacctgaggtcaggagttccagaccagcctggccaacacagcaaaaccccatctctactaaaaatataaatattagccaggcacagtggcacacgtctgtagtcccagctactcgggaggctgaggcaggagaatcccttgagcctgggaggcagaggtttcagtgagccaagatcatggcactgcactccagcctgggggacagagcgagattctatcttaaaaaaaaaaaaaaagtattagaattaagacaccatgataatggtacagagttagaaaaactgaccagtggaacagaatagagagccatgaatctactcaaaaaaggagaaaatttgatacacgagagagggttgatattgcaattatttttatcaccatatatatgcatatttatattaaatacatatgtaacttttaaaataacatctcaattttagaatagatttacagagccattgcaaaaatagtacagagagttcccatatacccactgatatggtttggctgtgtccccacccaaatctcatcttgaactgtagctcccataattcccacgtgttgtgggagtgacccagtaggagataattgaatcatgggggtggtttcccccatactgtcctcctggtagtgaataagtctctgatggttttgtaaggggttttctcttccgcttggctctcattttttcttgctgccaccatgtaagacgtgaccttgctcctcctttgccttccaccatgattgtgaggcctccccagccacatggaactgtgagtccattaaacctccttttctttataaattacccagtcttgggtatgtctttatcagcagcgtgagaacaaactaatacaaccacactcaatttcccttattattacatcttacattaacatggcacatttgtaacaattatgaatcaatattggtacattactattgactaaagtcccacactttatcagatttccttagttttacctaatgtcccttttctggtccaggattccatccagaagaccacgttcagtcatcaagcctcagccttctctgagctgtgacagtttctcagactctcctgggttttggcgaacttgacagttttgagggttattgatgaggtgttttgtagaccatctctcagttggggtcactgtgtgcagccaacgcttaagaaatggggagttatactccacttcctggagggcagtgtatttacatacattttttgaaattcttctgcacagatttcttttcctctgtgtatttatttttccaatcacctaattatatcaatatgaactcatgaatttttttattactttggttataatctaataccactttacttaagttgttgttcaaatggttcccccactttggcgattaagagctctttcagttggtttctatgtccttctctcgtggccccaccattgtatggtgtgtatgcttgtgtgtcagtgtgttttagcactttcttactttctgacactacgaggtgctccaggctcatcttgcatatttcctgccccagtcctagaatcagctgtttctccaatgagctctggttccttctgttggacaatagtataaaaacaaacctaggtgctaaatgatcgcttagatccagtgctcattgctactgggctgccattgcttctggaccctcttagcagagagagaaaggagatatatgtgtgtgtatgctaatgcatgtacacatacaattcttatttttacctctatctagctatgtatgtatgtatgtttgtatctgtcatctctatgttatgctaaacatgggtttatacctctctggatgttttaggagcaaggaagagacatgattccagctttacctggggaaaatcaatctcacagcaatgagaagaaataaatgatgagttaaaattaatttctatatttttctaattattcaagtgactaatgtttggtgtgcagaaatttaagaagactgaggactagaatgaattataacgcaggagaaaacaataaccatgcatagtcagcaagaggcactgataccattttgagacgactggatgccctttcgtatgctaggaatatgcagcccgtgttctggaaagtggggagaaggtcaggcggctcctagcagcaaagctgcgttatcctcaatatcctgtaggggagggtttagggagttcggatatccctgcctttgacattcatcttggcctcagtttttctcttacctggaagcaagagaggagttgattgtgagttcagagtggaaatggtggccaatccagaccctgcactgccactgactctccgggaatgtcagcgccaggtgagagccaggattccagggccagacctgagcttgtccatagcctgggacttgaatggggggaaacttgggcacagtggcaggtggaaaatcaagtctgtgcttcaggggcatctaggaatgccctgtctatcttctcccctccccaaccccatttacccaggtgcctcctgttactttcaatactaatgccttctttttttttttttgagacagagtctcactctgttgctcaggctggagtgcagtgacgcaatctcggctcactgcaacctccgcctcccgggtccaagcgattctcatgcctcagcctcctgagtagttgggactacaggcatgcaccaccacgcccacctaattttttttgtattttcagtagagatggggttttgccatgttggccaggctggtctcgaactcctgacctcagtggtgggattacaggcatgagccaccacgcccaacctgatgccttctttttctgaccatttcctctccagcaatcccaccgtggccacaggaaaacctggcccaggagattccaatgttcttggcttcccctcctgtcacagcctcagtgattttgtgatttcatcttgcttctcagggcttgcttttatcaaaagggttggttagtcacaatggctgttaataggtgcaacaaggcatagaagacctgttaggggttgaacttttccccctacaactccaaaatattaatatattgcagtcctaatcttcaggacctccaagaatgtaaccttatttggaaatagggtcgttgcagatgtcattggttaatgatgaggtcgtactggatcagggtgggccccttatccaatatgactggcatccttgtagaaacaccacagtgtgaagagacagagattcacgcagagggaaaactatgtgaaaagatacacggagaagaccgtgtaaaaggtggaggatgaaggtaaggcagttgcaagccaaggaacgcctaagataaggaacgcctaagatagccaatgaccaccaggtctcagagaggcccgggacagattctccctcactgcccctagaagcaagcaaccccgctaaccccttgatttcggacctctggtctccagaagtggggcccagctgggataacctgactctagggccaccaaggtttgtcatcctgggcggcattcggggctggtgtgacccaccttatgcacaaaggccagaatagacctagcggcattgacaataggactggaatgccagctttgtctgtgaaggaagggcgcaagggaggacagctgtggtgggcaaaccctaaccatttccatccttgtttagcttttgttctgactacgacaggactacgtagtcgaactacgactcccaggaagccgttcggccttccccaccccctccccgcccaccccgctccgccccgtcccggcgcgggtccgcctggtatataagggccgaatggcccagccgactgcagggcgcgcaggcggcgcgggtgcgcggtgcggcgctggtatccagaggacgcggtcaccgcctctggcatttgtcgttctgcgcttctccgcaaggaccctctgttaggcaggcgcccaccgtaagcctcccgggccttgtgaacctgcaaacccaagtctgagagacgatccgccttcagcgctttccagcttggcagagaggctttcccggcggggatctttggttggcgctggcgatgcgcggggaagaaaggcgaggagcggcgtccaggctgggtgatgtcccagcacgagtaggcgggatgcgctcgcttggtcctccgggcgcccggtccctgcccgcgtcgcgcgcccacccctggggacgagaaggcggccgcctgaggacccccgcccgcgacctccgcgagtctggagcgcagaggacagggtctggctgctctttggccttggatggaaagtggggaattgggtggggggctgcggaccccttaacgtggattacttggtgtgtatcagctgggctcagaagacccacgacctcttctccatccgtggattgatttgttctgcttaacagctgggtcgccaagctggaggtggaatcagaggtttctggctgactcggtgggtgctttgaaccaggaaaggacaagaaagaggatgggaaggactgatccacattcccaccaggaagtttagcagaacccccgcgtgccacctggaccccttggaaggacctggctcaggctggaccacctcttgagaggcaggagctctggatttgatcaagaattctttgctgagcatggtgcctcatgcctataatcccaacactttgggaggccagtgtgggaggatctcttgagcccaggagttcaagactagcctgggcaacacagagagaccccatctctaaaataataataataataaaataaaaaattagcagggcatggtggcatgtgcctgtagtcccagctacccaggaggctgaggcaagaggatggctggagcctgggatgttgaggctgcaatgaactgtgattaccccactgcactccagcctgggcaaaagagcgagagaccctgtctcaaataataataataataataatcttattttggagaataaagagacctctggatttgaggtgccatttgggtagaaagaaaagacgtttacaccgagaaatagtctgtgttgccctgaaggagcagagggatgcatcgctggaggtgacctacagttgaagaagactcattatgacagaccttgtccttcttccttgtggaaagtgtttcctctgctgctactgctcatgagactcttccccctccctgtcccagggaaccaaagggctttctaccacaccctttcttgccccccgcctcccatgtctgctgtgcctttgtactcagcaattcttgtttgctccattatcttccagccggatacagagtgaatagttaaccacacttaggtcaaataggatctaaatttttgttcctgctccgtgtaaagaggccagtgtttgtgtgttgcaagcagccttggaatagtaactcttctcatttgtttgggatctggccaccaagttccagaatgatacacggatcagtgcagaagttcatcaggctctcggaccttagggctgttggagaaggcttcagcagcagaactgatggtgaaggctcgtgttctccatcctcaactttctttgcttcgatcatacacaagaatacatttggaagggcaaaaaatgaacactgtcgttcattgcagccgtgttttgtgacacagatgcacagtctgctgtgaagaccttctctcaagtggcatttgggagtccatgccagatcatggtgcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattaaagtttttgtatgttgcagttgctgtgcttgtatgaccatttagtgaatttggtgtcttctaaatagaacagtggagtccttgtggacatctcagattcatcacaaaatgattgaggagaacctcttgaagatgtttagagctattgaaatttacagattgttgatgggttttcaccttttccttcctttcttgacacacagttacaggcattgtattccttggattcctacaggtgtcaaggaacagagatccacttacgttaccttcataaatcctggtttattcaaaagtcacagtaaggtagacaggaaatagtcccagccactgcctagctaagccttttcaaaaagcccaaggtcattcagcagatgcagaagcactagttggttttcaaagataacaagagcaataccatcatggtcgttttgatcctctgttcagcagcagggttcgctgcccctgactttagaattctgccatcgtgatgagctgaaggtcaccaacggtcccagtttgcccaggactaaagggtttcttgggatgaaggacattcagtgctaaacctgggacagtcctgggcaaactgggaaaactggtcaccctcctgggtgactcaacgaccatgcctctactttgttacttactattaactgactgatgctgttgactggtttagccaatctgcattcagagcttttgcgtctggttacttcgttggccttcaggcagccacagatggatgctattggatcaggcaccaatgctgaccaaatcaattgtttccaggatggtagggttgtatgaagaaccaactgagaccatgtccttctgagtgttgtggatggtgggcatggcaggccttcaaggtatcagggattcctctccaatacagccttacttacaaaggagaaactaactttctcatgaaaaacaaaacagttcattaagaaacaaaactaacacagccactgggaactgaggaagagagactgtaacatgtgtgcaagcacacacacacacacacacatgcatacacatgctgtctgtagaatcatgagccaggattccaaatctgcatctttgctagacagagatcaagaactaaaacctttgggatggtgttgtctgggaagcaaaggagttggctagaggacttcctgaaattcctttaaactctagaatcctttaaaatatcaagggtgtgtaaactggggctaagtatgtacattctctctaaaggctcctagataacctttgagttcaattcagtgtggagtggggcctcccagcttatacttacctttctagacactgacttttatctgggatgagggagcagaatttggaggtggtagtcagggcgggggtagggaggggagtgggtaagggatagttgcaccagcccaacttttttggtcttaagaacaacctgaacgcaaattacagggtcttttgtggactagaaaaagccaggttttcaggatcacgtggcgtcctgaagttgttgctgcttgtcagggcatctgacctccatcttctctgctgaaagacaggcatgagtgtttgcagtgccggaacaggggccttcagataatttcattcatctggcatggcaagaccacagggagggaattacatgctagggtagagatgaacttatggacgtatcatgcaccttggtgtttgcccctgtagtgattctcactaccttcgctaccattggagggatgctcacccacctccttgggtgccatttttcttttttaaaagatgaaggcatttcagatgatcccttcatttatgttctactttcattctttggtttcaaaagaagtcctgatcttatgtcaaaggcaacaatctcttctctcaatctctctctctctctcactctctctctctggctcactctgtcacccaggttggagtacagtggcatgatctcagctcactgcagcctcgacttcctgggctcaagaaatcctcctgtctctgccttccgagtagctgtgatcacagttgtatgccatcatgcccagacccatgcaggagacctctccaggtacacatatttcctgctactgaatggcttagactgggatttgcaaggaactacgaagtccaagacctttgcctttcttttagaagaaggcaccagctggttctccaatgttgaaggtcttctccagagataccttaaggtgtggggagattacaacttgctcaaggtctcatagctagaagatgtcagagtgataactcaaaccatgtcacatgactctaagcccaaagcagcctctagaaggttgtttgatcttctgatggaagcacaaatcaccattccaacatgaaagatggagaaacttaagtctagagagatttaaaggacttgtcaaaggcaatgaaacaagtggtatgtgaacttaggtctcctggctcccagtccaatgttcttcgaatatgattttggcagtggtctacccagctagtacacagagtgtgcagccactcttcatgggaagttctgggaggggtttcaaccagcacactcactcctgctggttgtgaccagcaggacaattgctgagccacattctgagcacctgcaggtggaggtgggatcttatagaaatctagggcataagggagacagggaaattagaccctggctactttaacatactcactttacagatgaggaaactgaggcccagagaggataaatgacttgctcaaggttagccagttggtcaatggcaaagattaaaccagaacccagatctcctctctccagccagagtcttcaagcaaagtccctaggaggtcaagccaactcttgctgctgctgctaatctaaggacagatgtggccactttctccaaaggatctcagagagctaactttatggcgttttacagaagtcctatctttccttcaggggaaccccattcatttgcaagatggaaggctatttttagcattgacttttattttctcctaagtgacttcctctctcatgtaccatttggccttcacagtggctgaaaagacagttcctaggaaaatctagaacatttaagcttgcgtgtgttgcagttcttagtgagtggaagggcagaagcccatagtgggtggtgtttcgactgggaggagggagatgctggagccagccagggagtgaggtctaggtatgttcctgtcaagtgggatttgttcaattgcaagtgagaagaaaactaaacttaaactagacttttaaaaaagaaatctattggctcatttaagaactactgcaactccttcaggcacagcttgatccagagatctaaatcatgttgaatcatttaaactactttatttccctccatctgtggtggagactttcggggttcattcttgagtagttcttaccttctgcgccacattggacagccatatttccctgcccctttgagtttaggtgagtcacatgacaacttctgaccaataaaatgagtgtattatgtctctatttcctacttcag

SEQ ID NO: 2056 - DNA, 13108 bp, Homo sapiens; identical to SEQ ID NO: 2055

SEQ ID NO: 2057 - DNA, 7751 bp, Homo sapiens
ggcaggtgtcagcgtctggatcttctctgggatcccaacagaagacattttcgtcctgctgtgctgaagacgggaccggaaggccattgctcagggagcgagcagatccagcctgtttggacgtggtgaggacccagccgtggggtttaaggccaagttagcctctcccttcactgattacaagagccattgttacaggtgctcacatgccaggagaaataagctggtgatttatgtggcacagcaccatcgatcgacctacaaaggaagcttcagtgcagccgtgttgctatacagacctctctcaccaaggcgtcatgaactgaagggctgggagaggcctcgtggaggaggaagagtttcgctcagctgcttgggtgtgggactgaatgtggttccagaactggtcgctgccttcacccgctgactctggtctcggcgatgacaagcccatggaacagacttacggcgtatgacctcatcggagacttgtacatggggccaacccccattttcccacaggaaacccacactctaattaagggctgaccctgaacttgaatctgagtcttctctttcttcaacagagagccatctctccagcccagctggcaaggagacaggtgatgttacaggaaaaaatacacagcttgtgcccttggaattaccagagttcaaagcctgttcagcatctacccaccatgtgacccgggtcgaattcttcagtttctctaagcccattttctcatctgtaagatggggaagtgtaatcagttctgaacccacatatacctcactgggcttgaacaggcctgagcaggcatgtggggctttactagctagccatcctttctgccgctctccctcattctccttcaagccccccaaagtccttggtggaggaggaagtggagacagaacgtttggtgttgggtgaggtacgtgaggaggctgatttcagaacctccaggaaacaaagctttagtgttccgagggcagtgcccgcctgtgcctcctcctcacagggggtagtaggagtggggtggggccgaggcatttcccagcacagctcaatcacatctcctgcgcctgcccttgtgacctgctcactggaaaggaagaaatgaccgagggagaagggagggcatttgaggagcaaggaagagacatgattccagctttacctggggaaaatcaatctcacagcaatgagaagaaataaatgatgagttaaaattaatttctatatttttctaattattcaagtgactaatgtttggtgtgcagaaatttaagaagactgaggactagaatgaattataacgcaggagaaaacaataaccatgcatagtcagcaagaggcactgataccattttgagacgactggatgccctttcgtatgctaggaatatgcagcccgtgttctggaaagtggggagaaggtcaggcggctcctagcagcaaagctgcgttatcctcaatatcctgtaggggagggtttagggagttcggatatccctgcctttgacattcatcttggcctcagtttttctcttacctggaagcaagagaggagttgattgtgagttcagagtggaaatggtggccaatccagaccctgcactgccactgactctccgggaatgtcagcgccaggtgagagccaggattccagggccagacctgagcttgtccatagcctgggacttgaatggggggaaacttgggcacagtggcaggtggaaaatcaagtctgtgcttcaggggcatctaggaatgccctgtctatcttctcccctccccaaccccatttacccaggtgcctcctgttactttcaatactaatgccttctttttttttttttgagacagagtctcactctgttgctcaggctggagtgcagtgacgcaatctcggctcactgcaacctccgcctcccgggtccaagcgattctcatgcctcagcctcctgagtagttgggactacaggcatgcaccaccacgcccacctaattttttttgtattttcagtagagatggggttttgccatgttggccaggctggtctcgaactcctgacctcagtggtgggattacaggcatgagccaccacgcccaacctgatgccttctttttctgaccatttcctctccagcaatcccaccgtggccacaggaaaacctggcccaggagattccaatgttcttggcttcccctcctgtcacagcctcagtgattttgtgatttcatcttgcttctcagggcttgcttttatcaaaagggttggttagtcacaatggctgttaataggtgcaacaaggcatagaagacctgttaggggttgaacttttccccctacaactccaaaatattaatatattgcagtcctaatcttcaggacctccaagaatgtaaccttatttggaaatagggtcgttgcagatgtcattggttaatgatgaggtcgtactggatcagggtgggccccttatccaatatgactggcatccttgtagaaacaccacagtgtgaagagacagagattcacgcagagggaaaactatgtgaaaagatacacggagaagaccgtgtaaaaggtggaggatgaaggtaaggcagttgcaagccaaggaacgcctaagataaggaacgcctaagatagccaatgaccaccaggtctcagagaggcccgggacagattctccctcactgcccctagaagcaagcaaccccgctaaccccttgatttcggacctctggtctccagaagtggggcccagctgggataacctgactctagggccaccaaggtttgtcatcctgggcggcattcggggctggtgtgacccaccttatgcacaaaggccagaatagacctagcggcattgacaataggactggaatgccagctttgtctgtgaaggaagggcgcaagggaggacagctgtggtgggcaaaccctaaccatttccatccttgtttagcttttgttctgactacgacaggactacgtagtcgaactacgactcccaggaagccgttcggccttccccaccccctccccgcccaccccgctccgccccgtcccggcgcgggtccgcctggtatataagggccgaatggcccagccgactgcagggcgcgcaggcggcgcgggtgcgcggtgcggcgctggtatccagaggacgcggtcaccgcctctggcatttgtcgttctgcgcttctccgcaaggaccctctgttaggcaggcgcccaccgtaagcctcccgggccttgtgaacctgcaaacccaagtctgagagacgatccgccttcagcgctttccagcttggcagagaggctttcccggcggggatctttggttggcgctggcgatgcgcggggaagaaaggcgaggagcggcgtccaggctgggtgatgtcccagcacgagtaggcgggatgcgctcgcttggtcctccgggcgcccggtccctgcccgcgtcgcgcgcccacccctggggacgagaaggcggccgcctgaggacccccgcccgcgacctccgcgagtctggagcgcagaggacagggtctggctgctctttggccttggatggaaagtggggaattgggtggggggctgcggaccccttaacgtggattacttggtgtgtatcagctgggctcagaagacccacgacctcttctccatccgtggattgatttgttctgcttaacagctgggtcgccaagctggaggtatttttccctctccaccctggtcttctcctgtaacgtgtggccgccttttccagcacggcctcctgccttcctggtgcactttttggagaacgtggtggaatcagaggtttctggctgactcggtgggtgctttgaaccaggaaaggacaagaaagaggatgggaaggactgatccacattcccaccaggaagtttagcagaacccccgcgtgccacctggaccccttggaaggacctggctcaggctggaccacctcttgagaggcaggagctctggatttgatcaagaattctttgctgagcatggtgcctcatgcctataatcccaacactttgggaggccagtgtgggaggatctcttgagcccaggagttcaagactagcctgggcaacacagagagaccccatctctaaaataataataataataaaataaaaaattagcagggcatggtggcatgtgcctgtagtcccagctacccaggaggctgaggcaagaggatggctggagcctgggatgttgaggctgcaatgaactgtgattaccccactgcactccagcctgggcaaaagagcgagagaccctgtctcaaataataataataataataatcttattttggagaataaagagacctctggatttgaggtgccatttgggtagaaagaaaagacgtttacaccgagaaatagtctgtgttgccctgaaggagcagagggatgcatcgctggaggtgacctacagttgaagaagactcattatgacagaccttgtccttcttccttgtggaaagtgtttcctctgctgctactgctcatgagactcttccccctccctgtcccagggaaccaaagggctttctaccacaccctttcttgccccccgcctcccatgtctgctgtgcctttgtactcagcaattcttgtttgctccattatcttccagccggatacagagtgaatagttaaccacacttaggtcaaataggatctaaatttttgttcctgctccgtgtaaagaggccagtgtttgtgtgttgcaagcagccttggaatagtaactcttctcatttgtttgggatctggccaccaagttccagaatgatacacggatcagtgcagaagttcatcaggctctcggaccttagggctgttggagaaggcttcagcagcagaactgatggtgaaggctcgtgttctccatcctcaactttctttgcttcgatcatacacaagaatacatttggaagggcaaaaaatgaacactgtcgttcattgcagccgtgttttgtgacacagatgcacagtctgctgtgaagaccttctctcaagtggcatttgggagtccatgccagatcatggtgcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattaaagtttttgtatgttgcagttgctgtgcttgtatgaccatttagtgaatttggtgtcttctaaatagaacagtggagtccttgtggacatctcagattcatcacaaaatgattgaggagaacctcttgaagatgtttagagctattgaaatttacagattgttgatgggttttcaccttttccttcctttcttgacacacagttacaggcattgtattccttggattcctacaggtgtcaaggaacagagatccacttacgttaccttcataaatcctggtttattcaaaagtcacagtaaggtagacaggaaatagtcccagccactgcctagctaagccttttcaaaaagcccaaggtcattcagcagatgcagaagcactagttggttttcaaagataacaagagcaataccatcatggtcgttttgatcctctgttcagcagcagggttcgctgcccctgactttagaattctgccatcgtgatgagctgaaggtcaccaacggtcccagtttgcccaggactaaagggtttcttgggatgaaggacattcagtgctaaacctgggacagtcctgggcaaactgggaaaactggtcaccctcctgggtgactcaacgaccatgcctctactttgttacttactattaactgactgatgctgttgactggtttagccaatctgcattcagagcttttgcgtctggttacttcgttggccttcaggcagccacagatggatgctattggatcaggcaccaatgctgaccaaatcaattgtttccaggatggtagggttgtatgaagaaccaactgagaccatgtccttctgagtgttgtggatggtgggcatggcaggccttcaaggtatcagggattcctctccaatacagccttacttacaaaggagaaactaactttctcatgaaaaacaaaacagttcattaagaaacaaaactaacacagccactgggaactgaggaagagagactgtaacatgtgtgcaagcacacacacacacacacacatgcatacacatgctgtctgtagaatcatgagccaggattccaaatctgcatctttgctagacagagatcaagaactaaaacctttgggatggtgttgtctgggaagcaaaggagttggctagaggacttcctgaaattcctttaaactctagaatcctttaaaatatcaagggtgtgtaaactggggctaagtatgtacattctctctaaaggctcctagataacctttgagttcaattcagtgtggagtggggcctcccagcttatacttacctttctagacactgacttttatctgggatgagggagcagaatttggaggtggtagtcagggcgggggtagggaggggagtgggtaagggatagttgcaccagcccaacttttttggtcttaagaacaacctgaacgcaaattacagggtcttttgtggactagaaaaagccaggttttcaggatcacgtggcgtcctgaagttgttgctgcttgtcagggcatctgacctccatcttctctgctgaaagacaggcatgagtgtttgcagtgccggaacaggggccttcagataatttcattcatctggcatggcaagaccacagggagggaattacatgctagggtagagatgaacttatggacgtatcatgcaccttggtgtttgcccctgtagtgattctcactaccttcgctaccattggagggatgctcacccacctccttgggtgccatttttcttttttaaaagatgaaggcatttcagatgatcccttcatttatgttctactttcattctttggtttcaaaagaagtcctgatcttatgtcaaaggcaacaatctcttctctcaatctctctctctctctcactctctctctctggctcactctgtcacccaggttggagtacagtggcatgatctcagctcactgcagcctcgacttcctgggctcaagaaatcctcctgtctctgccttccgagtagctgtgatcacagttgtatgccatcatgcccagacccatgcaggagacctctccaggtacacatatttcctgctactgaatggcttagactgggatttgcaaggaactacgaagtccaagacctttgcctttcttttagaagaaggcaccagctggttctccaatgttgaaggtcttctccagagatgaactctgaaagccacatgttgagatggccccattacaggatggagagcacctgaacccccaagttatggactagaagaagacagttgccctggaaaatcatctgacccacattggactttatgtgagggggaaataaacctttattatgttaagctacacaataataaataacaacaataatt

SEQ ID NO: 2058 - DNA, 7751 bp, Homo sapiens; identical to SEQ ID NO: 2057

SEQ ID NO: 2059 - DNA, 13476 bp, Homo sapiens
tctgtctcaaaaaaaaaaaaaaaaaaaaagacacctccacttactactctgcttctgaggactccccctcagggaggatctggggctgccagttctaagctgagagcaggtaggacctttccaccaccccagccagtgcctgcctgagcacaaagagctcttgatgaaaggctcccagcacctgcaaaatccaggcccaggtggctccagaatgactggtgtgtggggttgcaaaaagacctgccctggcggaatcgctgggaggctgggaggaagacaaataaagacactggcgtgccctcctggcccaggcattggcagtgcgtaggtcccaacccttgtaagagcctcaagcctgcacctgggaagaaggggcttagatgtcaaacctcagccacgtgtatgacagtgactacaaagatgccctgtgcagggagaccttggtttctctccttcctgcagaatttaggagacattctacaaaaggtactcaggcctgatgtactattccttttgcctggcggtcagcagccatgtgggggcttctgcctgcccctcctgctcacagccccccaccccctggggtgctgctgcccaatgaactctagacactctgtccatgtgtttatgaggcttgttcccaaatcttccccaggacgtgtccaatcaaccccgactcctgagagtggcagggaggggtggggatttgctcagcaagctgagccttagcttgccctctgcttctgttcccctgacaggagtacctgcagttacaccggccctgggccagtgctcacctgacaccccaccatccagcatcccctcaggaatccagccccagagcacctgcttctgcccctttctgctcttgtcttgttctcgagctatggagaggggtgactaccctggacagtcttgcagtattagagcaggaagggatcttgaaggtgatggtaacagtagctgccattattaagcacctactacatgccaggtgtgttaagaatgttgttctggctcctcacaagtgctggagagaggcgctaccgtagttaccatgatggaggcacaggttggtgtcagacctgtagctgagtggtcagggcacagacctgactgaaatcccaggtctgcctcttacccactggtgggacccagggctgctttctaaagccctctgtgtctccacttcctcgtttgtaagatgaggaaggtaataatagtggctgccccatagggaggtgccaattgtctatgcaggccaagtgcttgatggtgccctgagcccaagcaggtggcatgagggtcctgtcatcctggaggtcccagtggtgcagtgatgatggcaaggccggggctggggcccagctctttgttttacaaaggaggaaacactgggtgttggtgggcgggggtggggtgtcagggagagaggatacatccaccatggccttttctgatgagctccgtctagtgcccatcccgcaaaacatacctccctttagaattgaagggatctctggcagggccccttcgaccttctctaggtgttgccagcagcttgcagggctagtgcaggactaacggctctgaattgctcttacactgtgtgtgcccaactgccccccaacccctcaccatctctagtgcctggcacttcacaaccagggagcacttgccagggggaatcaaagcaatcagcaggtcccttctcaacgtaatggactcaggtctttcaagtcctgatggacttttaaccactctttgctgccagcgtatccatttgattgagaatattcaatatttccctcatccagacttgtctctctctgaggcacctttcccgctcccccgtataggaattcattgcattttcaaaaagcacaaaaatggagattcctgcctcgtttcaaccctgaatttaacaaggatcatttccatggaaaccaaaaaaaaaaaggaaatgaaataaggacgaatatctcatttatttccctgcagctctcatcccctgctcatccaagcctccctccttccagatgaataggaacaggttacagctgacccagtttcactcccagcttcagaagatgaatcacggtgggttggcggacaaggaatggggcaagctggggcagcgcggaaggcagtgctgttttcaggaggcctgacctctgtggccagagtccccgtcagcaccgcttactgcaggccaagatgcctcccaccctccagaatccgaccgcggagggagcttccagtccaggagcctgcgggaatcctggcgggggctgagggctgcagcccccctggcctgggcattgggtgcctcttagggatcttgcctgggtgccctaaggggtcacccggtgtccgtcctggagggccgcagagtcagcgcaacctgccctggtgctcggtcctaaggtcagctctgcttctcccgagtggggagggcgtcacggtttgcctgcagtgggagcgttccgtgtcattcagacgagcaggtgggaaggtcggcaggagtgcagagaagagacgcgggaagcgggatgcagagaggtgggctgaatcaaccaggcgcaggaggaagccacagtgcccaggggaggcagggggatgggggaggaggcgggaggccccgggttcttgccctgtgggccgcgtgggcgcccaggagcatggtgggcgccggcctcacttggacaccagcacacggacaaactcctcgtagttcacctgtccgtctccgtccgtgtccgcggcccggatcatctcgtccacctcctcgtcactcagcttctcccccagccgggtcatgacgtgtcgcagctcggcggcgctgacgaagccgttgccgtccttgtcgaacacgcggaaggcctcgcggatctcctcctcgttgtccgtgtccttcatcttcctggccatcatgcccaggaactcggggaagtccacggtgccgttgccgtcccggtcgatctcactcatcatgtcccgcagctcggcctccgtggggttctggcccagggaccgcatgaccgtgcccagctcgcgggtggtgatgcagccgtccccatccttgtcaaacagggagaaggcctccttgaattctgtgacctgctcctcagtcagctggtcggccatgccaggggtgggggcgtgggtggcagaagaggccactgtggggtctccctcccagtgccgcagcccggctgctgtcccagctctggggtggcaggtggagatccgggcggccggcgggctgtctcgccctggcttgagacgctggagcttaagaagcagcagagtcctcccccatcattggcagacgcccctgccctgcggttgcccgggcctgtcctgtttagacaggagtccagggcctgcgaatcgagctgacgccagcacctctgtgcctgcttgcacctggacccagcagagccacgggggccccgaatcacacctgcagtcagggcgtgatatttgagtgcctactaggtgcagtgtcactctggaagctgggaacacagtgggaccggcaagccacccccagtcctcgtgaggttaactagcaagacagctagtttgcaggtcaactgatcgaggaatgcaaacaaggtgactagggattattgataaatgctgatggacatacaaggtggtgatggacaggaccccgaggtcacctttcagcctggtcaaggacagacctcctgctgagaagcagctgtctaggccggagtggccatggcagggccaagggctggaagatgatcagtggggctgcaggcctgtgagggaggggacaaggaggagagacaaaggagaccttgaagggctcagccaggaagtcccactatcattctctggtccacattgccccaggagctccgggcagcatggagctggggctgtggagcggcctctcccagaggagacccgcttagggggatagtggggtgttcacagcacagactcggctcccactcccagggggcctggagacatgacccccagagaggcaggagcaggcgcttcacctgtgggaatccaagaaatccacactgggggagaaacatggagcccactctattttttgctgggtgtgtgggggtggggtagagaccggaaagggaaagaaagtgtccttttgaggacctggacttgccgaggagagactatggcaggagaagggctcggatattcattttttttctctctgattttccttcccttctctattcaagtagaggcaagtgtgtccttctggtctggagggggtctgtggtagggggaaaattgaagccacctgcaagacaccttccttcctacctgagggctcccacaaagcctgtgtcctgagggtttgggcaggaggaagcaggaaggttgaagaatccctccatccccatggaatcttttccttagaagagaagtttgtggaccccagagcagcagggctcagggatgtggtggccacaggcagccttggcaaagagccctggggcccaggggtggcgtggagggaacgaggtgatgggcatcttggaagccacgtgtgtgggtgacactttggtgaccagatcccaccctcccctcctttctcaccccagaatattcggccttgcctgagacctcacaccccaacagctctaggggagtggggagatgggctggccaggactccctggggtaggagaggggctgataataaagtttagatttagagagaaaaatgaggcagcatctccatttgcaggctgggagcatgccctgggcccaggttacagctctgtccacagggggctgcgcaagaaagagtgtgtgctttgctcctgggagccccgcccttcctcgaatattctggagatctcttttgtggtggggagacccagcaaaggctgcacacacagcttgctcaaggtcaccccatgaaaagttcagctggggatcaaggtcccttttttattttggggttttttgggggctaattctgggacatggggaccttctgtcaccttctgagaagggctcttgattgtacactggtgcctgatgcctgagtgttagaattcatatcccaaacgcactttaaaaatatttaaatatctccgctctagatcacccgaatacccaaaaatagcaggttagtaacaaatacctgaaatttcctccacaccatgaaataatacacagcctttaaaatgaggatgaggatataacaatggaaaggtttccatggaaaatttttaaaaagcagatagaaaactgtatatgtgatatgatttcatgtattaaacatttatatatgtttatttatatacattcacagaagaaacgcctagataatcatgtaccaaactcttaatagtggatactttggataataggattataagtgcttttaattttcttataaatgtagtatctttgctcatttaaaaatgttttatatttgccatatatcatttctattattaggggaaatgactgaagattcaaaaaccatccctgataaaaaatattccatatcttactgaactcccaatattctttctctttctctgaggttaggtaatgtggagggcctggtaatattgtcagctttatatctctcagagatatgagactatggtgagcatagctattattatgtatagaaaagcagaataattaatagccaataaccacaccccctatttgactgccagagtgaccatctagtggaaaagatgctatgaagcatttttcttctactttccctgcctaggggctggagagacttcttcatgaaggaatacagggacagtcacaggagacaggagcaccaagggattcggacatgtggctgacacagtcttctggagagccccggatggcatcagggggaaacctggcctgagacagtgccctgatggacaaggacaggaatacggtcatacctcctgcccacttgaccaacgaccaggatgagaagccaacagatgatgaatatgaattaaagttggacaactagcaagtttaaaacttggactgggacctagatcttccgattcctacagctagcctccctttccatcttctctgtggtcatcactaatgcagtttttgaccgtcttgtccagaagctgcaaaacagacaacagaagccaggactggccctgccttagatggctttcagtgcaggaaagtatcaagacagtcttgttcgtagcgtatatctctctccaccttttctgctaagcacctcatgtatgcagctgccaatgtaacacctccatttgcgtgtttaatcaccatctcaagctaatgtaaccaagcagacttcttggccttcatccctgcctcctctagtcttctcatctctctctctctctctctctttttgagacagaatttggctctgttgcccaggctggagtgcagtggcaccatcttggctcactgcaacctctgcctcctgggctcaagccatcctcccaactcagcctcctgagtagctgggtcttcccatctctttaaaaaacaattcaattgttcagaacaaaaccctggagtcatatttaattcctcccttcctcttgcacttctaaaccaatcattcatctctactttgaaaatgtttctttattcatccagtgcaccaagccaccatcacctcgaggcaggaatattcaacggcctcataagtggtctccctatttgtgttatattcaatgcatgtcttttcttactcaaaatcctataaaggcttctcttcaccatccacgactgtttcctgccttcctcactatgatcccatcactgacccctcaagactatgttccagcctactttctgctccttgaccaacacccttactctgattcccacttttgtgacttcacatgagtcccctgtctgcctggacactctgcccccaaccttgaagtgctcacccttccctgtcactcagttgaaagtcaaattccatttcctcatgagggcttccctgaatacccacttttaattaactctctgcctcctcccatcacttctgttttaccccctcttttagttccttcctatcttagtttcataagagccagggccgtttccgacttctttccccgtcaagcctccttagataggacaggtcctctgcctcaccgactttaatcagtatttgctaagtaaacagagcacaggaggatcctgttgtcatcaaagagcagctctgcctccaatggcgaaaggattgttggaacctcatccttccttcaagttctggttcaaaaaattccatgctatgcctcacatggccttgcccaggtgcctgtttgatttgcctgggttgtctgttctttcttccccactgtcctcatttgccatgtggctcggtggtggctggagacctccatgctggcccctgggagcagctgctaaggctcggcgcctcaggacaccttggcacctgtggatatcgaccaccaggcttctcttctgttcatgtctctgcaagaatgagaacctgcccccataccatttgtgctgtgtaggcctcaggaggcatggactcacgcatccagcttcctgcaagccctctggtacatcgcagtgttcacccccagctttctattacagccaccacccagggactctggtgcaggctccttagagagaggccaggaaactgccgaggtgataagtgacagcaggtctcaggggaagagaggacttctctccttagtaaagaacctgtcgaggtcggaaagacactccaggctcaaagccaaatttgaaagttaggctgacagcccaactagggcagattggaggagccaggtggagagaggatgtgggggagtcaggaaagaggtggaaggagaagcctggaagagtggctccgctcctggagtatggccagcggcacttcgtcaggacctcgaccttcacccactagtgggagggtgttcctcgcatgacttgtaggatcacctgggaaacacacaaatggaagaatttaaaaatatctgctaggacaccccgtgtcccccacaactcatcacagagcaaacccatcacagagcaaactccttggctacttcttgtcttgggccgtcttttcatctggcctgtttgcctgactggactttggggtctttgttcccagcatcaaaatttcctaccagcgactttccatcacagctcccttccagtcttctggaaattgtcagatgtgcctggatttgcagggcctgcacaagatatgctgtcgatctgggatttttggggatttttgcagttcacactccaatgtgcaacagcaaccaaacggagatggaggacgtgaacatgaactactggagatgctgatgaaacgtgtgtaaggaccgcaatggtatctgtgtcctgctcgtgaaattgaccagatacagcggcttccttttgcttccgaaggcccggattgacctgacaattgatatgctttgctctatactccaactcccattgaccatggggtgaaagcaccctttctcggtcagcctcactgcttccccgcagatggagggattttctgcaggagcatgggccctgggccttcctttcccactgtctcttgaaagcctcctccagatgtgctgcctggctcagctctttgggtgacttttgttctgtctcatgtgacccatcaagattcacacagggctgtgtcccgggcagggctggagtcgacattcagggaggagatcactgttctggaacagagcagtgattggtttaattgaaatctgatagatcatcatgtaaaaagctggcatgtaagcatgctcccggagcctgcagggccctgcgcggcctcttgcctggccatcacgtagaggcggtcctcttgcatggttgggggcctcacctgcaccacgggcccccaagccaaacagtgagattgtacggagaccatcctggtcaggtcttgcagtttgcaccaggtagccccaggctatcctgccgtgcaagagctgccttctcagcacagtggagttctacggctgcctcggctgcagaggtcagctctggagccttgctgagcacctccatggatgcattttgcaaagggccgagtaagaggcattaacgtggcctgtgcttagttcctgacagcaagcgggattaaacccggattaaaggatcagccctaaaccaaagcagaccagtaataggtctcatgataaaagcagccaaataataatagtaaaaatctattcttggacttattactttcctgggaaaagggctatttcttgtgaaatatgcagcgattggaactttccccgacagcccaccgtgagctcactcactgcccctgcctgtgctggggggtggtgggtggtgagaggtgcaagtgaagggtctggacagaggcagagggaggagagggggcagggggatggggaggaagaatggggggttcgctctgggatagcttcatgatccactgaacctttcaaacttgatgcttgacgttttgaaaaaaatgacagaaaatatgggctgggcactgtggctcacgcctgtaatcctagcactttgggaggctgaggtgggcagatcacctgaggtcaggagttcaagaccagcctggccaacatggttaaaccccgtctctactaaaaataagccaggtgtggtggcacatgcctgtaatcccagctgcttgggaggctgaggcagaaaaattgtttgaatctaggagacagagattgcagtcagccgagatgctgcctctaaactccaggctgggtgaccaagtggggctctgtctcgaaaaaaaaaaaaaaagtgtactagggggatgtcgttgaggggcttagccacatgctacagatctttttataccaagatgcattcaatgattagctaagttggacagtttgttactttaagcctccacaaccaaaggggcaagataattatctcccagagaacaagttgatcttctttgaaggataaggagttccccaagcagcaggaagagcttctgttcccaattccagcctttgaagtttaagcttcagaagaaaaccttagcatttaatacaggaaggcatgcacgtgtgtgtgcatgtgtttgtacccacacatgtggctcaagcttccctgtgacaatgggttgcctgcgggtaagcgtgggatgtgtggagaaggcaggagggtttagggcgtgggctcagtaccctgatgagagatttaaagcaggcaaagggattcggcaaagtgcagctcccatttcatcatttcttcagaccctgccttagttatttactgctgtggttttaaactctgctcttcgaaacccttggtttctgcagaagtccttcgagaggttcgtgggggcaaaggaaggtgaggggcaggagcccaggccacccggcctccttcctttccccacgtctgctttcaactgtttcatatgcatcatgcaaatcgcagctgtcatggctcaggtcctcatgtgtacaatgggcgccatggcagcgtccaggtcagagggtgaccagagtgacatgaattaagacacgagaggactccaaagagtggtcaggcctctcacgtcataagatctccataaatggtcactattattttgtgttattaggggtacgcttttcatttgtaagatgacttccatggggccccacgcctcatgaccccgtctcaccccctgcaaataccatcccatggagaggcaggacttgagcctatgaatttgaggggtacacggttcagtccaaaccttttggtgtttctgtgtatccatttctgcatgtgtaaaatgaggagaacagacagcttccgacctcatctccaaaggcgcacggaggaggtggaaaggccctcgccggagactgagcactgcagccagcgcaaggccggatttgctgcttccgcgcggggacgccctcggaaaggtggcagattctcctgccattcctggctccagggagtcctgaaggaacgatggttagggcggagaatcctgcagaggaaaggagagaaaggactagaggtcacacacggcttcttggaggggagcggggagcaggggctccgaggctgcgggtcgcaggctccagggcaggaagctctccatgggaaccgtagtatgaattccaccgaggtgcgtcccggcacagacccgaaggcagccacatttgtggaaataagatttgacgtgcatttcggatccgcagagaaggtggactctgttttgcagaatggaccagcggtggggggtggggtggggggcaggaaaagactttaaacgctggcagaactttgtattccactcattcgtgcatgcattcattcagccatcctttcgctatcattcatcaaactagcgcgcactgaggccactttgtgtcagcgcagcgcctggcctgaggacctcagggtggtgtcggcaaagttccgctgccaaggagttcacgggccgtgtttcctgccaggccgcagacactctctgcgtggagcccgaggaggttctgtgtgagatctcaccctgcgggaagaaagaggcggaggctcggggttggtccaatcacacccctgatggtgagagacgggcgggcggggcctgacgcccactcccagctggatgcctgtctcccaccccgcgtgtcctttcccagaccccaaagcttcctgcctggtctcagttcttcggagaagagggattagaagctggaacaggtatttctgctaatggggcgtggcagatcggcatttgcgggggctctgtcaccccgtaagatgtcccagcaggaagcgtggcgggtctccactgagagctccacggagcagctttggctccctgagaagtcgaggtgtgagcagtagcggccttccctttgcagagagaaggcttggggagagaagaccctggtgccatcttcataggaggtggaaaggaaactgtatgacaggagaatgaatcaggtttggggctcaaggtgccggccactgggaaaaacagctgccccgagttgcaaaactctgggtcctatatgtataaactatgccctgaggaaggaatctcaggcgtatcttaggagaaaatgttctagcttgggaaacaaacacaacaggaccgtgaatccaaatatttcaagtgggtttagaggactggagttctaaacgctgcttttactgtaagtgatcacgccccggaatgtgctgaagaaaggaaaatgagccagtatcggcgaggactatgggcaaggaaaacgagagtgtgcgatgtgtcaaagcaagacatctgtgtatagtaatataatcaagtaatagatagtcatagaatcaagctgatgtatttggcaggggccgcgggaggatgaggcaactcccatcagattagaaagatgttaacactgtaacaaaagtggggctcgaggaaggggaaaagcgcagctctctttttaagacgccagaaagtagtcagacatgctaagaacaaaacaaacacaaacgaaaaccagcaaagaaagctcttcgagaagagtaaggctactgatctttaggaatcaaatcattatttccacacatgtcatgaagaacacagacattaaagcacaaaggagaaacttaaatgaaagtaggagggagaagtcaaagctcaagtaaagagatttttaacctagagaggctgagttatcaaggaagaaagaaggccaagccagcttgttgcagaatgttccagaagataagataatgatagacttaaataaatagggactgatcaaggtgatagcgagttcttggtgaaattgcttccaaggattttatagaagtgtatttcatggaaatgtacagtaaccggatgactgtattaaaattttaaaactgctgggtgtggtggctcatgcatataattccaacactttgggaggccaaggcgggtggatcacatgaggccaggagttcgagaccagcctgaccaacatggtaaaaccctgtctctattaaaaatacaaaaattagcagggtgtggtggtgtgtgcctgtaatcccagctacctgggaggctgaggcaggagaatcacctgaacctgagaggttgcagtgagccaagattgcgccactgcactccagtctgactccgtctcaaataaaacaaaataaaataaaaatctaaaactgacttaggcagttaagtgtgtttccaaagaacgtaattggtgggaggcagagcgggcccgaattgccacctcttcccggcacggccagtgctcttcctcccactcccggccacctccgcaggcccctgcccgtgccaggactgggtgaagctgtgaatgtgcttctccacttgggggtgcgggacaatgctggggccctgggctgggtttctgccctaggaagcctcactgttgagtcaggggctgctggagctgagttttgtcttcagtggcttatgaaggaaagatgaagcta

SEQ ID NO: 2060 - DNA, 9287 bp, Homo sapiens
tgacctctgtggccagagtccccgtcagcaccgcttactgcaggccaagatgcctcccaccctccagaatccgaccgcggagggagcttccagtccaggagcctgcgggaatcctggcgggggctgagggctgcagcccccctggcctgggcattgggtgcctcttagggatcttgcctgggtgccctaaggggtcacccggtgtccgtcctggagggccgcagagtcagcgcaacctgccctggtgctcggtcctaaggtcagctctgcttctcccgagtggggagggcgtcacggtttgcctgcagtgggagcgttccgtgtcattcagacgagcaggtgggaaggtcggcaggagtgcagagaagagacgcgggaagcgggatgcagagagttcacctgtccgtctccgtccgtgtccgcggcccggatcatctcgtccacctcctcgtcactcagcttctcccccagccgggtcatgacgtgtcgcagctcggcggcgctgacgaagccgttgccgtccttgtcgaacacgcggaaggcctcgcggatctcctcctcgttgtccgtgtccttcatcttcctggccatcatgcccaggaactcggggaagtccacggtgccgttgccgtcccggtcgatctcactcatcatgtcccgcagctcggcctccgtggggttctggcccagggaccgcatgaccgtgcccagctcgcgggtggtgatgcagccgtccccatccttgtcaaacagggagaaggcctccttgaattctgtgacctgctcctcagtcagctggtcggccatgccaggggtgggggcgtgggtggcagaagaggccactgtggggtctccctcccagtgccgcagcccggctgctgtcccagctctggggtggcaggtggagatccgggcggccggcgggctgtctcgccctggcttgagacgctggagcttaagaagcagcagagtcctcccccatcattggcagacgcccctgccctgcggttgcccgggcctgtcctgtttagacaggagtccagggcctgcgaatcgagctgacgccagcacctctgtgcctgcttgcacctggacccagcagagccacgggggccccgaatcacacctgcagtcagggcgtggtgggtgagctttggagcaatccacgctggactccttcctcctgaatttccctttctctcctccctccccgtctcccacctgccgcctgtctcccactcaataaactccagtgccctttcttcccttgagtggagggctttttgcaggatgaaaggcagatgaaagaaacgtccttgcctttggtttctaaagcctcatatagaacaggagggtttttggaggaggaaggttttcccttcaggtagaagcagcgagttttcttatcttcagaatggacatgaatagggaggggtttcctccaacccattcactcatccaccctttcacagatatttgagtgcctactaggtgcagtgtcactctggaagctgggaacacagtgggaccggcaagccacccccagtcctcgtgaggttaactagcaagacagctagtttgcaggggctggagagacttcttcatgaaggaatacagggacagtcacaggagacaggagcaccaagggattcggacatgtggctgacacagtcttctggagagccccggatggcatcagggggaaacctggcctgagacagtgccctgatggacaaggacaggaatacggtcatacctcctgcccacttgaccaacgaccaggatgagaagccaacagatgatgaatatgaattaaagttggacaactagcaagtttaaaacttggactgggacctagatcttccgattcctacagctagcctccctttccatcttctctgtggtcatcactaatgcagtttttgaccgtcttgtccagaagctgcaaaacagacaacagaagccaggactggccctgccttagatggctttcagtgcaggaaagtatcaagacagtcttgttcgtagcgtatatctctctccaccttttctgctaagcacctcatgtatgcagctgccaatgtaacacctccatttgcgtgtttaatcaccatctcaagctaatgtaaccaagcagacttcttggccttcatccctgcctcctctagtcttctcatctctctctctctctctctctttttgagacagaatttggctctgttgcccaggctggagtgcagtggcaccatcttggctcactgcaacctctgcctcctgggctcaagccatcctcccaactcagcctcctgagtagctgggtcttcccatctctttaaaaaacaattcaattgttcagaacaaaaccctggagtcatatttaattcctcccttcctcttgcacttctaaaccaatcattcatctctactttgaaaatgtttctttattcatccagtgcaccaagccaccatcacctcgaggcaggaatattcaacggcctcataagtggtctccctatttgtgttatattcaatgcatgtcttttcttactcaaaatcctataaaggcttctcttcaccatccacgactgtttcctgccttcctcactatgatcccatcactgacccctcaagactatgttccagcctactttctgctccttgaccaacacccttactctgattcccacttttgtgacttcacatgagtcccctgtctgcctggacactctgcccccaaccttgaagtgctcacccttccctgtcactcagttgaaagtcaaattccatttcctcatgagggcttccctgaatacccacttttaattaactctctgcctcctcccatcacttctgttttaccccctcttttagttccttcctatcttagtttcataagagccagggccgtttccgacttctttccccgtcaagcctccttagataggacaggtcctctgcctcaccgactttaatcagtatttgctaagtaaacagagcacaggaggatcctgttgtcatcaaagagcagctctgcctccaatggcgaaaggattgttggaacctcatccttccttcaagttctggttcaaaaaattccatgctatgcctcacatggccttgcccaggtgcctgtttgatttgcctgggttgtctgttctttcttccccactgtcctcatttgccatgtggctcggtggtggctggagacctccatgctggcccctgggagcagctgctaaggctcggcgcctcaggacaccttggcacctgtggatatcgaccaccaggcttctcttctgttcatgtctctgcaagaatgagaacctgcccccataccatttgtgctgtgtaggcctcaggaggcatggactcacgcatccagcttcctgcaagccctctggtacatcgcagtgttcacccccagctttctattacagccaccacccagggactctggtgcaggctccttagagagaggccaggaaactgccgaggtgataagtgacagcaggtctcaggggaagagaggacttctctccttagtaaagaacctgtcgaggtcggaaagacactccaggctcaaagccaaatttgaaagttaggctgacagcccaactagggcagattggaggagccaggtggagagaggatgtgggggagtcaggaaagaggtggaaggagaagcctggaagagtggctccgctcctggagtatggccagcggcacttcgtcaggacctcgaccttcacccactagtgggagggtgttcctcgcatgacttgtaggatcacctgggaaacacacaaatggaagaatttaaaaatatctgctaggacaccccgtgtcccccacaactcatcacagagcaaacccatcacagagcaaactccttggctacttcttgtcttgggccgtcttttcatctggcctgtttgcctgactggactttggggtctttgttcccagcatcaaaatttcctaccagcgactttccatcacagctcccttccagtcttctggaaattgtcagatgtgcctggatttgcagggcctgcacaagatatgctgtcgatctgggatttttggggatttttgcagttcacactccaatgtgcaacagcaaccaaacggagatggaggacgtgaacatgaactactggagatgctgatgaaacgtgtgtaaggaccgcaatggtatctgtgtcctgctcgtgaaattgaccagatacagcggcttccttttgcttccgaaggcccggattgacctgacaattgatatgctttgctctatactccaactcccattgaccatggggtgaaagcaccctttctcggtcagcctcactgcttccccgcagatggagggattttctgcaggagcatgggccctgggccttcctttcccactgtctcttgaaagcctcctccagatgtgctgcctggctcagctctttgggtgacttttgttctgtctcatgtgacccatcaagattcacacagggctgtgtcccgggcagggctggagtcgacattcagggaggagatcactgttctggaacagagcagtgattggtttaattgaaatctgatagatcatcatgtaaaaagctggcatgtaagcatgctcccggagcctgcagggccctgcgcggcctcttgcctggccatcacgtagaggcggtcctcttgcatggttgggggcctcacctgcaccacgggcccccaagccaaacagtgagattgtacggagaccatcctggtcaggtcttgcagtttgcaccaggtagccccaggctatcctgccgtgcaagagctgccttctcagcacagtggagttctacggctgcctcggctgcagaggtcagctctggagccttgctgagcacctccatggatgcattttgcaaagggccgagtaagaggcattaacgtggcctgtgcttagttcctgacagcaagcgggattaaacccggattaaaggatcagccctaaaccaaagcagaccagtaataggtctcatgataaaagcagccaaataataatagtaaaaatctattcttggacttattactttcctgggaaaagggctatttcttgtgaaatatgcagcgattggaactttccccgacagcccaccgtgagctcactcactgcccctgcctgtgctggggggtggtgggtggtgagaggtgcaagtgaagggtctggacagaggcagagggaggagagggggcagggggatggggaggaagaatggggggttcgctctgggatagcttcatgatccactgaacctttcaaacttgatgcttgacgttttgaaaaaaatgacagaaaatatgggctgggcactgtggctcacgcctgtaatcctagcactttgggaggctgaggtgggcagatcacctgaggtcaggagttcaagaccagcctggccaacatggttaaaccccgtctctactaaaaataagccaggtgtggtggcacatgcctgtaatcccagctgcttgggaggctgaggcagaaaaattgtttgaatctaggagacagagattgcagtcagccgagatgctgcctctaaactccaggctgggtgaccaagtggggctctgtctcgaaaaaaaaaaaaaaagtgtactagggggatgtcgttgaggggcttagccacatgctacagatctttttataccaagatgcattcaatgattagctaagttggacagtttgttactttaagcctccacaaccaaaggggcaagataattatctcccagagaacaagttgatcttctttgaaggataaggagttccccaagcagcaggaagagcttctgttcccaattccagcctttgaagtttaagcttcagaagaaaaccttagcatttaatacaggaaggcatgcacgtgtgtgtgcatgtgtttgtacccacacatgtggctcaagcttccctgtgacaatgggttgcctgcgggtaagcgtgggatgtgtggagaaggcaggagggtttagggcgtgggctcagtaccctgatgagagatttaaagcaggcaaagggattcggcaaagtgcagctcccatttcatcatttcttcagaccctgccttagttatttactgctgtggttttaaactctgctcttcgaaacccttggtttctgcagaagtccttcgagaggttcgtgggggcaaaggaaggtgaggggcaggagcccaggccacccggcctccttcctttccccacgtctgctttcaactgtttcatatgcatcatgcaaatcgcagctgtcatggctcaggtcctcatgtgtacaatgggcgccatggcagcgtccaggtcagagggtgaccagagtgacatgaattaagacacgagaggactccaaagagtggtcaggcctctcacgtcataagatctccataaatggtcactattattttgtgttattaggggtacgcttttcatttgtaagatgacttccatggggccccacgcctcatgaccccgtctcaccccctgcaaataccatcccatggagaggcaggacttgagcctatgaatttgaggggtacacggttcagtccaaaccttttggtgtttctgtgtatccatttctgcatgtgtaaaatgaggagaacagacagcttccgacctcatctccaaaggcgcacggaggaggtggaaaggccctcgccggagactgagcactgcagccagcgcaaggccggatttgctgcttccgcgcggggacgccctcggaaaggtggcagattctcctgccattcctggctccagggagtcctgaaggaacgatggttagggcggagaatcctgcagaggaaaggagagaaaggactagaggtcacacacggcttcttggaggggagcggggagcaggggctccgaggctgcgggtcgcaggctccagggcaggaagctctccatgggaaccgtagtatgaattccaccgaggtgcgtcccggcacagacccgaaggcagccacatttgtggaaataagatttgacgtgcatttcggatccgcagagaaggtggactctgttttgcagaatggaccagcggtggggggtggggtggggggcaggaaaagactttaaacgctggcagaactttgtattccactcattcgtgcatgcattcattcagccatcctttcgctatcattcatcaaactagcgcgcactgaggccactttgtgtcagcgcagcgcctggcctgaggacctcagggtggtgtcggcaaagttccgctgccaaggagttcacgggccgtgtttcctgccaggccgcagacactctctgcgtggagcccgaggaggttctgtgtgagatctcaccctgcgggaagaaagaggcggaggctcggggttggtccaatcacacccctgatggtgagagacgggcgggcggggcctgacgcccactcccagctggatgcctgtctcccaccccgcgtgtcctttcccagaccccaaagcttcctgcctggtctcagttcttcggagaagagggattagaagctggaacaggtatttctgctaatggggcgtggcagatcggcatttgcgggggctctgtcaccccgtaagatgtcccagcaggaagcgtggcgggtctccactgagagctccacggagcagctttggctccctgagaagtcgaggtgtgagcagtagcggccttccctttgcagagagaaggcttggggagagaagaccctggtgccatcttcataggaggtggaaaggaaactgtatgacaggagaatgaatcaggtttggggctcaaggtgccggccactgggaaaaacagctgccccgagttgcaaaactctgggtcctatatgtataaactatgccctgaggaaggaatctcaggcgtatcttaggagaaaatgttctagcttgggaaacaaacacaacaggaccgtgaatccaaatatttcaagtgggtttagaggactggagttctaaacgctgcttttactgtaagtgatcacgccccggaatgtgctgaagaaaggaaaatgagccagtatcggcgaggactatgggcaaggaaaacgagagtgtgcgatgtgtcaaagcaagacatctgtgtatagtaatataatcaagtaatagatagtcatagaatcaagctgatgtatttggcaggggccgcgggaggatgaggcaactcccatcagattagaaagatgttaacactgtaacaaaagtggggctcgaggaaggggaaaagcgcagctctctttttaagacgccagaaagtagtcagacatgctaagaacaaaacaaacacaaacgaaaaccagcaaagaaagctcttcgagaagagtaaggctactgatctttaggaatcaaatcattatttccacacatgtcatgaagaacacagacattaaagcacaaaggagaaacttaaatgaaagtaggagggagaagtcaaagctcaagtaaagagatttttaacctagagaggctgagttatcaaggaagaaagaaggccaagccagcttgttgcagaatgttccagaagataagataatgatagacttaaataaatagggactgatcaaggtgatagcgagttcttggtgaaattgcttccaaggattttatagaagtgtatttcatggaaatgtacagtaaccggatgactgtattaaaattttaaaactgctgggtgtggtggctcatgcatataattccaacactttgggaggccaaggcgggtggatcacatgaggccaggagttcgagaccagcctgaccaacatggtaaaaccctgtctctattaaaaatacaaaaattagcagggtgtggtggtgtgtgcctgtaatcccagctacctgggaggctgaggcaggagaatcacctgaacctgagaggttgcagtgagccaagattgcgccactgcactccagtctgactccgtctcaaataaaacaaaataaaataaaaatctaaaactgacttaggcagttaagtgtgtttccaaagaacgtaattggtgggaggcagagcgggcccgaattgccacctcttcccggcacggccagtgctcttcctcccactcccggccacctccgcaggcccctgcccgtgccaggactgggtgaagctgtgaatgtgcttctccacttgggggtgcgggacaatgctggggccctgggctgggtttctgccctaggaagcctcactgttgagtcaggggctgctggagctgagttttgtcttcagtggcttatgaaggaaagatgaagcta

SEQ ID NO: 2061 - DNA, 7874 bp, Homo sapiens
tgacctctgtggccagagtccccgtcagcaccgcttactgcaggccaagatgcctcccaccctccagaatccgaccgcggagggagcttccagtccaggagcctgcgggaatcctggcgggggctgagggctgcagcccccctggcctgggcattgggtgcctcttagggatcttgcctgggtgccctaaggggtcacccggtgtccgtcctggagggccgcagagtcagcgcaacctgccctggtgctcggtcctaaggtcagctctgcttctcccgagtggggagggcgtcacggtttgcctgcagtgggagcgttccgtgtcattcagacgagcaggtgggaaggtcggcaggagtgcagagaagagacgcgggaagcgggatgcagagagttcacctgtccgtctccgtccgtgtccgcggcccggatcatctcgtccacctcctcgtcactcagcttctcccccagccgggtcatgacgtgtcgcagctcggcggcgctgacgaagccgttgccgtccttgtcgaacacgcggaaggcctcgcggatctcctcctcgttgtccgtgtccttcatcttcctggccatcatgcccaggaactcggggaagtccacggtgccgttgccgtcccggtcgatctcactcatcatgtcccgcagctcggcctccgtggggttctggcccagggaccgcatgaccgtgcccagctcgcgggtggtgatgcagccgtccccatccttgtcaaacagggagaaggcctccttgaattctgtgacctgctcctcagtcagctggtcggccatgccaggggtgggggcgtgggtggcagaagaggccactgtggggtctccctcccagtgccgcagcccggctgctgtcccagctctggggtggcaggtggagatccgggcggccggcgggctgtctcgccctggcttgagacgctggagcttaagaagcagcagagtcctcccccatcattggcagacgcccctgccctgcggttgcccgggcctgtcctgtttagacaggagtccagggcctgcgaatcgagctgacgccagcacctctgtgcctgcttgcacctggacccagcagagccacgggggccccgaatcacacctgcagtcagggcgtggggctggagagacttcttcatgaaggaatacagggacagtcacaggagacaggagcaccaagggattcggacatgtggctgacacagtcttctggagagccccggatggcatcagggggaaacctggcctgagacagtgccctgatggacaaggacaggaatacggtcatacctcctgcccacttgaccaacgaccaggatgagaagccaacagatgatgaatatgaattaaagttggacaactagcaagtttaaaacttggactgggacctagatcttccgattcctacagctagcctccctttccatcttctctgtggtcatcactaatgcagtttttgaccgtcttgtccagaagctgcaaaacagacaacagaagccaggactggccctgccttagatggctttcagtgcaggaaagtatcaagacagtcttgttcgtagcgtatatctctctccaccttttctgctaagcacctcatgtatgcagctgccaatgtaacacctccatttgcgtgtttaatcaccatctcaagctaatgtaaccaagcagacttcttggccttcatccctgcctcctctagtcttctcatctctctctctctctctctctttttgagacagaatttggctctgttgcccaggctggagtgcagtggcaccatcttggctcactgcaacctctgcctcctgggctcaagccatcctcccaactcagcctcctgagtagctgggtcttcccatctctttaaaaaacaattcaattgttcagaacaaaaccctggagtcatatttaattcctcccttcctcttgcacttctaaaccaatcattcatctctactttgaaaatgtttctttattcatccagtgcaccaagccaccatcacctcgaggcaggaatattcaacggcctcataagtggtctccctatttgtgttatattcaatgcatgtcttttcttactcaaaatcctataaaggcttctcttcaccatccacgactgtttcctgccttcctcactatgatcccatcactgacccctcaagactatgttccagcctactttctgctccttgaccaacacccttactctgattcccacttttgtgacttcacatgagtcccctgtctgcctggacactctgcccccaaccttgaagtgctcacccttccctgtcactcagttgaaagtcaaattccatttcctcatgagggcttccctgaatacccacttttaattaactctctgcctcctcccatcacttctgttttaccccctcttttagttccttcctatcttagtttcataagagccagggccgtttccgacttctttccccgtcaagcctccttagataggacaggtcctctgcctcaccgactttaatcagtatttgctaagtaaacagagcacaggaggatcctgttgtcatcaaagagcagctctgcctccaatggcgaaaggattgttggaacctcatccttccttcaagttctggttcaaaaaattccatgctatgcctcacatggccttgcccaggtgcctgtttgatttgcctgggttgtctgttctttcttccccactgtcctcatttgccatgtggctcggtggtggctggagacctccatgctggcccctgggagcagctgctaaggctcggcgcctcaggacaccttggcacctgtggatatcgaccaccaggcttctcttctgttcatgtctctgcaagaatgagaacctgcccccataccatttgtgctgtgtaggcctcaggaggcatggactcacgcatccagcttcctgcaagccctctggtacatcgcagtgttcacccccagctttctattacagccaccacccagggactctggtgcaggctccttagagagaggccaggaaactgccgaggtgataagtgacagcaggtctcaggggaagagaggacttctctccttagtaaagaacctgtcgaggtcggaaagacactccaggctcaaagccaaatttgaaagttaggctgacagcccaactagggcagattggaggagccaggtggagagaggatgtgggggagtcaggaaagaggtggaaggagaagcctggaagagtggctccgctcctggagtatggccagcggcacttcgtcaggacctcgaccttcacccactagtgggagggtgttcctcgcatgacttgtaggatcacctgggaaacacacaaatggaagaatttaaaaatatctgctaggacaccccgtgtcccccacaactcatcacagagcaaacccatcacagagcaaactccttggctacttcttgtcttgggccgtcttttcatctggcctgtttgcctgactggactttggggtctttgttcccagcatcaaaatttcctaccagcgactttccatcacagctcccttccagtcttctggaaattgtcagatgtgcctggatttgcagggcctgcacaagatatgctgtcgatctgggatttttggggatttttgcagttcacactccaatgtgcaacagcaaccaaacggagatggaggacgtgaacatgaactactggagatgctgatgaaacgtgtgtaaggaccgcaatggtatctgtgtcctgctcgtgaaattgaccagatacagcggcttccttttgcttccgaaggcccggattgacctgacaattgatatgctttgctctatactccaactcccattgaccatggggtgaaagcaccctttctcggtcagcctcactgcttccccgcagatggagggattttctgcaggagcatgggccctgggccttcctttcccactgtctcttgaaagcctcctccagatgtgctgcctggctcagctctttgggtgacttttgttctgtctcatgtgacccatcaagattcacacagggctgtgtcccgggcagggctggagtcgacattcagggaggagatcactgttctggaacagagcagtgattggtttaattgaaatctgatagatcatcatgtaaaaagctggcatgtaagcatgctcccggagcctgcagggccctgcgcggcctcttgcctggccatcacgtagaggcggtcctcttgcatggttgggggcctcacctgcaccacgggcccccaagccaaacagtgagattgtacggagaccatcctggtcaggtcttgcagtttgcaccaggtagccccaggctatcctgccgtgcaagagctgccttctcagcacagtggagttctacggctgcctcggctgcagaggtcagctctggagccttgctgagcacctccatggatgcattttgcaaagggccgagtaagaggcattaacgtggcctgtgcttagttcctgacagcaagcgggattaaacccggattaaaggatcagccctaaaccaaagcagaccagtaataggtctcatgataaaagcagccaaataataatagtaaaaatctattcttggacttattactttcctgggaaaagggctatttcttgtgaaatatgcagcgattggaactttccccgacagcccaccgtgagctcactcactgcccctgcctgtgctggggggtggtgggtggtgagaggtgcaagtgaagggtctggacagaggcagagggaggagagggggcagggggatggggaggaagaatggggggttcgctctgggatagcttcatgatccactgaacctttcaaacttgatgcttgacgttttgaaaaaaatgacagaaaatatgggctgggcactgtggctcacgcctgtaatcctagcactttgggaggctgaggtgggcagatcacctgaggtcaggagttcaagaccagcctggccaacatggttaaaccccgtctctactaaaaataagccaggtgtggtggcacatgcctgtaatcccagctgcttgggaggctgaggcagaaaaattgtttgaatctaggagacagagattgcagtcagccgagatgctgcctctaaactccaggctgggtgaccaagtggggctctgtctcgaaaaaaaaaaaaaaagtgtactagggggatgtcgttgaggggcttagccacatgctacagatctttttataccaagatgcattcaatgattagctaagttggacagtttgttactttaagcctccacaaccaaaggggcaagataattatctcccagagaacaagttgatcttctttgaaggataaggagttccccaagcagcaggaagagcttctgttcccaattccagcctttgaagtttaagcttcagaagaaaaccttagcatttaatacaggaaggcatgcacgtgtgtgtgcatgtgtttgtacccacacatgtggctcaagcttccctgtgacaatgggttgcctgcgggtaagcgtgggatgtgtggagaaggcaggagggtttagggcgtgggctcagtaccctgatgagagatttaaagcaggcaaagggattcggcaaagtgcagctcccatttcatcatttcttcagaccctgccttagttatttactgctgtggttttaaactctgctcttcgaaacccttggtttctgcagaagtccttcgagaggttcgtgggggcaaaggaagaacagacagcttccgacctcatctccaaaggcgcacggaggaggtggaaaggccctcgccggagactgagcactgcagccagcgcaaggccggatttgctgcttccgcgcggggacgccctcggaaaggtggcaggccgcagacactctctgcgtggagcccgaggaggttctgtgtgagatctcaccctgcgggaagaaagaggcggaggctcggggttggtccaatcacacccctgatggtgagagacgggcgggcggggcctgacgcccactcccagctggatgcctgtctcccaccccgcgtgtcctttcccagaccccaaagcttcctgcctggtctcagttcttcggagaagagggattagaagctggaacaggtatttctgctaatggggcgtggcagatcggcatttgcgggggctctgtcaccccgtaagatgtcccagcaggaagcgtggcgggtctccactgagagctccacggagcagctttggctccctgagaagtcgaggtgtgagcagtagcggccttccctttgcagagagaaggcttggggagagaagaccctggtgccatcttcataggaggtggaaaggaaactgtatgacaggagaatgaatcaggtttggggctcaaggtgccggccactgggaaaaacagctgccccgagttgcaaaactctgggtcctatatgtataaactatgccctgaggaaggaatctcaggcgtatcttaggagaaaatgttctagcttgggaaacaaacacaacaggaccgtgaatccaaatatttcaagtgggtttagaggactggagttctaaacgctgcttttactgtaagtgatcacgccccggaatgtgctgaagaaaggaaaatgagccagtatcggcgaggactatgggcaaggaaaacgagagtgtgcgatgtgtcaaagcaagacatctgtgtatagtaatataatcaagtaatagatagtcatagaatcaagctgatgtatttggcaggggccgcgggaggatgaggcaactcccatcagattagaaagatgttaacactgtaacaaaagtggggctcgaggaaggggaaaagcgcagctctctttttaagacgccagaaagtagtcagacatgctaagaacaaaacaaacacaaacgaaaaccagcaaagaaagctcttcgagaagagtaaggctactgatctttaggaatcaaatcattatttccacacatgtcatgaagaacacagacattaaagcacaaaggagaaacttaaatgaaagtaggagggagaagtcaaagctcaagtaaagagatttttaacctagagaggctgagttatcaaggaagaaagaaggccaagccagcttgttgcagaatgttccagaagataagataatgatagacttaaataaatagggactgatcaaggtgatagcgagttcttggtgaaattgcttccaaggattttatagaagtgtatttcatggaaatgtacagtaaccggatgactgtattaaaattttaaaactgctgggtgtggtggctcatgcatataattccaacactttgggaggccaaggcgggtggatcacatgaggccaggagttcgagaccagcctgaccaacatggtaaaaccctgtctctattaaaaatacaaaaattagcagggtgtggtggtgtgtgcctgtaatcccagctacctgggaggctgaggcaggagaatcacctgaacctgagaggttgcagtgagccaagattgcgccactgcactccagtctgactccgtctcaaataaaacaaaataaaataaaaatctaaaactgacttaggcagttaagtgtgtttccaaagaacgtaattggtgggaggcagagcgggcccgaattgccacctcttcccggcacggccagtgctcttcctcccactcccggccacctccgcaggcccctgcccgtgccaggactgggtgaagctgtgaatgtgcttctccacttgggggtgcgggacaatgctggggccctgggctgggtttctgccctaggaagcctcactgttgagtcaggggctgctggagctgagttttgtcttcagtggcttatgaaggaaagatgaagcta

SEQ ID NO: 2062 - DNA, 7874 bp, Homo sapiens; identical to SEQ ID NO: 2061

SEQ ID NO: 2063 - DNA, 7874 bp, Homo sapiens; identical to SEQ ID NO: 2061

SEQ ID NO: 2064 - DNA, 9117 bp, Homo sapiens
ctggggcagcgcggaaggcagtgctgttttcaggaggcctgacctctgtggccagagtccccgtcagcaccgcttactgcaggccaagatgcctcccaccctccagaatccgaccgcggagggagcttccagtccaggagcctgcgggaatcctggcgggggctgagggctgcagcccccctggcctgggcattgggtgcctcttagggatcttgcctgggtgccctaaggggtcacccggtgtccgtcctggagggccgcagagtcagcgcaacctgccctggtgctcggtcctaaggtcagctctgcttctcccgagtggggagggcgtcacggtttgcctgcagtgggagcgttccgtgtcattcagacgagcaggtgggaaggtcggcaggagtgcagagaagagacgcgggaagcgggatgcagagagttcacctgtccgtctccgtccgtgtccgcggcccggatcatctcgtccacctcctcgtcactcagcttctcccccagccgggtcatgacgtgtcgcagctcggcggcgctgacgaagccgttgccgtccttgtcgaacacgcggaaggcctcgcggatctcctcctcgttgtccgtgtccttcatcttcctggccatcatgcccaggaactcggggaagtccacggtgccgttgccgtcccggtcgatctcactcatcatgtcccgcagctcggcctccgtggggttctggcccagggaccgcatgaccgtgcccagctcgcgggtggtgatgcagccgtccccatccttgtcaaacagggagaaggcctccttgaattctgtgacctgctcctcagtcagctggtcggccatgccaggggtgggggcgtgggtggcagaagaggccactgtggggtctccctcccagtgccgcagcccggctgctgtcccagctctggggtggcaggtggagatccgggcggccggcgggctgtctcgccctggcttgagacgctggagcttaagaagcagcagagtcctcccccatcattggcagacgcccctgccctgcggttgcccgggcctgtcctgtttagacaggagtccagggcctgcgaatcgagctgacgccagcacctctgtgcctgcttgcacctggacccagcagagccacgggggccccgaatcacacctgcagtcagggcgtggtggatatttgagtgcctactaggtgcagtgtcactctggaagctgggaacacagtgggaccggcaagccacccccagtcctcgtgaggttaactagcaagacagctagtttgcaggggctggagagacttcttcatgaaggaatacagggacagtcacaggagacaggagcaccaagggattcggacatgtggctgacacagtcttctggagagccccggatggcatcagggggaaacctggcctgagacagtgccctgatggacaaggacaggaatacggtcatacctcctgcccacttgaccaacgaccaggatgagaagccaacagatgatgaatatgaattaaagttggacaactagcaagtttaaaacttggactgggacctagatcttccgattcctacagctagcctccctttccatcttctctgtggtcatcactaatgcagtttttgaccgtcttgtccagaagctgcaaaacagacaacagaagccaggactggccctgccttagatggctttcagtgcaggaaagtatcaagacagtcttgttcgtagcgtatatctctctccaccttttctgctaagcacctcatgtatgcagctgccaatgtaacacctccatttgcgtgtttaatcaccatctcaagctaatgtaaccaagcagacttcttggccttcatccctgcctcctctagtcttctcatctctctctctctctctctctttttgagacagaatttggctctgttgcccaggctggagtgcagtggcaccatcttggctcactgcaacctctgcctcctgggctcaagccatcctcccaactcagcctcctgagtagctgggtcttcccatctctttaaaaaacaattcaattgttcagaacaaaaccctggagtcatatttaattcctcccttcctcttgcacttctaaaccaatcattcatctctactttgaaaatgtttctttattcatccagtgcaccaagccaccatcacctcgaggcaggaatattcaacggcctcataagtggtctccctatttgtgttatattcaatgcatgtcttttcttactcaaaatcctataaaggcttctcttcaccatccacgactgtttcctgccttcctcactatgatcccatcactgacccctcaagactatgttccagcctactttctgctccttgaccaacacccttactctgattcccacttttgtgacttcacatgagtcccctgtctgcctggacactctgcccccaaccttgaagtgctcacccttccctgtcactcagttgaaagtcaaattccatttcctcatgagggcttccctgaatacccacttttaattaactctctgcctcctcccatcacttctgttttaccccctcttttagttccttcctatcttagtttcataagagccagggccgtttccgacttctttccccgtcaagcctccttagataggacaggtcctctgcctcaccgactttaatcagtatttgctaagtaaacagagcacaggaggatcctgttgtcatcaaagagcagctctgcctccaatggcgaaaggattgttggaacctcatccttccttcaagttctggttcaaaaaattccatgctatgcctcacatggccttgcccaggtgcctgtttgatttgcctgggttgtctgttctttcttccccactgtcctcatttgccatgtggctcggtggtggctggagacctccatgctggcccctgggagcagctgctaaggctcggcgcctcaggacaccttggcacctgtggatatcgaccaccaggcttctcttctgttcatgtctctgcaagaatgagaacctgcccccataccatttgtgctgtgtaggcctcaggaggcatggactcacgcatccagcttcctgcaagccctctggtacatcgcagtgttcacccccagctttctattacagccaccacccagggactctggtgcaggctccttagagagaggccaggaaactgccgaggtgataagtgacagcaggtctcaggggaagagaggacttctctccttagtaaagaacctgtcgaggtcggaaagacactccaggctcaaagccaaatttgaaagttaggctgacagcccaactagggcagattggaggagccaggtggagagaggatgtgggggagtcaggaaagaggtggaaggagaagcctggaagagtggctccgctcctggagtatggccagcggcacttcgtcaggacctcgaccttcacccactagtgggagggtgttcctcgcatgacttgtaggatcacctgggaaacacacaaatggaagaatttaaaaatatctgctaggacaccccgtgtcccccacaactcatcacagagcaaacccatcacagagcaaactccttggctacttcttgtcttgggccgtcttttcatctggcctgtttgcctgactggactttggggtctttgttcccagcatcaaaatttcctaccagcgactttccatcacagctcccttccagtcttctggaaattgtcagatgtgcctggatttgcagggcctgcacaagatatgctgtcgatctgggatttttggggatttttgcagttcacactccaatgtgcaacagcaaccaaacggagatggaggacgtgaacatgaactactggagatgctgatgaaacgtgtgtaaggaccgcaatggtatctgtgtcctgctcgtgaaattgaccagatacagcggcttccttttgcttccgaaggcccggattgacctgacaattgatatgctttgctctatactccaactcccattgaccatggggtgaaagcaccctttctcggtcagcctcactgcttccccgcagatggagggattttctgcaggagcatgggccctgggccttcctttcccactgtctcttgaaagcctcctccagatgtgctgcctggctcagctctttgggtgacttttgttctgtctcatgtgacccatcaagattcacacagggctgtgtcccgggcagggctggagtcgacattcagggaggagatcactgttctggaacagagcagtgattggtttaattgaaatctgatagatcatcatgtaaaaagctggcatgtaagcatgctcccggagcctgcagggccctgcgcggcctcttgcctggccatcacgtagaggcggtcctcttgcatggttgggggcctcacctgcaccacgggcccccaagccaaacagtgagattgtacggagaccatcctggtcaggtcttgcagtttgcaccaggtagccccaggctatcctgccgtgcaagagctgccttctcagcacagtggagttctacggctgcctcggctgcagaggtcagctctggagccttgctgagcacctccatggatgcattttgcaaagggccgagtaagaggcattaacgtggcctgtgcttagttcctgacagcaagcgggattaaacccggattaaaggatcagccctaaaccaaagcagaccagtaataggtctcatgataaaagcagccaaataataatagtaaaaatctattcttggacttattactttcctgggaaaagggctatttcttgtgaaatatgcagcgattggaactttccccgacagcccaccgtgagctcactcactgcccctgcctgtgctggggggtggtgggtggtgagaggtgcaagtgaagggtctggacagaggcagagggaggagagggggcagggggatggggaggaagaatggggggttcgctctgggatagcttcatgatccactgaacctttcaaacttgatgcttgacgttttgaaaaaaatgacagaaaatatgggctgggcactgtggctcacgcctgtaatcctagcactttgggaggctgaggtgggcagatcacctgaggtcaggagttcaagaccagcctggccaacatggttaaaccccgtctctactaaaaataagccaggtgtggtggcacatgcctgtaatcccagctgcttgggaggctgaggcagaaaaattgtttgaatctaggagacagagattgcagtcagccgagatgctgcctctaaactccaggctgggtgaccaagtggggctctgtctcgaaaaaaaaaaaaaaagtgtactagggggatgtcgttgaggggcttagccacatgctacagatctttttataccaagatgcattcaatgattagctaagttggacagtttgttactttaagcctccacaaccaaaggggcaagataattatctcccagagaacaagttgatcttctttgaaggataaggagttccccaagcagcaggaagagcttctgttcccaattccagcctttgaagtttaagcttcagaagaaaaccttagcatttaatacaggaaggcatgcacgtgtgtgtgcatgtgtttgtacccacacatgtggctcaagcttccctgtgacaatgggttgcctgcgggtaagcgtgggatgtgtggagaaggcaggagggtttagggcgtgggctcagtaccctgatgagagatttaaagcaggcaaagggattcggcaaagtgcagctcccatttcatcatttcttcagaccctgccttagttatttactgctgtggttttaaactctgctcttcgaaacccttggtttctgcagaagtccttcgagaggttcgtgggggcaaaggaaggtgaggggcaggagcccaggccacccggcctccttcctttccccacgtctgctttcaactgtttcatatgcatcatgcaaatcgcagctgtcatggctcaggtcctcatgtgtacaatgggcgccatggcagcgtccaggtcagagggtgaccagagtgacatgaattaagacacgagaggactccaaagagtggtcaggcctctcacgtcataagatctccataaatggtcactattattttgtgttattaggggtacgcttttcatttgtaagatgacttccatggggccccacgcctcatgaccccgtctcaccccctgcaaataccatcccatggagaggcaggacttgagcctatgaatttgaggggtacacggttcagtccaaaccttttggtgtttctgtgtatccatttctgcatgtgtaaaatgaggagaacagacagcttccgacctcatctccaaaggcgcacggaggaggtggaaaggccctcgccggagactgagcactgcagccagcgcaaggccggatttgctgcttccgcgcggggacgccctcggaaaggtggcaggtgcccacggcgaggaaggggcgggagtgaggggtgcgtggcccgagagaactcagtgaagaaggccattagggaggaaataagggaaacggggtgtgcgaagctctgagctttttctgcccggtttggctgaggacacgccacgggtgagcatctgcgcgaggggagcttggtgggtgaggaaggaagaagacacgatagagaactggaagcaagaagggaggaaaccaaaaggaacggggaggagaaagggcttctctggagctgcttgcttttcccagattctcctgccattcctggctccagggagtcctgaaggaacgatggttagggcggagaatcctgcagaggaaaggagagaaaggactagaggtcacacacggcttcttggaggggagcggggagcaggggctccgaggctgcgggtcgcaggctccagggcaggaagctctccatgggaaccgtagtatgaattccaccgaggtgcgtcccggcacagacccgaaggcagccacatttgtggaaataagatttgacgtgcatttcggatccgcagagaaggtggactctgttttgcagaatggaccagcggtggggggtggggtggggggcaggaaaagactttaaacgctggcagaactttgtattccactcattcgtgcatgcattcattcagccatcctttcgctatcattcatcaaactagcgcgcactgaggccactttgtgtcagcgcagcgcctggcctgaggacctcagggtggtgtcggcaaagttccgctgccaaggagttcacgggccgtgtttcctgccaggccgcagacactctctgcgtggagcccgaggaggttctgtgtgagatctcaccctgcgggaagaaagaggcggaggctcggggttggtccaatcacacccctgatggtgagagacgggcgggcggggcctgacgcccactcccagctggatgcctgtctcccaccccgcgtgtcctttcccagaccccaaagcttcctgcctggtctcagttcttcggagaagagggattagaagctggaacagagagaaggcttggggagagaagaccctggtgccatcttcataggaggtggaaaggaaactgtatgacaggagaatgaatcaggtttggggctcaaggtgccggccactgggaaaaacagctgccccgagttgcaaaactctgggtcctatatgtataaactatgccctgaggaaggaatctcaggcgtatcttaggagaaaatgttctagcttgggaaacaaacacaacaggaccgtgaatccaaatatttcaagtgggtttagaggactggagttctaaacgctgcttttactgtaagtgatcacgccccggaatgtgctgaagaaaggaaaatgagccagtatcggcgaggactatgggcaaggaaaacgagagtgtgcgatgtgtcaaagcaagacatctgtgtatagtaatataatcaagtaatagatagtcatagaatcaagctgatgtatttggcaggggccgcgggaggatgaggcaactcccatcagattagaaagatgttaacactgtaacaaaagtggggctcgaggaaggggaaaagcgcagctctctttttaagacgccagaaagtagtcagacatgctaagaacaaaacaaacacaaacgaaaaccagcaaagaaagctcttcgagaagagtaaggctactgatctttaggaatcaaatcattatttccacacatgtcatgaagaacacagacattaaagcacaaaggagaaacttaaatgaaagtaggagggagaagtcaaagctcaagtaaagagatttttaacctagagaggctgagttatcaaggaagaaagaaggccaagccagcttgttgcagaatgttccagaagataagataatgatagacttaaataaatagggactgatcaaggtgatagcgagttcttggtgaaattgcttccaaggattttatagaagtgtatttcatggaaatgtacagtaaccggatgactgtattaaaattttaaaactgctgggtgtggtggctcatgcatataattccaacactttgggaggccaaggcgggtggatcacatgaggccaggagttcgagaccagcctgaccaacatggtaaaaccctgtctctattaaaaatacaaaaattagcagggtgtggtggtgtgtgcctgtaatcccagctacctgggaggctgaggcaggagaatcacctgaacctgagaggttgcagtgagccaagattgcgccactgcactccagtctgactccgtctcaaataaaacaaaataaaataaaaatctaaaactgacttaggcagttaagtgtgtttccaaagaacgtaattggtgggaggcagagcgggcccgaattgccacctcttcccggcacggccagtgctcttcctcccactcccggccacctccgcaggcccctgcccgtgccaggactgggtgaagctgtgaatgtgcttctccacttgggggtgcgggacaatgctggggccctgggctgggtttctgccctaggaagcctcactgttgagtcaggggctgctggagctgagttttgtcttcagtggcttatgaaggaaagatgaagcta

SEQ ID NO: 2065 - DNA, 11578 bp, Homo sapiens
tctgtctcaaaaaaaaaaaaaaaaaaaaagacacctccacttactactctgcttctgaggactccccctcagggaggatctggggctgccagttctaagctgagagcaggtaggacctttccaccaccccagccagtgcctgcctgagcacaaagagctcttgatgaaaggctcccagcacctgcaaaatccaggcccaggtggctccagaatgactggtgtgtggggttgcaaaaagacctgccctggcggaatcgctgggaggctgggaggaagacaaataaagacactggcgtgccctcctggcccaggcattggcagtgcgtaggtcccaacccttgtaagagcctcaagcctgcacctgggaagaaggggcttagatgtcaaacctcagccacgtgtatgacagtgactacaaagatgccctgtgcagggagaccttggtttctctccttcctgcagaatttaggagacattctacaaaaggtactcaggcctgatgtactattccttttgcctggcggtcagcagccatgtgggggcttctgcctgcccctcctgctcacagccccccaccccctggggtgctgctgcccaatgaactctagacactctgtccatgtgtttatgaggcttgttcccaaatcttccccaggacgtgtccaatcaaccccgactcctgagagtggcagggaggggtggggatttgctcagcaagctgagccttagcttgccctctgcttctgttcccctgacaggagtacctgcagttacaccggccctgggccagtgctcacctgacaccccaccatccagcatcccctcaggaatccagccccagagcacctgcttctgcccctttctgctcttgtcttgttctcgagctatggagaggggtgactaccctggacagtcttgcagtattagagcaggaagggatcttgaaggtgatggtaacagtagctgccattattaagcacctactacatgccaggtgtgttaagaatgttgttctggctcctcacaagtgctggagagaggcgctaccgtagttaccatgatggaggcacaggttggtgtcagacctgtagctgagtggtcagggcacagacctgactgaaatcccaggtctgcctcttacccactggtgggacccagggctgctttctaaagccctctgtgtctccacttcctcgtttgtaagatgaggaaggtaataatagtggctgccccatagggaggtgccaattgtctatgcaggccaagtgcttgatggtgccctgagcccaagcaggtggcatgagggtcctgtcatcctggaggtcccagtggtgcagtgatgatggcaaggccggggctggggcccagctctttgttttacaaaggaggaaacactgggtgttggtgggcgggggtggggtgtcagggagagaggatacatccaccatggccttttctgatgagctccgtctagtgcccatcccgcaaaacatacctccctttagaattgaagggatctctggcagggccccttcgaccttctctaggtgttgccagcagcttgcagggctagtgcaggactaacggctctgaattgctcttacactgtgtgtgcccaactgccccccaacccctcaccatctctagtgcctggcacttcacaaccagggagcacttgccagggggaatcaaagcaatcagcaggtcccttctcaacgtaatggactcaggtctttcaagtcctgatggacttttaaccactctttgctgccagcgtatccatttgattgagaatattcaatatttccctcatccagacttgtctctctctgaggcacctttcccgctcccccgtataggaattcattgcattttcaaaaagcacaaaaatggagattcctgcctcgtttcaaccctgaatttaacaaggatcatttccatggaaaccaaaaaaaaaaaggaaatgaaataaggacgaatatctcatttatttccctgcagctctcatcccctgctcatccaagcctccctccttccagatgaataggaacaggttacagctgacccagtttcactcccagcttcagaagatgaatcacggtgggttggcggacaaggaatggggcaagctggggcagcgcggaaggcagtgctgttttcaggaggcctgacctctgtggccagagtccccgtcagcaccgcttactgcaggccaagatgcctcccaccctccagaatccgaccgcggagggagcttccagtccaggagcctgcgggaatcctggcgggggctgagggctgcagcccccctggcctgggcattgggtgcctcttagggatcttgcctgggtgccctaaggggtcacccggtgtccgtcctggagggccgcagagtcagcgcaacctgccctggtgctcggtcctaaggtcagctctgcttctcccgagtggggagggcgtcacggtttgcctgcagtgggagcgttccgtgtcattcagacgagcaggtgggaaggtcggcaggagtgcagagaagagacgcgggaagcgggatgcagagaggtgggctgaatcaaccaggcgcaggaggaagccacagtgcccaggggaggcagggggatgggggaggaggcgggaggccccgggttcttgccctgtgggccgcgtgggcgcccaggagcatggtgggcgccggcctcacttggacaccagcacacggacaaactcctcgtagttcacctgtccgtctccgtccgtgtccgcggcccggatcatctcgtccacctcctcgtcactcagcttctcccccagccgggtcatgacgtgtcgcagctcggcggcgctgacgaagccgttgccgtccttgtcgaacacgcggaaggcctcgcggatctcctcctcgttgtccgtgtccttcatcttcctggccatcatgcccaggaactcggggaagtccacggtgccgttgccgtcccggtcgatctcactcatcatgtcccgcagctcggcctccgtggggttctggcccagggaccgcatgaccgtgcccagctcgcgggtggtgatgcagccgtccccatccttgtcaaacagggagaaggcctccttgaattctgtgacctgctcctcagtcagctggtcggccatgccaggggtgggggcgtgggtggcagaagaggccactgtggggtctccctcccagtgccgcagcccggctgctgtcccagctctggggtggcaggtggagatccgggcggccggcgggctgtctcgccctggcttgagacgctggagcttaagaagcagcagagtcctcccccatcattggcagacgcccctgccctgcggttgcccgggcctgtcctgtttagacaggagtccagggcctgcgaatcgagctgacgccagcacctctgtgcctgcttgcacctggacccagcagagccacgggggccccgaatcacacctgcagtcagggcgtgatatttgagtgcctactaggtgcagtgtcactctggaagctgggaacacagtgggaccggcaagccacccccagtcctcgtgaggttaactagcaagacagctagtttgcaggggctggagagacttcttcatgaaggaatacagggacagtcacaggagacaggagcaccaagggattcggacatgtggctgacacagtcttctggagagccccggatggcatcagggggaaacctggcctgagacagtgccctgatggacaaggacaggaatacggtcatacctcctgcccacttgaccaacgaccaggatgagaagccaacagatgatgaatatgaattaaagttggacaactagcaagtttaaaacttggactgggacctagatcttccgattcctacagctagcctccctttccatcttctctgtggtcatcactaatgcagtttttgaccgtcttgtccagaagctgcaaaacagacaacagaagccaggactggccctgccttagatggctttcagtgcaggaaagtatcaagacagtcttgttcgtagcgtatatctctctccaccttttctgctaagcacctcatgtatgcagctgccaatgtaacacctccatttgcgtgtttaatcaccatctcaagctaatgtaaccaagcagacttcttggccttcatccctgcctcctctagtcttctcatctctctctctctctctctctttttgagacagaatttggctctgttgcccaggctggagtgcagtggcaccatcttggctcactgcaacctctgcctcctgggctcaagccatcctcccaactcagcctcctgagtagctgggtcttcccatctctttaaaaaacaattcaattgttcagaacaaaaccctggagtcatatttaattcctcccttcctcttgcacttctaaaccaatcattcatctctactttgaaaatgtttctttattcatccagtgcaccaagccaccatcacctcgaggcaggaatattcaacggcctcataagtggtctccctatttgtgttatattcaatgcatgtcttttcttactcaaaatcctataaaggcttctcttcaccatccacgactgtttcctgccttcctcactatgatcccatcactgacccctcaagactatgttccagcctactttctgctccttgaccaacacccttactctgattcccacttttgtgacttcacatgagtcccctgtctgcctggacactctgcccccaaccttgaagtgctcacccttccctgtcactcagttgaaagtcaaattccatttcctcatgagggcttccctgaatacccacttttaattaactctctgcctcctcccatcacttctgttttaccccctcttttagttccttcctatcttagtttcataagagccagggccgtttccgacttctttccccgtcaagcctccttagataggacaggtcctctgcctcaccgactttaatcagtatttgctaagtaaacagagcacaggaggatcctgttgtcatcaaagagcagctctgcctccaatggcgaaaggattgttggaacctcatccttccttcaagttctggttcaaaaaattccatgctatgcctcacatggccttgcccaggtgcctgtttgatttgcctgggttgtctgttctttcttccccactgtcctcatttgccatgtggctcggtggtggctggagacctccatgctggcccctgggagcagctgctaaggctcggcgcctcaggacaccttggcacctgtggatatcgaccaccaggcttctcttctgttcatgtctctgcaagaatgagaacctgcccccataccatttgtgctgtgtaggcctcaggaggcatggactcacgcatccagcttcctgcaagccctctggtacatcgcagtgttcacccccagctttctattacagccaccacccagggactctggtgcaggctccttagagagaggccaggaaactgccgaggtgataagtgacagcaggtctcaggggaagagaggacttctctccttagtaaagaacctgtcgaggtcggaaagacactccaggctcaaagccaaatttgaaagttaggctgacagcccaactagggcagattggaggagccaggtggagagaggatgtgggggagtcaggaaagaggtggaaggagaagcctggaagagtggctccgctcctggagtatggccagcggcacttcgtcaggacctcgaccttcacccactagtgggagggtgttcctcgcatgacttgtaggatcacctgggaaacacacaaatggaagaatttaaaaatatctgctaggacaccccgtgtcccccacaactcatcacagagcaaacccatcacagagcaaactccttggctacttcttgtcttgggccgtcttttcatctggcctgtttgcctgactggactttggggtctttgttcccagcatcaaaatttcctaccagcgactttccatcacagctcccttccagtcttctggaaattgtcagatgtgcctggatttgcagggcctgcacaagatatgctgtcgatctgggatttttggggatttttgcagttcacactccaatgtgcaacagcaaccaaacggagatggaggacgtgaacatgaactactggagatgctgatgaaacgtgtgtaaggaccgcaatggtatctgtgtcctgctcgtgaaattgaccagatacagcggcttccttttgcttccgaaggcccggattgacctgacaattgatatgctttgctctatactccaactcccattgaccatggggtgaaagcaccctttctcggtcagcctcactgcttccccgcagatggagggattttctgcaggagcatgggccctgggccttcctttcccactgtctcttgaaagcctcctccagatgtgctgcctggctcagctctttgggtgacttttgttctgtctcatgtgacccatcaagattcacacagggctgtgtcccgggcagggctggagtcgacattcagggaggagatcactgttctggaacagagcagtgattggtttaattgaaatctgatagatcatcatgtaaaaagctggcatgtaagcatgctcccggagcctgcagggccctgcgcggcctcttgcctggccatcacgtagaggcggtcctcttgcatggttgggggcctcacctgcaccacgggcccccaagccaaacagtgagattgtacggagaccatcctggtcaggtcttgcagtttgcaccaggtagccccaggctatcctgccgtgcaagagctgccttctcagcacagtggagttctacggctgcctcggctgcagaggtcagctctggagccttgctgagcacctccatggatgcattttgcaaagggccgagtaagaggcattaacgtggcctgtgcttagttcctgacagcaagcgggattaaacccggattaaaggatcagccctaaaccaaagcagaccagtaataggtctcatgataaaagcagccaaataataatagtaaaaatctattcttggacttattactttcctgggaaaagggctatttcttgtgaaatatgcagcgattggaactttccccgacagcccaccgtgagctcactcactgcccctgcctgtgctggggggtggtgggtggtgagaggtgcaagtgaagggtctggacagaggcagagggaggagagggggcagggggatggggaggaagaatggggggttcgctctgggatagcttcatgatccactgaacctttcaaacttgatgcttgacgttttgaaaaaaatgacagaaaatatgggctgggcactgtggctcacgcctgtaatcctagcactttgggaggctgaggtgggcagatcacctgaggtcaggagttcaagaccagcctggccaacatggttaaaccccgtctctactaaaaataagccaggtgtggtggcacatgcctgtaatcccagctgcttgggaggctgaggcagaaaaattgtttgaatctaggagacagagattgcagtcagccgagatgctgcctctaaactccaggctgggtgaccaagtggggctctgtctcgaaaaaaaaaaaaaaagtgtactagggggatgtcgttgaggggcttagccacatgctacagatctttttataccaagatgcattcaatgattagctaagttggacagtttgttactttaagcctccacaaccaaaggggcaagataattatctcccagagaacaagttgatcttctttgaaggataaggagttccccaagcagcaggaagagcttctgttcccaattccagcctttgaagtttaagcttcagaagaaaaccttagcatttaatacaggaaggcatgcacgtgtgtgtgcatgtgtttgtacccacacatgtggctcaagcttccctgtgacaatgggttgcctgcgggtaagcgtgggatgtgtggagaaggcaggagggtttagggcgtgggctcagtaccctgatgagagatttaaagcaggcaaagggattcggcaaagtgcagctcccatttcatcatttcttcagaccctgccttagttatttactgctgtggttttaaactctgctcttcgaaacccttggtttctgcagaagtccttcgagaggttcgtgggggcaaaggaaggtgaggggcaggagcccaggccacccggcctccttcctttccccacgtctgctttcaactgtttcatatgcatcatgcaaatcgcagctgtcatggctcaggtcctcatgtgtacaatgggcgccatggcagcgtccaggtcagagggtgaccagagtgacatgaattaagacacgagaggactccaaagagtggtcaggcctctcacgtcataagatctccataaatggtcactattattttgtgttattaggggtacgcttttcatttgtaagatgacttccatggggccccacgcctcatgaccccgtctcaccccctgcaaataccatcccatggagaggcaggacttgagcctatgaatttgaggggtacacggttcagtccaaaccttttggtgtttctgtgtatccatttctgcatgtgtaaaatgaggagaacagacagcttccgacctcatctccaaaggcgcacggaggaggtggaaaggccctcgccggagactgagcactgcagccagcgcaaggccggatttgctgcttccgcgcggggacgccctcggaaaggtggcaggtgcccacggcgaggaaggggcgggagtgaggggtgcgtggcccgagagaactcagtgaagaaggccattagggaggaaataagggaaacggggtgtgcgaagctctgagctttttctgcccggtttggctgaggacacgccacgggtgagcatctgcgcgaggggagcttggtgggtgaggaaggaagaagacacgatagagaactggaagcaagaagggaggaaaccaaaaggaacggggaggagaaagggcttctctggagctgcttgcttttcccagattctcctgccattcctggctccagggagtcctgaaggaacgatggttagggcggagaatcctgcagaggaaaggagagaaaggactagaggtcacacacggcttcttggaggggagcggggagcaggggctccgaggctgcgggtcgcaggctccagggcaggaagctctccatgggaaccgtagtatgaattccaccgaggtgcgtcccggcacagacccgaaggcagccacatttgtggaaataagatttgacgtgcatttcggatccgcagagaaggtggactctgttttgcagaatggaccagcggtggggggtggggtggggggcaggaaaagactttaaacgctggcagaactttgtattccactcattcgtgcatgcattcattcagccatcctttcgctatcattcatcaaactagcgcgcactgaggccactttgtgtcagcgcagcgcctggcctgaggacctcagggtggtgtcggcaaagttccgctgccaaggagttcacgggccgtgtttcctgccaggccgcagacactctctgcgtggagcccgaggaggttctgtgtgagatctcaccctgcgggaagaaagaggcggaggctcggggttggtccaatcacacccctgatggtgagagacgggcgggcggggcctgacgcccactcccagctggatgcctgtctcccaccccgcgtgtcctttcccagaccccaaagcttcctgcctggtctcagttcttcggagaagagggattagaagctggaacaggtatttctgctaatggggcgtggcagatcggcatttgcgggggctctgtcaccccgtaagatgtcccagcaggaagcgtggcgggtctccactgagagctccacggagcagctttggctccctgagaagtcgaggtgtgagcagtagcggccttccctttgcagagagaaggcttggggagagaagaccctggtgccatcttcataggaggtggaaaggaaactgtatgacaggagaatgaatcaggtttggggctcaaggtgccggccactgggaaaaacagctgccccgagttgcaaaactctgggtcctatatgtataaactatgccctgaggaaggaatctcaggcgtatcttaggagaaaatgttctagcttgggaaacaaacacaacaggaccgtgaatccaaatatttcaagtgggtttagaggactggagttctaaacgctgcttttactgtaagtgatcacgccccggaatgtgctgaagaaaggaaaatgagccagtatcggcgaggactatgggcaaggaaaacgagagtgtgcgatgtgtcaaagcaagacatctgtgtatagtaatataatcaagtaatagatagtcatagaatcaagctgatgtatttggcaggggccgcgggaggatgaggcaactcccatcagattagaaagatgttaacactgtaacaaaagtggggctcgaggaaggggaaaagcgcagctctctttttaagacgccagaaagtagtcagacatgctaagaacaaaacaaacacaaacgaaaaccagcaaagaaagctcttcgagaagagtaaggctactgatctttaggaatcaaatcattatttccacacatgtcatgaagaacacagacattaaagcacaaaggagaaacttaaatgaaagtaggagggagaagtcaaagctcaagtaaagagatttttaacctagagaggctgagttatcaaggaagaaagaaggccaagccagcttgttgcagaatgttccagaagataagataatgatagacttaaataaatagggactgatcaaggtgatagcgagttcttggtgaaattgcttccaaggattttatagaagtgtatttcatggaaatgtacagtaaccggatgactgtattaaaattttaaaactgctgggtgtggtggctcatgcatataattccaacactttgggaggccaaggcgggtggatcacatgaggccaggagttcgagaccagcctgaccaacatggtaaaaccctgtctctattaaaaatacaaaaattagcagggtgtggtggtgtgtgcctgtaatcccagctacctgggaggctgaggcaggagaatcacctgaacctgagaggttgcagtgagccaagattgcgccactgcactccagtctgactccgtctcaaataaaacaaaataaaataaaaatctaaaactgacttaggcagttaagtgtgtttccaaagaacgtaattggtgggaggcagagcgggcccgaattgccacctcttcccggcacggccagtgctcttcctcccactcccggccacctccgcaggcccctgcccgtgccaggactgggtgaagctgtgaatgtgcttctccacttgggggtgcgggacaatgctggggccctgggctgggtttctgccctaggaagcctcactgttgagtcaggggctgctggagctgagttttgtcttcagtggcttatgaaggaaagatgaagcta

SEQ ID NO: 2066 - DNA, 11801 bp, Homo sapiens
agagtgactcccttggggaatccagccctttcaccagcaaagaaaatgggcaccacctagtgctttttcaacgcaaaggctgtttgtgctcatgtggacaagagtgggcatgcgttggctgacctttacaaaggaaaaaaaaaaaaggagtcaggtggctttaacccctatgccaactgaaagaagaagcaagtgacaatcttaagacaaaggaattcagtgcttccaaattatagatttctttggtttttttttttttataattattggtctgttcatgagaaataacatctttacttaccaagacactaatttcctctgtatcacctttttgcctcctcatgtcctctgaggttaatttgtaagaatttctaagaattttcatttggtccaaagtgacatagcagaaccagcgctggcccacccccacccccaaaatctattctaacaagcagtctctctggagttctcctaacacaacaaatagcttttatgaaaaatgatgtgtagcacaaaatcttttgcagtgcaataagatcaagttaaccactcatgcctctaggaaaaagcctaggaagttttatctgattggcaaaatggacccagatatgagttcaaggattgagtacagtttgatgaaatttcatagcaatgaagtctgattatctgaatgattgcttaagccttttaaaacataactcgaggaagcactagatttttcattgggaaaacagatggtcttgtagggaatcgtagaaccaccatctcatgctgtttactttttctgtaatactttgcctagaattactctcaccactattgctttttaaaaataataatgatttcttcattgctaaaaggtagatctttctgcaataaaattagaaatcttagtggagggcaaggtgaagggcagaaatgggaaaaatgagtaacctgctatacctaactggattaacaaggacctgtaacatatccaggaactaactggctggctctgaactcattagggatctgcttatctgttatgctgtacaacagaatccagacaaaaaacagactgtgaagaaacggattaaaaatgattgtaacttctctaagagttcagtatctgtgctaagcaactttgtagaaggactgaagaaaacaaagcccaagattctgaacttcactccactgcctatccccaagttctgccgttataagatcgcaataacgctacttagatatagaactttgcaactgttttatgaactaacctaaaaagtcaaacgcactctcatctcttggtcattttattgctgtaatttatgatattaaataagtgatttgtttaaaataaattttaaaatttataccaaggaggaaaaataatcttaaaatgggtttgttctatgaggagcaagaaaaaaaaaatgtgtagtgaactgatctctttgagatttcactggcacaaaatatatccctttaagcttaacactaaataggtgatcttgtcttgacagatttaagatgaacatgaattgattagctgaagccatcaggtgtggctgagcctgtctttttccaaatatgtacctacaggataatggaaggaggtagctgttgtcatcacctttttaagtgaaagcagtgttatgttttgtattcaagtcgaattccccaactcttcatatcaccaccattctggtcagcctgttaagggaagaaaaacaacaacaacattttctttttttcttccctgcccacccagccccccttttccactgcctgccttgccctgaatgctatagttcacagcgaaaccctctggtaatgacagccctgaagtgataatgtactttcctgccttcctgttaacggtagcataatcccgccatgtgtgccagccccgtggcagaaggatgcgttcatattttctggaggtaaaagggaccggttcaatttacaggcttgactacctcagcagtttcactaagttctggtacataaatggatgttttattaaagaagaaaaggaagggggaagggaaggaggaggaagacgaagaagaagaaaagaagagaaggaaaggaggtgggaaggagaattcgtctttttctgctcaatattatgtcagtgaaaccaaataatgtgtctcggttcctccccctgagcattccacccgggtaaaaaaggaactaagctcacctctgctgagagaagctgtgcatggcgagtggcccccacacacctggctggatgacatctgagggctcggaggtccctgctgctcagtgtgccaggatggtcccaccgtcctcacattcacattttttatggatgatgcgtcattctgctaaggcaacaaaagtgaaaacaatcaatagttctacccaaatacctgttattttaagaatggggccagagtgatttcttggctatgagcagctcaggagacactatttttcgttgtttaaatacaattgattttccttgcttcagaacccagatcactcacggagctcctggtgtgtcgagcttggatgaatttgtaatatgacacagtgatacctgtttgtttaaggacaccttgtgtgtaatgtcagtgttgcattactctgtggttccaaaacttcaagtccacactggagaaggtgggggcagcctgtggacagaggcaggaaagaagggacattgttttgagtgcctgttagcttgtaggcacagttccatgctcttttctgtaaaacaggccaatgatattggaagccaagtttgtctggctatggagcccctgtttctccactctaccaataatcaaaactcacagtgagaggttaaaccaatacatgcacacattaccaaaacaaggtttcacaaacaatatttacctttacacaggcaatttactcttattttaccagtcctactccataataattcaattctttaaaattatggttgcaaccccactaaattggcctcataatctaccattgtaacatggcccactgtttgatacacactggagtacaccttggtacccttcacatttttaaatgatgctatattggacttggtatccatgtgatgatcaagattgtatttgaagatgttgcatagaaagtcccatcctatgattcagttttttcatctaagaattagaaattataacatttattccccaaaattctccagttgaattcactggaggtattcattgcctctcagagagtctgttacttaaaataaagacaattaaaattaagatagcaagtattttagcaacaaaagccacaaaaaagaataataattataattgctattgttagtaataattgttgaactcacaacctgccggccactgctctatgagctttcaatataactcattcagttctcactatcactttatgaagtaggtaaatattactttcactttacagccagaattcctttatcttctttctcataaatttctcattctaaactgttaatatacatctcagaaaatgaatgagattgtgactatgactcaagaaatacgtatttctatgcttggtttaaataaaatacaaaagcctgtatcatctaattggcttgataaatctcactagctttttaataatcatgaaatttaaatttttttgtagaaaactttcagaatacttaatgaaaaatcagtatgtattcaccttcaaaaaacacaaatttccaggcataataataatatctgcaagtccaaatgtaatcacggtgccagggctggttgattcagcagcttatcactgtcactggggactcagattctctccacctttccactctcccatccctcatcagctttgtcctatgagggctgcacagatccaggtgtcacatccagcatcatagtgacaagaacaaaggtctctttctcaggagtctactaagtgtcccttaaatcctgattagcaaatttcctttgctaaaaatgagttatatgccaattcctaaactagtcactgttagggtgtagaatcactgtgattggattagaaaagctctgcctcctggaactaggaatgatgttgtttgccctgaagcacatggatctgtggtcaggaagaggggtcttgcgggaaatatatatactgagtaagcagtgtctgatacaaagacgaaaaatatttcttttgacaggaagatttggtaaaatataaagtagtagaattatttcccattatttaatctgtttaatgtttcataaaaattagcaaacgtaatgaggaaacgtatctgtaagaatccactatgcatttgctgtttgctctgaaatcaacaggacccagtgctttcattactagaaagaagaaaattaggtaggttaataaaacaaacatctggaaagtatcaacactcataaaaataaatggaatcatcctgtgtatacactaaagccaggttggcatttgtcaacaactacagagaaaacactacagaatttactacttccaacttcctgggtgggtttgttctcattcatttaacatattttcctaagtgaaaatttagttttaggttttgaaatacaatcatataagaatatgtagactaatagtgtttattaatttttaataatgcctacagtttcccatatttggttgcatttttcctgctatcctattgcttctgagccacctgttcccctctcaaaaacatgcaagctgggatttttttcttttcttttaactagatatcttgccaaaatttcagactcatagtaaagagtttttatttttcaccaacctaattattaaaaaaggagtatttagaatagctctaagaattctcatacagccttcatcctcattccccaaatgttaacattttactacatttgctgtatctatctctttgtgtgtatatgcacagacatacacagaatgtctatgccttatatacacatgtatatctctgtgtatatatgtatgtatatatgcacatatttttaatagattctgagttttctaatcctttgagaataagttacagtcatgaaacccctttatttttaaatacttgtgtatctttctaataaagaagaaattccccaatgaaacaacaaaagattaccaaaatcagaaaactagcattgctataatactcttatctaatttatagactttattcagatttcaatactatttttatggtcaaaaaaaatcaaatgtcatgggtcatgccctgaattcagctgtcatttctctttagtcttctttattctgacagtcctttagtgttttcctggcagaatgctgttaatatcagtcttcagtaaaacatattaagagaggaaacatcatgccaaagccagtggatttgtatggatggtggcttgagtgggattcgtcctgcctttgcagccttcctcctgcagggataataggtgtgagtatgtttcactattctcttagacatcctgacctgtaccacaaatgtgaagggccaactggagaactaggtgatccaacagtttgttattaatcatctcatctcttgccaatgaatagcaacaagaacatcccaaaacatctgaaatatttctaaatattctaaacatttgtaaaaatgtgggacattatagaaaaaaacttacaaaaacatttgtttcaatcactgcatgcttagatgcaatctttaaaagtacttcaagtaaataattagaatggggatgtttagaattggttaaaggttcattatttctgaaccaatgtgcagaatttggcttatgagtacaagaataaagacatttggatcaattctcttatctttttattaatatttaaattagcctacaaaaaatccacatatataaaagtcctctaaagcctgagaagctcatttgcttttacgtaggacatattgatggttttaattttttaatctctcagactgcatctgtatagcaacaagcggatactttagcaaggaataaattgttccaaaaaggtatgggcaagtgtgtcttacaactttttttttttttctgaaagatctcagtaaaatattttctgatatgttttcaaaccaatgtattctatcacatgaaagagaagttacctgacaacgtggttatttgcagttatgttataaccaaatttgtaactgactctccctcctccagtcttatgaaaaagaaggaagaaattatagcctggaagagaatattcccaaatggggcgagctagggcatctaaatctatagctggagctacaaaacacttcgcttcattcaagaaacgttttcttgagttgattttttatgtacctatcttaaaaataaggtagtgctcctggagtaagattaatagcagcagacccttacttaacctattttcagtagtgaaaacagattataaacccctttttttccactacagagttataaatacaacagcagtgcagaaatcatttgttcattgagttcaactcaagattatactcaagtctgattgcaaaagcccattcatatggaagaagagacaaaaggctaacaactctctgggaagagcatcaaaggctcaatgtttacaagaagaaattgaggggaagattggagaataattttctctgggggaatgatggcagcttaggggtcttttgtagagaaagttctttgctaggattaaaggcaggattattggtggataattgaaaaatgaaatggagaacctcttaaaatggcaatgtatttggaatatccagggagttcttgaaatgtgaattctaaggaaatgggtagtacttaagaagaaaagattaactcaaactcactatttcaagtgataaaactgcaagtgaatcacaaagggatggagctgccaatgcctgcagaggaaaaccaaaagaccaataacacagtgacttgggtcagcttttaagtcaaggcaccaattcaagaaaatcctaatgaggaagaaatcaatctgctctgcagatcatgttatggctatataatggctaaagaacaacagtaactagaacctgaattagtgttatattgctcattttatctaatttcacaaagttattgttaccttaaatcatacatttatcagaactgttttatgtaaaataatatttgaggttgactcctcatagtaaaattaaatgcttctaaatttaatgtatgtgaaacaggatgtgctatgggctgaatgtttgggtctctctcaaattcatatgttaaaatcctaacctccaaatcaatgctagtaagaggcagggccctagggaggtagttaggtcacaaggtgcagcccttatgaatgggattaatgcctctataagaagagaaacaagagagattttttctttctctgccatgtaaggatacaatgagaagtcagccatctgtaaaccaggaaggggaccctcaccaagaacatcaccatgctggcaccctgaactcaaacttccagcctccagaactgtgagaaataaatgtaataactatttgttgtttaatacatccaatctatagtagtctgttacagtagccaaaactgattaagacaaaaagtttcatttgaaagcaataactaacgtataattctgaacttgacattcactattgctaaggttacattggtttcccgactgctaaaaaaaaataaaaatcagatagctcatctgagaagacacacagacggaaatcaagcacatgaaaaatatgcttagcatcactggtcattagaaaaatgtaaattaaaactacaatgagttgccactacacaaatatcagaatgaccaaaataaacacattttttaaaatttaaatgacaatattaagtgttggaaaagatacagagcaactgcaactctcagatattgctgatatgaatcgaaaatggtacagacactttggaaatcagtttgacaagttcttataaaattaaatatatactgggcatggtggagtgtgcccgtagtcccagatcttgggaggctaaggcaggaggatagctggatcccaagagttcaaggctgcagtgagctatgatcatgctactgcagtctagcctaagtgacagagtaagatgctgtctcaaaaaaaaaaaaaaaagaaaaaattaaacatatacttaccatgcagctcagcaattccattcctaagtatttacccaagtgaaatttaaaaaccacccaaatattccttagctgaggaacagataaactagtacgttcataaaatggaatactgtttaatatattcataaaatggaatactgttcagcaatataaaagaatgaactattgatacatgcaaccacatgggatgaatttcaaatgcattacatggaatgaaaaaagctagactcaaacagatgcatatgaaaatattctatttagatgacattctggaaaatgcgaaactatagttttggaaagatctatggttgccagggattaagagtgtagaaaggggccaagttcagtggttcacacctctaatcccagcactttgggaagctgaggccagaggatcacttgggcccaggagttcaagaccagcttgggcaacatggcaagacgccccatctctacaaaaaattaatttaaaaaaatagcatggtgacatgcacctgtagtcccagctgtcaggcctctgagcccaagctaagccatcatatcccctgtgacctgcacgcacacatccagatggccggttcctgccttaattgatgacattccaccacaaaagaaatgaaaatggcctgttcctgccttaactgatgacattgtcttgtgacattccttctcctggctcatcctggctcaaaagctcccccactgagtaccttgtgacccccactcctgcctgccagagaacaacccccctttttcctttacctacccaaatcctataaaacggccccacccctatctcccttcactgactctttttggactcagcccacctgcacccaggtgattaaaagctttattgctcacacaaagcctgtttggtggtctcttcgcacagaagtgcatgaaatttggtgctgtgactgggatcgggggacctcccttgggagatcaatcctctgtcctcctgctctttgctccatgagaaaggtccacctacgacctcaggtcctcagaccgaccagcccaagaaacatctcatcaatttcaaatccggtaagcagcctctttttactctcttctccaacctccctcactatccctcaacctctttctcctttcaatcttggtgccacacttcaatctcccccttctcctaacttcaattcctttcattttctggtagagacaaaggagacacgttttatctgtggacccaaaactccggcgccagtcacggactagggaaggcagccttccctttgtgtttaatcatttcagggacacctctctgattattcacccaggtttcacaggtgtcagaccacgcagggatgcctgccttagtccttcacccttagtggcaagtgccgcttttctagaggaggggcaaatatcccaatccattctctccatatctctaccccttctctgcttttctggaggaggggcaagaacccctcaaccccttctccttcacccttagtggcaagtccagcttttctagcgggcaagaacccccaatcccttatttccgcaccccgacctcttatctctgcaccccaatcccttatttccatacctgacctcttatctctgcaccccaatcccttatttccatgccccaacctcttatctctgcaccccaatcccttatttccacaccccgacctatctctgcaccccaatcccttatttccacgccctgacctcttatctctgtgccccaaccccttatttccacaccccgacccctttcccacttttctggaatttaagaacccccgaaccccttccttctatgtctctactctcttttctctaggcttgcttccttcactataggcaaccttccaccctccattcctcctcctcctcccttagcctgtgttctcaagaacttaaaacctcttcaactcacacctgacctaaaacctaaatgccttattttcttctacaatgctgcttgaccctatacaaactcgacaggagttccaaatagccagaaaacagcacttccattttttccatcctacaagatctaaataaatcttgtcgtaaaataggcaaatggtctgaggtgcctgacgtccaggcactcttttacacatcagtccctctgtagtctctgttctcaatgcaactcctcccaaatcttccttctttccctcctgcctgtcccctcagtcccaaccccaagcatcgctgagtctttctaatcttctttttctacagacccatctgacctctcccctcctcgccaggccaagctaggtcccaattcttcctcagcctctgctcctccaccctataatccttttatcacctcccctcctcacacctggtcctgcttacagtttcgtgctgtgactagccctcccccacctgcccagcaatttactcttaaaaaggtggctggagccaaaggcatagtcaaggttaatactcctttttctttatcccaaatcagatagcgtttaggctttttcatcaaatataaaaatccagcccagttcatggctcattcggcagcaaccctgagatgctttacagccctagaccctaaaaagtcaaaaggccgtcttattctcaatatacattttattacccaatatgctcctgacattaaataaaactccaaaaattaaattctggccctcaaaccccacaacaggacttaattaacctcgccttcaaggtgtacaataatagaggcagccaagtagcaacatatttctgagttgcaattccttgcctccactgtgagacaaaccccagccacatctccagcacacaagaacttccaaacgcctaaaccgcagcggccaggcgttcctccagaaccaccttccccaggagcttgctacaagtgccagaaatctggccaccaggccaaggaatgcccacagcccaggattcctcctaagccgtgtcccatctgtgcaggaccccactggaaatcggactgttcaactcacctggcagccactcccagagcccctggaactctggcccaaggctctctgactgactccttcccagatcttctcggcttagcggctgaagaccgacgctgccggatcgtctcggaagccccgtagaccatcacggacgccgagctttaagtaactctcacagtggacggaagctgaataatgccctccaaaccataaagatgtccataacctaatttccagaatctacaaatgtgctttgttacatggcaagggaaaattaaggctgcagatcaaattaatgttgctaatcagccaaccttataataagattatcctaaatgatctgggtgagcccagtagaatctcaagggtccttataagcggaaatgaaatagcagtgtgagacagatttggcctaatgttgttggcttcaaagatggaagaatggagccatgacccaaggaatgcaggaagcctctagatgctgcaaaaggcatggaacaaattctcccctacagcctcagggggaatgcagccctgccaacctcttgattttagcccagtgagacccatgttggactcctttcctccaaagctgtaagataataaattgtgttgttttaagacactacgtttatggtgatttgttacaggagcaagaggaatctaatacacatccacatagaacaacacaaagtgtcatgactagaggcactgcctgtggtgaccca

SEQ ID NO: 2067 - DNA, 19092 bp, Homo sapiens
gcaattctctcctattcttgattcttctgttttaggcaacatattgaatctcttgggagaaactcatcctgtatctgctcgattgaaaacatgaaggtgcacattccaagctgcatatgctcagactctgcaaagttggcctctgaaaagttggtaccaagttacataaccatcaaaaatgatatttagtggctgagggtgagacacacaactgtgattctaacaagaatatgacactggagaggatatctatgagatgactggcagactccacaccaatgatcctgacagctcacctctgctgagagaagctgtgcatggcgagtggcccccacacacctggctggatgacatctgagggctcggaggtccctgctgctcagtgtgccaggatggtcccaccgtcctcacattcacattttttatggatgatgcgtcattctgctaaggcaacaaaagtgaaaacaatcaatagttctacccaaatacctgttattttaagaatggggccagagtgatttcttggctatgagcagctcaggagacactatttttcgttgtttaaatacaattgattttccttgcttcagaacccagatcactcacggagctcctggtgtgtcgagcttggatgaatttgtaatatgacacagtgatacctgtttgtttaaggacaccttgtgtgtaatgtcagtgttgcattactctgtggttccaaaacttcaagtccacactggagaaggtgggggcagcctgtggacagaggcaggaaagaagggacattgttttgagtgcctgttagcttgtaggcacagttccatgctcttttctgtaaaacaggccaatgatattggaagccaagtttgtctggctatggagcccctgtttctccactctaccaataatcaaaactcacagtgagaggttaaaccaatacatgcacacattaccaaaacaaggtttcacaaacaatatttacctttacacaggcaatttactcttattttaccagtcctactccataataattcaattctttaaaattatggttgcaaccccactaaattggcctcataatctaccattgtaacatggcccactgtttgatacacactggagtacaccttggtacccttcacatttttaaatgatgctatattggacttggtatccatgtgatgatcaagattgtatttgaagatgttgcatagaaagtcccatcctatgattcagttttttcatctaagaattagaaattataacatttattccccaaaattctccagttgaattcactggaggtattcattgcctctcagagagtctgttacttaaaataaagacaattaaaattaagatagcaagtattttagcaacaaaagccacaaaaaagaataataattataattgctattgttagtaataattgttgaactcacaacctgccggccactgctctatgagctttcaatataactcattcagttctcactatcactttatgaagtaggtaaatattactttcactttacagccagaattcctttatcttctttctcataaatttctcattctaaactgttaatatacatctcagaaaatgaatgagattgtgactatgactcaagaaatacgtatttctatgcttggtttaaataaaatacaaaagcctgtatcatctaattggcttgataaatctcactagctttttaataatcatgaaatttaaatttttttgtagaaaactttcagaatacttaatgaaaaatcagtatgtattcaccttcaaaaaacacaaatttccaggcataataataatatctgcaagtccaaatgtaatcacggtgccagggctggttgattcagcagcttatcactgtcactggggactcagattctctccacctttccactctcccatccctcatcagctttgtcctatgagggctgcacagatccaggtgtcacatccagcatcatagtgacaagaacaaaggtctctttctcaggagtctactaagtgtcccttaaatcctgattagcaaatttcctttgctaaaaatgagttatatgccaattcctaaactagtcactgttagggtgtagaatcactgtgattggattagaaaagctctgcctcctggaactaggaatgatgttgtttgccctgaagcacatggatctgtggtcaggaagaggggtcttgcgggaaatatatatactgagtaagcagtgtctgatacaaagacgaaaaatatttcttttgacaggaagatttggtaaaatataaagtagtagaattatttcccattatttaatctgtttaatgtttcataaaaattagcaaacgtaatgaggaaacgtatctgtaagaatccactatgcatttgctgtttgctctgaaatcaacaggacccagtgctttcattactagaaagaagaaaattaggtaggttaataaaacaaacatctggaaagtatcaacactcataaaaataaatggaatcatcctgtgtatacactaaagccaggttggcatttgtcaacaactacagagaaaacactacagaatttactacttccaacttcctgggtgggtttgttctcattcatttaacatattttcctaagtgaaaatttagttttaggttttgaaatacaatcatataagaatatgtagactaatagtgtttattaatttttaataatgcctacagtttcccatatttggttgcatttttcctgctatcctattgcttctgagccacctgttcccctctcaaaaacatgcaagctgggatttttttcttttcttttaactagatatcttgccaaaatttcagactcatagtaaagagtttttatttttcaccaacctaattattaaaaaaggagtatttagaatagctctaagaattctcatacagccttcatcctcattccccaaatgttaacattttactacatttgctgtatctatctctttgtgtgtatatgcacagacatacacagaatgtctatgccttatatacacatgtatatctctgtgtatatatgtatgtatatatgcacatatttttaatagattctgagttttctaatcctttgagaataagttacagtcatgaaacccctttatttttaaatacttgtgtatctttctaataaagaagaaattccccaatgaaacaacaaaagattaccaaaatcagaaaactagcattgctataatactcttatctaatttatagactttattcagatttcaatactatttttatggtcaaaaaaaatcaaatgtcatgggtcatgccctgaattcagctgtcatttctctttagtcttctttattctgacagtcctttagtgttttcctggcagaatgctgttaatatcagtcttcagtaaaacatattaagagaggaaacatcatgccaaagccagtggatttgtatggatggtggcttgagtgggattcgtcctgcctttgcagccttcctcctgcagggataataggtgtgagtatgtttcactattctcttagacatcctgacctgtaccacaaatgtgaagggccaactggagaactaggtgatccaacagtttgttattaatcatctcatctcttgccaatgaatagcaacaagaacatcccaaaacatctgaaatatttctaaatattctaaacatttgtaaaaatgtgggacattatagaaaaaaacttacaaaaacatttgtttcaatcactgcatgcttagatgcaatctttaaaagtacttcaagtaaataattagaatggggatgtttagaattggttaaaggttcattatttctgaaccaatgtgcagaatttggcttatgagtacaagaataaagacatttggatcaattctcttatctttttattaatatttaaattagcctacaaaaaatccacatatataaaagtcctctaaagcctgagaagctcatttgcttttacgtaggacatattgatggttttaattttttaatctctcagactgcatctgtatagcaacaagcggatactttagcaaggaataaattgttccaaaaaggtatgggcaagtgtgtcttacaactttttttttttttctgaaagatctcagtaaaatattttctgatatgttttcaaaccaatgtattctatcacatgaaagagaagttacctgacaacgtggttatttgcagttatgttataaccaaatttgtaactgactctccctcctccagtcttatgaaaaagaaggaagaaattatagcctggaagagaatattcccaaatggggcgagctagggcatctaaatctatagctggagctacaaaacacttcgcttcattcaagaaacgttttcttgagttgattttttatgtacctatcttaaaaataaggtagtgctcctggagtaagattaatagcagcagacccttacttaacctattttcagtagtgaaaacagattataaacccctttttttccactacagagttataaatacaacagcagtgcagaaatcatttgttcattgagttcaactcaagattatactcaagtctgattgcaaaagcccattcatatggaagaagagacaaaaggctaacaactctctgggaagagcatcaaaggctcaatgtttacaagaagaaattgaggggaagattggagaataattttctctgggggaatgatggcagcttaggggtcttttgtagagaaagttctttgctaggattaaaggcaggattattggtggataattgaaaaatgaaatggagaacctcttaaaatggcaatgtatttggaatatccagggagttcttgaaatgtgaattctaaggaaatgggtagtacttaagaagaaaagattaactcaaactcactatttcaagtgataaaactgcaagtgaatcacaaagggatggagctgccaatgcctgcagaggaaaaccaaaagaccaataacacagtgacttgggtcagcttttaagtcaaggcaccaattcaagaaaatcctaatgaggaagaaatcaatctgctctgcagatcatgttatggctatataatggctaaagaacaacagtaactagaacctgaattagtgttatattgctcattttatctaatttcacaaagttattgttaccttaaatcatacatttatcagaactgttttatgtaaaataatatttgaggttgactcctcatagtaaaattaaatgcttctaaatttaatgtatgtgaaacaggatgtgctatgggctgaatgtttgggtctctctcaaattcatatgttaaaatcctaacctccaaatcaatgctagtaagaggcagggccctagggaggtagttaggtcacaaggtgcagcccttatgaatgggattaatgcctctataagaagagaaacaagagagattttttctttctctgccatgtaaggatacaatgagaagtcagccatctgtaaaccaggaaggggaccctcaccaagaacatcaccatgctggcaccctgaactcaaacttccagcctccagaactgtgagaaataaatgtaataactatttgttgtttaatacatccaatctatagtagtctgttacagtagccaaaactgattaagacaaaaagtttcatttgaaagcaataactaacgtataattctgaacttgacattcactattgctaaggttacattggtttcccgactgctaaaaaaaaataaaaatcagatagctcatctgagaagacacacagacggaaatcaagcacatgaaaaatatgcttagcatcactggtcattagaaaaatgtaaattaaaactacaatgagttgccactacacaaatatcagaatgaccaaaataaacacattttttaaaatttaaatgacaatattaagtgttggaaaagatacagagcaactgcaactctcagatattgctgatatgaatcgaaaatggtacagacactttggaaatcagtttgacaagttcttataaaattaaatatatactgggcatggtggagtgtgcccgtagtcccagatcttgggaggctaaggcaggaggatagctggatcccaagagttcaaggctgcagtgagctatgatcatgctactgcagtctagcctaagtgacagagtaagatgctgtctcaaaaaaaaaaaaaaaagaaaaaattaaacatatacttaccatgcagctcagcaattccattcctaagtatttacccaagtgaaatttaaaaaccacccaaatattccttagctgaggaacagataaactagtacgttcataaaatggaatactgtttaatatattcataaaatggaatactgttcagcaatataaaagaatgaactattgatacatgcaaccacatgggatgaatttcaaatgcattacatggaatgaaaaaagctagactcaaacagatgcatatgaaaatattctatttagatgacattctggaaaatgcgaaactatagttttggaaagatctatggttgccagggattaagagtgtagaaaggggccaagttcagtggttcacacctctaatcccagcactttgggaagctgaggccagaggatcacttgggcccaggagttcaagaccagcttgggcaacatggcaagacgccccatctctacaaaaaattaatttaaaaaaatagcatggtgacatgcacctgtagtcccagctgtcaggcctctgagcccaagctaagccatcatatcccctgtgacctgcacgcacacatccagatggccggttcctgccttaattgatgacattccaccacaaaagaaatgaaaatggcctgttcctgccttaactgatgacattgtcttgtgacattccttctcctggctcatcctggctcaaaagctcccccactgagtaccttgtgacccccactcctgcctgccagagaacaacccccctttttcctttacctacccaaatcctataaaacggccccacccctatctcccttcactgactctttttggactcagcccacctgcacccaggtgattaaaagctttattgctcacacaaagcctgtttggtggtctcttcgcacagaagtgcatgaaatttggtgctgtgactgggatcgggggacctcccttgggagatcaatcctctgtcctcctgctctttgctccatgagaaaggtccacctacgacctcaggtcctcagaccgaccagcccaagaaacatctcatcaatttcaaatccggtaagcagcctctttttactctcttctccaacctccctcactatccctcaacctctttctcctttcaatcttggtgccacacttcaatctcccccttctcctaacttcaattcctttcattttctggtagagacaaaggagacacgttttatctgtggacccaaaactccggcgccagtcacggactagggaaggcagccttccctttgtgtttaatcatttcagggacacctctctgattattcacccaggtttcacaggtgtcagaccacgcagggatgcctgccttagtccttcacccttagtggcaagtgccgcttttctagaggaggggcaaatatcccaatccattctctccatatctctaccccttctctgcttttctggaggaggggcaagaacccctcaaccccttctccttcacccttagtggcaagtccagcttttctagcgggcaagaacccccaatcccttatttccgcaccccgacctcttatctctgcaccccaatcccttatttccatacctgacctcttatctctgcaccccaatcccttatttccatgccccaacctcttatctctgcaccccaatcccttatttccacaccccgacctatctctgcaccccaatcccttatttccacgccctgacctcttatctctgtgccccaaccccttatttccacaccccgacccctttcccacttttctggaatttaagaacccccgaaccccttccttctatgtctctactctcttttctctaggcttgcttccttcactataggcaaccttccaccctccattcctcctcctcctcccttagcctgtgttctcaagaacttaaaacctcttcaactcacacctgacctaaaacctaaatgccttattttcttctacaatgctgcttgaccctatacaaactcgacaggagttccaaatagccagaaaacagcacttccattttttccatcctacaagatctaaataaatcttgtcgtaaaataggcaaatggtctgaggtgcctgacgtccaggcactcttttacacatcagtccctctgtagtctctgttctcaatgcaactcctcccaaatcttccttctttccctcctgcctgtcccctcagtcccaaccccaagcatcgctgagtctttctaatcttctttttctacagacccatctgacctctcccctcctcgccaggccaagctaggtcccaattcttcctcagcctctgctcctccaccctataatccttttatcacctcccctcctcacacctggtcctgcttacagtttcgtgctgtgactagccctcccccacctgcccagcaatttactcttaaaaaggtggctggagccaaaggcatagtcaaggttaatactcctttttctttatcccaaatcagatagcgtttaggctttttcatcaaatataaaaatccagcccagttcatggctcattcggcagcaaccctgagatgctttacagccctagaccctaaaaagtcaaaaggccgtcttattctcaatatacattttattacccaatatgctcctgacattaaataaaactccaaaaattaaattctggccctcaaaccccacaacaggacttaattaacctcgccttcaaggtgtacaataatagaggcagccaagtagcaacatatttctgagttgcaattccttgcctccactgtgagacaaaccccagccacatctccagcacacaagaacttccaaacgcctaaaccgcagcggccaggcgttcctccagaaccaccttccccaggagcttgctacaagtgccagaaatctggccaccaggccaaggaatgcccacagcccaggattcctcctaagccgtgtcccatctgtgcaggaccccactggaaatcggactgttcaactcacctggcagccactcccagagcccctggaactctggcccaaggctctctgactgactccttcccagatcttctcggcttagcggctgaagaccgacgctgccggatcgtctcggaagccccgtagaccatcacggacgccgagctttaagtaactctcacagtggacggtaagtccgtccccttcttaatcaatacggaggctacccactccacattaccctcttttcaagggcctgtttcccttgcctccataactgttgtaggtattgacagccaggcttctaaacctcttaaaactccccaactctggtgccaacttagacaacactcttttatgcactccttttagttatccccacctgcccagtttccttattaggccgagacactttaactaaattatctgcttccctgactattcctggactacagctacatctcattgcctcccttcttcccaatccaaagcctccttcatgtcctcctcttgtattccccaaccttaacccacaagtataagatacctctactccctccttggcgaccgatcatgcaccccttaccatctcattaaaacctaatcagccttatcccgctcaatgccaatatcccatcccacagcatgctttgaaaggattaaagcctgttatcactggcttgctacagcatggccttttaaagcccataaactctccttacaattcccccattttacctgtcctaaaaccagacaagccttacaagttagttcaggatctgcgccttatcaaccaaattgttttgcctatccaccccatggtgccaaacccgtatactctcctatcctcaatacctccctccacaatctgttattctgttctggatctcaaacatgcttgctttactattgctttgcacccttcatctcaccctttcttcgctttcacttggactgaccctgacacccatcaggctcagcaaattacctgggctgtactgccgtaaagcttcacagacagcccccattacttcagtcaagcccaaatttcttcctcatctgttatctatctcagcataattctcataaaaacacacgtgctctccctgccaattgtgtccaattaatctgtcaaaccccaaccccttctacaaaacaacaactcctttccttcctgggcatagttagatactttcacctttagatacctggttttgccatcctaacaaaaccatcatataaactcacaaaaagaaacctagctgaccccatagatcctaaatcctttccccactcctctttccattccttgaagacagctttagaggctgcccccactctagctctccctgactcatcccaacccttttcattagatacagctgaagtgcaaggctgtgcagtcagaattcttacacaaggaccaggatcacgtcctgtagcctttttgtccaaacaacttgaccttcctgttttaagctggccattatgtctccgtgcagtggcggctgctgccctaatacttttagaggcccttaaaatcacaaactatgctcaactcactctctgcagctctcataatttccaaaatctattttcttcctcacacctgaagcatatactttctgctccccggctccttcagctgtactcactctttgttgagtctcccacaattaccattgttcctggcctggacttcaatccggcctcccacattattcctgataccacacctgaccctcatgactgtatctctctgatccacctgacgttcaccccatttccccacatttccttcttccctgtttctcaccctgatcacacttagtttattgacggcagttccaccaggcctaatcaccacacaccagcaaaagcaggctatgctatagtacaagccactagcctgcctcttaaaacctctcatttcctttccatcgtagaaatctatcctcaaggaaataacttctcaatgttccatctgctattctactactcctcagggattattcaggccccctcccttccctacacatcaagcttagggatttgcccccgcccagaactggcaaattagctttactcaacatgccccgagtcaggaaactaaaatacctcttagtctaagtagacactttcactagataagtagagatctttccttcagggtctgagaaggccaccgcagtcatttcttcccttctgtcagacgtaattcctcagtttagccttcccacctctatacagtctgataacagaccagcctttattagtcaaatcagccaagcagtttttcaggctcttagtattcagtgaaacctttatatcccttacagtcctcagtcttcaagaaaagtagaacagactaaaggtcttttaaaaacacacttcaccaagctcagccaccaacttaaaaaagaatagacaatacttttaccactttccctttcagaagtcaggcctgtcctcagaatgctacaaagtacagctcatttaagctcctgtatagatgctcctttttattaggccccagtctcattccagacaccagaccaacttggactgtgccgcaaaaaacttgtcatccctactgtcttctgtctagtcatactcctattcaccattctcaactactcatacatgccctgctcttgtttacattgccggtttacactgtttctccaagctatcacagctgatatctcctggtgctatccccaaaccgtcactcttaactgttaaagtaaataaataagctttgctggtaaggctatgctgaacctccttaggcattctctaattagatgtcctaagtcctcccagttcttagtccttttttttttattattattattatactttaagttttagggtacatgtgcacctgtttttctccttctcttattctgtttagtttttcaattcatacaaaactgtatccaggccatcaccaataattctaaatgacaaatgtttcttctaacaaccccacaatatcaccccttaccacaaaatcttccttcagcttaatctctcccactctaggttcccacgccgcccctagtcccgcttgaagcagcccggagaaacatcgcccattatctctccataccacccccaaaaattttcgccatcccaacactttaccactgttttgttttattttataaataaattaattattaagaatatatatttattttataaataaattaattattaatataagaagacaggaatgccaggcctctgagcccaagctaagccatcatatcccctgtgacctgcacatacacatccagatggccggttcctgccttaactgatgacattccaccacaaaagaagtgaaaatggcctgttcctgccttaactgtgacattgtcttgtgaaattccttctcctggctcatcctggctcaaaagctcccctactgagtaccttgtgacccccactcctgcctgccagagaacaacccccctttttcctttacctacccaaatcctataaaatggccccacccctatctcccttcgctgactctcttttcagactcagcccgcctgcacccaggtgattaaaagctttattgctcacacaaagcctgtttggtggtctcttcacatggacgtgtgtgaaaccagctacttgggaagtggaggcaggaggatcgcttgtgtctaggaggtcaaagctgcactgagttatgacggcatcactgcactccagcctagcatccttaagagtaagcactattattatcatcattttacaaatgaggaaactgaagcacagaaatgtcaagtggctttcccaaggtcataccgcaagtaagtcacagaatcagtatttggatctaggaagagagccttcagagtccttgttttaattatttgctctaccaagaagaaaaagaagagagaaaaaaagaaaataaagaatacagacaggcaggttaatgagagaaaaagataaataatgaagaacaaaaagcaaggagcaatattctgaagagttacagacatgatggaataaacagcaagttgtcaaaaggagctgcaaatgcccatgtatgccctttcaggagcgctagactatctgcatgagacagagagtaaatcctgatgccatcactcaaactagacctacaagtgcctcgagttcttacagatccccatctttctgggcaaaacatccatccttcaaatcattccacaggttaaagaacaaatgtcaggttacactcttgaatagtacagtcctattttctcccataaatgcctgcataggacgtcttcttcatatggaccctaaaatatttctacaagtagtagacattttttagaactgcaataaagtaatgtaataaatgcattgtttgaattttttcctgttttatatatgatacctgagattagaattgtgtcccttttatataaaattgggcagttttattttgtgccatttcaaaggtattgttctatatcactgtagtttcagatgtttattttttattatttcaaagtcaaaacatgaagaagtaagatgtatgtttctgtatgcctttaaaaatgcaaacctgcaacattaatgggaactttccccaggacacttcatttcagttccaactggctgctaattacttactcacagtggaagtgtcacactgctttcctttcagcacttcgttggccaagtgtctctggcaataatctctcaacacataagcaccattccctttcatcacattatttaatcaataaagtaatgtcctcgcactggccaggctcagagccatcttgtcacaagtgctaaataaatgaaacaaacaccagtcctgcttctacaacctctccattaataaacatgaacggagacgcctttaatacaaaatccattctctcaaacgtttaaaactgcacacacatgcacgtttgcaagactagaagaggaatcatttatatgatggtgagaatagaccaagcagcactgggccaagtcccactcacaagtggtgagattacgttatttccaactgggacaagtgccccttccatgctctcccagggctgcttgttcccaaggggtgatgtttcctcatccatgttctgtctgtaagaggcaagcacatcatggcactccctctgctgctcagtttacaaaagaatgataggatgccccatttttccttctctttttgccaggggccctgcactatggtagtattgggcttccaaatataaagtttggatcccaattcatcctctcctatttctcaatggtaataaaaccagaggagagaagggtgagtcttagccttagtctaacagatgctggcacactctaggtatgcaatgttaaaaggataaatgacttatttatgtagcatcagagtcaccttctttagaagctagcatttattaagcacttaatatgtggcaggcactcttctaataggtaacttgcttaattctctcattttatacattgagaaactaaggcttggcaaggataagtcagttatccagagtcccagcaggtgagagcaaagctaggatgtcttcatttctctgtgaaaagttatttccaattggagtcctagaactttcaagatccacctttttttttcactgtttttatttatctgtgctgcctgagggaatacattcttatgaccaactggcattgctgtcagtgtttcaagagtaagctcgctatccccaagttctctggcattgaagaatcaggaaccatgtttttataaataaaatcactctgtaatcattccactttctgtgaaaaatctcaccacaccacaatacttccatgggttcccaaaaggttccctgtgtccgattcctactctttctgaaatccctctccttgccatctcacctccaggtgagttcttcctcattccccctctgtcccaagcatgggagagctcctcttcctgcatcacccaaagcaccattaaataagggtgccatgtaaaactgacttgtattgaggattatagaaggaaattaaattacaccacaggtcaaaaactaacttcaaatggaatattccacaccataaatatattcagccattcttctacaataactctcttaccaaccctcttccccgcttaggtcctgactgttatccatgtcatcttcctactaagacccttttattctgtctcctctactctatatactactcaagccctaaacaactccttcttgagcttccaaaagacaatcatcaaactcttgttacttgatgatacagagcaaataaagcaccctcccaatgtctaggtgaattttggggcacttacttttcattctaaaaaaacaaaaaaaaaaataaggttttccttacaaaaagagaaatcctcttttttaagggtggccacttcaaaatgaagccacccattatgtttttctcactgcacaatttttagagttctagaaagtgaatagagccttgtctaagcagtcaaagctctcagcagtgtggataactgcccttaccctaaaacaatgctttatttaagatgcctagaggaaggatatcctagtcaaaatattcttttttaaaaataaaatagaaatagctcctcctgagctatttgacaagttagtgccacttagggtgagtgtcacactcttgatgttgttcaataaatatttgctaaataaattggtgattgcagtcacttcccaaaggaaagaagacaaaaggtacaagtaaagtaaaattactttattttcactttaagagcaaaaactttaataattgccttgagtctgttttagcagaaattaggcacttggttttcattagcagaggcattcagagatatttctgctaatgaaaatctaaaaccaggcctttaaaatggcttagtgatagtgatgattcttaagagagctcatgagtttcccagccctatgggacatgttgatcattcattttataggtcaaatgcaagtgcgtttattaatgtatgctctgatctaacccacattgcaggactaacttcacagtgcttgatcaatgatacccaaattaatggattcatcagtgctgcctattgagacaccctcgtcatttatattgcatttcttccaactcgtaattaggcatgtaatctgtgcagtctctaagtggattcttgaaaagaaacctacatcagaagaaagtgtggagatttttattgtattgatgactttggctcatcagttgctcctgttctgttacattatttcttctacatcttgacgggtactttctttctcatgctaaagttcccccattgttacaaatccttcagtcaaagattgtattctacatcatgcctttcctttgtccataaaatttctgttcctactacttcattgaaatatttatttcaaaagtcttcaataatcttctaaccacaaaatgtaattccctttcatagactcagtagcatctggtattgctaaccatgcactcttatttgaaaccttttcacctgctggactctaagacattaccctttccagatccttttcctgtctctctgttcagaattcatcagtctctttgtaggatctctttctaccagcttgttaaactttcctccaagttctgccgcctcgacttgacaatatacttgacatatatacttatgtatatatgacatgactatatactcatcttgacaatatactcattccaatggcttctacaatcacctctaggtacataatttccaaacttaagccctaatgtaactactaaagaggaaagcaagggaaggatgaaataatatggtagaaataaatccccaaacgccattaataaaagcaaatattaaaaaactaaattctccagtttaaaagatcttcagtgaagataaaatacaagttgattacaaactctaagattgaataaacatagaaatttgtttgtatgtgtttgaaagaggaacgcccaaaacataaagacacagaagtttgaaagtaaagaaagaaacaagatatctgccctcccaccaccatcaaaaaaaaaagcttttttcactacattaatagcagataaaatgcaatttagggcaaaaaaaaagcatattgaaatgaagaaggtcattatatattaaaagcatcaaaatttagcaggaatatgtaaaaatggcaacttgtatgtacctaataatatagcctcaagacatgaaaagcaaaaatcagttgaaatgcaaggatatattgataatggcaaaattataatgagagattttatcatctttcttagtaattgataaatcaaaaacaaaatattactatgcattgcttcatattttgcatataaaaatgcatccaccaattaaacatacttttctcaagcctatgtagaaaaattataaaaaatgatcatctattagaacaaaaagcaattctcaacaaatattaaagaatctctgtcattcagatcagcctctgaacaagtacaatcagattagaagtcaaatacaaaaaataatcccatatatttagaaatttaaaatttatataatttatgtattctaattacaatgaccatttcaaaatatttataattaattgaatgatgaaaattgtacatatcaaaacttatgagataaagctaaagcaatattttgaaaaaatttatattctcaatgctatatacattttcagaaagagtaaaaatcaataactcacctatgcaactcaaaaaattaggagagcatcaactacaaagtatataaaataaaataataacagtaaaagcagaaattaataaaatgtttaaaaacaagaataaaactaaaaagaatcagcaaaaaaaaaaagttgatttgaaaacaaaaaaaaactagttagacaaactactagccaaagcaataaagaataaaaaagaaaaaagacaaatagaaaataatcttaaaagcagacataaaggacatagctacagaaacagtggagacttctttttaatcaaaagagaatactatggccaaattcatgccatgaaatttgaaagttaagattaaaaggacagtctctgaaaaaatataatttctctgacccatctccagaaataaataacttcaatggatatataacctttagaacacagatattgaatccctaattaaaatctacacagctcactcttcagcaacaaaatgaaacaaagttaatcaagcgtttcatacatggagaataatatctaacaccatggacctttttttttttttttttttttgagatggagtcttgctctgtcaccaggctggagtgcagtggggcaatcttggctcattacaatttccgcctcctgggttcaagcgattctcctgcctcagcttccagagtagctgggattacaggtgcgcaccaccacacccagctaatttttgcattttcagtagagacagggtttcaccatgttggccaggatagtctcgatctcctgacctcgtgatccgccagccccggcctcccaaagtgctgggattacaggcatgagccaccacgcccggtccatcatagactattagaactgaatgaatcttagagagcatctgatacaaccgtcccctgcaaacaagggaactgaagttcagagagatgaaaataacaaccgccaccacaacagctgctaatgttaatggagtcctcactatgagtcaggtagtatgttaaatgctttgtgtgcattatctcatttaatatcaataaccctgtaaaataagtgctaacatttttgctttgcatgtaagaaaatcgctgcttataaaatttaaataacttgcccagggtcacttggctaataagaggcagtaagattcaaactcaggttcatctgcctgcaacacctgtgctcctagctgcagcgtggcaatcaggatgcataag

SEQ ID NO: 2068 - DNA, 11767 bp, Homo sapiens
gctttattgctcacacaaagcctgtttggtggtctcttcgcacagaagtgcatgaaatttggtgctgtgactgggatcgggggacctcccttgggagatcaatcctctgtcctcctgctctttgctccatgagaaaggtccacctacgacctcaggtcctcagaccgaccagcccaagaaacatctcatcaatttcaaatccggaccccactggaaatcggactgttcaactcacctggcagccactcccagagcccctggaactctggcccaaggctctctgactgactccttcccagatcttctcggcttagcggctgaagaccgacgctgccggatcgtctcggaagccccgtagaccatcacggacgccgagctttaagtaactctcacagtggacggtaagtccgtccccttcttaatcaatacggaggctacccactccacattaccctcttttcaagggcctgtttcccttgcctccataactgttgtaggtattgacagccaggcttctaaacctcttaaaactccccaactctggtgccaacttagacaacactcttttatgcactccttttagttatccccacctgcccagtttccttattaggccgagacactttaactaaattatctgcttccctgactattcctggactacagctacatctcattgcctcccttcttcccaatccaaagcctccttcatgtcctcctcttgtattccccaaccttaacccacaagtataagatacctctactccctccttggcgaccgatcatgcaccccttaccatctcattaaaacctaatcagccttatcccgctcaatgccaatatcccatcccacagcatgctttgaaaggattaaagcctgttatcactggcttgctacagcatggccttttaaagcccataaactctccttacaattcccccattttacctgtcctaaaaccagacaagccttacaagttagttcaggatctgcgccttatcaaccaaattgttttgcctatccaccccatggtgccaaacccgtatactctcctatcctcaatacctccctccacaatctgttattctgttctggatctcaaacatgcttgctttactattgctttgcacccttcatctcaccctttcttcgctttcacttggactgaccctgacacccatcaggctcagcaaattacctgggctgtactgccgtaaagcttcacagacagcccccattacttcagtcaagcccaaatttcttcctcatctgttatctatctcagcataattctcataaaaacacacgtgctctccctgccaattgtgtccaattaatctgtcaaaccccaaccccttctacaaaacaacaactcctttccttcctgggcatagttagatactttcacctttagatacctggttttgccatcctaacaaaaccatcatataaactcacaaaaagaaacctagctgaccccatagatcctaaatcctttccccactcctctttccattccttgaagacagctttagaggctgcccccactctagctctccctgactcatcccaacccttttcattagatacagctgaagtgcaaggctgtgcagtcagaattcttacacaaggaccaggatcacgtcctgtagcctttttgtccaaacaacttgaccttcctgttttaagctggccattatgtctccgtgcagtggcggctgctgccctaatacttttagaggcccttaaaatcacaaactatgctcaactcactctctgcagctctcataatttccaaaatctattttcttcctcacacctgaagcatatactttctgctccccggctccttcagctgtactcactctttgttgagtctcccacaattaccattgttcctggcctggacttcaatccggcctcccacattattcctgataccacacctgaccctcatgactgtatctctctgatccacctgacgttcaccccatttccccacatttccttcttccctgtttctcaccctgatcacacttagtttattgacggcagttccaccaggcctaatcaccacacaccagcaaaagcaggctatgctatagtacaagccactagcctgcctcttaaaacctctcatttcctttccatcgtagaaatctatcctcaaggaaataacttctcaatgttccatctgctattctactactcctcagggattattcaggccccctcccttccctacacatcaagcttagggatttgcccccgcccagaactggcaaattagctttactcaacatgccccgagtcaggaaactaaaatacctcttagtctaagtagacactttcactagataagtagagatctttccttcagggtctgagaaggccaccgcagtcatttcttcccttctgtcagacgtaattcctcagtttagccttcccacctctatacagtctgataacagaccagcctttattagtcaaatcagccaagcagtttttcaggctcttagtattcagtgaaacctttatatcccttacagtcctcagtcttcaagaaaagtagaacagactaaaggtcttttaaaaacacacttcaccaagctcagccaccaacttaaaaaagaatagacaatacttttaccactttccctttcagaagtcaggcctgtcctcagaatgctacaaagtacagctcatttaagctcctgtatagatgctcctttttattaggccccagtctcattccagacaccagaccaacttggactgtgccgcaaaaaacttgtcatccctactgtcttctgtctagtcatactcctattcaccattctcaactactcatacatgccctgctcttgtttacattgccggtttacactgtttctccaagctatcacagctgatatctcctggtgctatccccaaaccgtcactcttaactgttaaagtaaataaataagctttgctggtaaggctatgctgaacctccttaggcattctctaattagatgtcctaagtcctcccagttcttagtccttttttttttattattattattatactttaagttttagggtacatgtgcacctgtttttctccttctcttattctgtttagtttttcaattcatacaaaactgtatccaggccatcaccaataattctaaatgacaaatgtttcttctaacaaccccacaatatcaccccttaccacaaaatcttccttcagcttaatctctcccactctaggttcccacgccgcccctagtcccgcttgaagcagcccggagaaacatcgcccattatctctccataccacccccaaaaattttcgccatcccaacactttaccactgttttgttttattttataaataaattaattattaagaatatatatttattttataaataaattaattattaatataagaagacaggaatgccaggcctctgagcccaagctaagccatcatatcccctgtgacctgcacatacacatccagatggccggttcctgccttaactgatgacattccaccacaaaagaagtgaaaatggcctgttcctgccttaactgtgacattgtcttgtgaaattccttctcctggctcatcctggctcaaaagctcccctactgagtaccttgtgacccccactcctgcctgccagagaacaacccccctttttcctttacctacccaaatcctataaaatggccccacccctatctcccttcgctgactctcttttcagactcagcccgcctgcacccaggtgattaaaagctttattgctcacacaaagcctgtttggtggtctcttcacatggacgtgtgtgaaaccagctacttgggaagtggaggcaggaggatcgcttgtgtctaggaggtcaaagctgcactgagttatgacggcatcactgcactccagcctaggtgactcagtgaaacccagttcaaaaaattatttttttaaaaaaagagtgtagaaagagttcaacaacaaaggagtagcacaggatatttgggtatgcagggggtaagacagtgatggaactgttctatttcttgattgtgatgatggttatattagtttgtacatttgttaagactcatagaactatataccaataagagtgatttttgcagtatgtaaattttaaaacaaattaagaaaatgtattgaaaataaaatcatagaccgcaataccattgtattagtttcctatggctgctgtgacaagtaaccacaaacttggtgattttaaacaacatgaatgtacttttccgtagttctagaggccagaagtccaagatgagtcttacagagctaaaatcaaggtgtagacaggcccaggctcctcctggaggttgcctcctccaactactggtggccattggcatttcttggcttgtggctgcatcactccaatctctgtttccatggtcatattaatttctcttcttttttctgtgtgaattgtgcctttgtcccctctcttataatgacacttaggattgcattagagatcaggtgaatactccaagataatctcctatctcaagaatctttaatgactctagacagcctttgccatataaggtaatattcactgattccagggattagaatgtggccattcggagtatgaggccatcattcagcctcccacaactgtagtaaataggagaggtctacacagggaacttttcatatactgataatgttcaaattcttaagtgataaaaacataggtgttcagcatttaagtggcagaaaacaagaagaaatgggagtatttctactgagtgagtagtttggagaagttagaaaatatatggtaaattcaagctatgatgaattatcctagttcaattgtgttactataaaggaatacctgaggctgagtaatttatgaagaaaagaggtttatttggttcacagttctgcaggctgtacaagaagaacggtgccagcatctgcttgtcactaaggcctcaggctgcttgcacacatggtagaaggtgaagaggagcctgcatgtacagagattacacagtgggaaaggaagcaagagagagggaagggaggtgctaggcttttcttaacaaccagctcccacagaaactaagagtgagaattcactcatctccagctcccatcagagggcattaatctattcatgagggatctgccaccatgatgcaaacacttcccattaagcccgacctccaatattgaagatcaaattgaaacatgagatttggagggttcgaacttctaaactatagcatgactacactcaagtgacttgaatatgggatgtggtggagtatatcatgaaagaggtttaaaaggttacagccaaataatagggcacctcaaatctcttggtaataattttggcatcattctggaggtcttacagagtgattaaatgtttttgagtcagtgggaatcaaaccaatgtgttaattcatcgtataaatacatacaaattataatagcatttattatgtggcaagaatggcttaagaactttaaatattttaaatcattttattcttgtagcatccttaagagtaagcactattattatcatcattttacaaatgaggaaactgaagcacagaaatgtcaagtggctttcccaaggtcataccgcaagtaagtcacagaatcagtatttggatctaggaagagagccttcagagtccttgttttaattatttgctctaccaagaagaaaaagaagagagaaaaaaagaaaataaagaatacagacaggcaggttaatgagagaaaaagataaataatgaagaacaaaaagcaaggagcaatattctgaagagttacagacatgatggaataaacagcaagttgtcaaaaggagctgcaaatgcccatgtatgccctttcaggagcgctagactatctgcatgagacagagagtaaatcctgatgccatcactcaaactagacctacaagtgcctcgagttcttacagatccccatctttctgggcaaaacatccatccttcaaatcattccacaggttaaagaacaaatgtcaggttacactcttgaatagtacagtcctattttctcccataaatgcctgcataggacgtcttcttcatatggaccctaaaatatttctacaagtagtagacattttttagaactgcaataaagtaatgtaataaatgcattgtttgaattttttcctgttttatatatgatacctgagattagaattgtgtcccttttatataaaattgggcagttttattttgtgccatttcaaaggtattgttctatatcactgtagtttcagatgtttattttttattatttcaaagtcaaaacatgaagaagtaagatgtatgtttctgtatgcctttaaaaatgcaaacctgcaacattaatgggaactttccccaggacacttcatttcagttccaactggctgctaattacttactcacagtggaagtgtcacactgctttcctttcagcacttcgttggccaagtgtctctggcaataatctctcaacacataagcaccattccctttcatcacattatttaatcaataaagtaatgtcctcgcactggccaggctcagagccatcttgtcacaagtgctaaataaatgaaacaaacaccagtcctgcttctacaacctctccattaataaacatgaacggagacgcctttaatacaaaatccattctctcaaacgtttaaaactgcacacacatgcacgtttgcaagactagaagaggaatcatttatatgatggtgagaatagaccaagcagcactgggccaagtcccactcacaagtggtgagattacgttatttccaactgggacaagtgccccttccatgctctcccagggctgcttgttcccaaggggtgatgtttcctcatccatgttctgtctgtaagaggcaagcacatcatggcactccctctgctgctcagtttacaaaagaatgataggatgccccatttttccttctctttttgccaggggccctgcactatggtagtattgggcttccaaatataaagtttggatcccaattcatcctctcctatttctcaatggtaataaaaccagaggagagaagggtgagtcttagccttagtctaacagatgctggcacactctaggtatgcaatgttaaaaggataaatgacttatttatgtagcatcagagtcaccttctttagaagctagcatttattaagcacttaatatgtggcaggcactcttctaataggtaacttgcttaattctctcattttatacattgagaaactaaggcttggcaaggataagtcagttatccagagtcccagcaggtgagagcaaagctaggatgtcttcatttctctgtgaaaagttatttccaattggagtcctagaactttcaagatccacctttttttttcactgtttttatttatctgtgctgcctgagggaatacattcttatgaccaactggcattgctgtcagtgtttcaagagtaagctcgctatccccaagttctctggcattgaagaatcaggaaccatgtttttataaataaaatcactctgtaatcattccactttctgtgaaaaatctcaccacaccacaatacttccatgggttcccaaaaggttccctgtgtccgattcctactctttctgaaatccctctccttgccatctcacctccaggtgagttcttcctcattccccctctgtcccaagcatgggagagctcctcttcctgcatcacccaaagcaccattaaataagggtgccatgtaaaactgacttgtattgaggattatagaaggaaattaaattacaccacaggtcaaaaactaacttcaaatggaatattccacaccataaatatattcagccattcttctacaataactctcttaccaaccctcttccccgcttaggtcctgactgttatccatgtcatcttcctactaagacccttttattctgtctcctctactctatatactactcaagccctaaacaactccttcttgagcttccaaaagacaatcatcaaactcttgttacttgatgatacagagcaaataaagcaccctcccaatgtctaggtgaattttggggcacttacttttcattctaaaaaaacaaaaaaaaaaataaggttttccttacaaaaagagaaatcctcttttttaagggtggccacttcaaaatgaagccacccattatgtttttctcactgcacaatttttagagttctagaaagtgaatagagccttgtctaagcagtcaaagctctcagcagtgtggataactgcccttaccctaaaacaatgctttatttaagatgcctagaggaaggatatcctagtcaaaatattcttttttaaaaataaaatagaaatagctcctcctgagctatttgacaagttagtgccacttagggtgagtgtcacactcttgatgttgttcaataaatatttgctaaataaattggtgattgcagtcacttcccaaaggaaagaagacaaaaggtacaagtaaagtaaaattactttattttcactttaagagcaaaaactttaataattgccttgagtctgttttagcagaaattaggcacttggttttcattagcagaggcattcagagatatttctgctaatgaaaatctaaaaccaggcctttaaaatggcttagtgatagtgatgattcttaagagagctcatgagtttcccagccctatgggacatgttgatcattcattttataggtcaaatgcaagtgcgtttattaatgtatgctctgatctaacccacattgcaggactaacttcacagtgcttgatcaatgatacccaaattaatggattcatcagtgctgcctattgagacaccctcgtcatttatattgcatttcttccaactcgtaattaggcatgtaatctgtgcagtctctaagtggattcttgaaaagaaacctacatcagaagaaagtgtggagatttttattgtattgatgactttggctcatcagttgctcctgttctgttacattatttcttctacatcttgacgggtactttctttctcatgctaaagttcccccattgttacaaatccttcagtcaaagattgtattctacatcatgcctttcctttgtccataaaatttctgttcctactacttcattgaaatatttatttcaaaagtcttcaataatcttctaaccacaaaatgtaattccctttcatagactcagtagcatctggtattgctaaccatgcactcttatttgaaaccttttcacctgctggactctaagacattaccctttccagatccttttcctgtctctctgttcagaattcatcagtctctttgtaggatctctttctaccagcttgttaaactttcctccaagttctgccgcctcgacttgacaatatacttgacatatatacttatgtatatatgacatgactatatactcatcttgacaatatactcattccaatggcttctacaatcacctctaggtacataatttccaaacttaagccctaatgtaactactaaagaggaaagcaagggaaggatgaaataatatggtagaaataaatccccaaacgccattaataaaagcaaatattaaaaaactaaattctccagtttaaaagatcttcagtgaagataaaatacaagttgattacaaactctaagattgaataaacatagaaatttgtttgtatgtgtttgaaagaggaacgcccaaaacataaagacacagaagtttgaaagtaaagaaagaaacaagatatctgccctcccaccaccatcaaaaaaaaaagcttttttcactacattaatagcagataaaatgcaatttagggcaaaaaaaaagcatattgaaatgaagaaggtcattatatattaaaagcatcaaaatttagcaggaatatgtaaaaatggcaacttgtatgtacctaataatatagcctcaagacatgaaaagcaaaaatcagttgaaatgcaaggatatattgataatggcaaaattataatgagagattttatcatctttcttagtaattgataaatcaaaaacaaaatattactatgcattgcttcatattttgcatataaaaatgcatccaccaattaaacatacttttctcaagcctatgtagaaaaattataaaaaatgatcatctattagaacaaaaagcaattctcaacaaatattaaagaatctctgtcattcagatcagcctctgaacaagtacaatcagattagaagtcaaatacaaaaaataatcccatatatttagaaatttaaaatttatataatttatgtattctaattacaatgaccatttcaaaatatttataattaattgaatgatgaaaattgtacatatcaaaacttatgagataaagctaaagcaatattttgaaaaaatttatattctcaatgctatatacattttcagaaagagtaaaaatcaataactcacctatgcaactcaaaaaattaggagagcatcaactacaaagtatataaaataaaataataacagtaaaagcagaaattaataaaatgtttaaaaacaagaataaaactaaaaagaatcagcaaaaaaaaaaagttgatttgaaaacaaaaaaaaactagttagacaaactactagccaaagcaataaagaataaaaaagaaaaaagacaaatagaaaataatcttaaaagcagacataaaggacatagctacagaaacagtggagacttctttttaatcaaaagagaatactatggccaaattcatgccatgaaatttgaaagttaagattaaaaggacagtctctgaaaaaatataatttctctgacccatctccagaaataaataacttcaatggatatataacctttagaacacagatattgaatccctaattaaaatctacacagctcactcttcagcaacaaaatgaaacaaagttaatcaagcgtttcatacatggagaataatatctaacaccatggacctttttttttttttttttttttgagatggagtcttgctctgtcaccaggctggagtgcagtggggcaatcttggctcattacaatttccgcctcctgggttcaagcgattctcctgcctcagcttccagagtagctgggattacaggtgcgcaccaccacacccagctaatttttgcattttcagtagagacagggtttcaccatgttggccaggatagtctcgatctcctgacctcgtgatccgccagccccggcctcccaaagtgctgggattacaggcatgagccaccacgcccggtccatcatagactattagaactgaatgaatcttagagagcatctgatacaaccgtcccctgcaaacaagggaactgaagttcagagagatgaaaataacaaccgccaccacaacagctgctaatgttaatggagtcctcactatgagtcaggtagtatgttaaatgctttgtgtgcattatctcatttaatatcaataaccctgtaaaataagtgctaacatttttgctttgcatgtaagaaaatcgctgcttataaaatttaaataacttgcccagggtcacttggctaataagaggcagtaagattcaaactcaggttcatctgcctgcaacacctgtgctcctagctgcagcgtggcaatcaggatgcataag

SEQ ID NO: 2069 - DNA, 392 bp, Homo sapiens
gataaaaacccacagccatacactagctggcctgtcctgagggttgtgaggcacaaaatgctaggagactagagaagtaagaaatgtcttgacatgaggagaaatcaaggaaagcatggttttagaacatgtgtgggatgttttttgtatcgagactgaagaggctttttaaagtggagggaaggcaaactgaggcatagagatgccaataccaggtcttgtcaggaagaacagagtccaatttggctgcaggatagggcatatgtaggggaggggataagactggcatgggggcagagggggacttgaatgtcaggtgacagagtcaaagcttgcactcaagtaggtgattgataggtgaggggtgggatgtggggttgagtagatttgcc

SEQ ID NO: 2070 - DNA, 392 bp, Homo sapiens; identical to SEQ ID NO: 2069

SEQ ID NO: 2071 - DNA, 894 bp, Homo sapiens
ctaggcgttctgcctcccagggtggagttggcagatgagaatgagggagaggctattgtcatcatcatcaaaagctttaagattcagtgcctaatcttgcaagccacaatgcaggatgatgctgctcagagggaatcccagcgagccaggcctgtccctagggagcacccactgaaagagaaatactggcagccacacgtagaacattgacagcattgcctatctgaacatgatccatgagtggctttctctacagctgcaggaagtctcacaactccattttccagcgggatggggctctatctcagtagagcagcttcgctttatcagctgaaggccatcttgagttcatgctgtctactcacctgcattcctcgccctccagcagcttgcgcctctggatcatccggttcatctcagagatctcatgcttggtgttgcggaggtcatcgccatgccggccagctgtctgctgcagctcctcatactgatgcagccaggaaagaggaaagattctgtttatatgagaatgggaagaactttcccaaagttcacaggcagtgagtactaagtggtggcaaatagtgtggggctggttcaggcttttccaaggctgagctagtctagtgcctttgctctcctggagacactggtgtgagattcagagtgagattatttctcaggtccttgggtttagatggaaattgtctacacagccattcctataaagcatcccaatgggcttcagcaggttccaggagccccattcttagtgtcgtcatggcctagaatcctagacatgggtgtgtcccctcactcaggagacagtcatcagagcacccaccttggtctgataccaggactcggcttctgtccggctgcggttggcaatct

SEQ ID NO: 2072 - DNA, 3069 bp, Homo sapiens
tttgctttgttgaagatcagttggctctaagtatttggctttctttctgagttctttattctgttccattggtctatgtgtctatttttataccagtcccatgctgttttggtgactatggccttatagtttagcttgaagtcatgtaatgtgatgcctccacatttttttctttttgcttagtcttgcaaaaagcaagactctgtggcctcttttttggttccatatgaattttaggatcttttttctacctctgtgaagaatgatgatggtattactcatggagggtgtccagattcttggcgtcttgaacaaagaattggacaaaatgcaaaaacaaagcaaggaaagcaaaagcagagatttattgaaaatgaaagtacattccacagggtgggagtgggcctaagcagaggggctcaagagacctggttacagaattttctggggtttcaatactctctagagttttcccactggttactttgtgcatgctctgtgtaaatgaagagaatgaagtgaagttacaaagtcatttactcagaatgcaccctatgtaaatggagaggatgttacttggtgtgtatgatctatgtaaatggagacgatgaatgtgaagttacaaagtgtaaatggtgtaagtggagaggatggagtgaagttacaaaaccattcacattcctgtcattgctgaagtgcttccatttgatttaattctaggaagtcagcctggatcggccttatgttccctgcctccaggcactattctccagcctcagtggtattttgatgggaattgcattgaatttgtaggttgcttttggcaatatggtcatttacacaatattgattctacccatctatgagtatgggatgcgtttccatttgttttgtgtcatccatgatttctttcagcagtgttttgtagttttccttgtagaggtctttcacctccttggttagatatattcctacgtattttattgtttttgcagcttttgtgaaaggggttgagttcttgatttgattctcagtttgatcactgttggtgtatagcagaactactgacttgtgcacattaattttgtatcctgaaacttcgctgaatttacttaccagttctaggagctttttggatgagtctttatggttttctagatatacaattatatcatcagcaaacagtgacagtttgacttcatctttattgatttggatgccctttatttctttctcttgtctgattgctctagccaggacttccagtactatgttgaatagaagtgatgaaagtgggcatccttgtcttgttccagttctcaggggaaatgctttcgactttgccccattcggtataatgttggctgtggtttgtcatagatggcttttattaccttaagcccttctatgccaattttgtatgtatgtcccttctatgccaatagaagtatgtcccttctatgccaattttgctgagggttttaatcataaaggatgctagattttgtcaaatgctttttctgcatctattgagatgattatgtgattaaaaaaattctgtttctgtggtgattcatatttattgacttatatatgttgaaccatccctgcatccctgggataaaaccaaatagattacagtggattatctttttgctatgctgttagattcagtccgctagtattttgttgagaattttagcatctatgttcatcaaggatattgatctgtagtttttgttgttgttgttgttgttgttatgtccttttgtggtcttggtatcagggtgatactggcttcatagaatgatttagggcagattccctttttctctatcgaaaaggattggtactaattcttctttgaatatctgacagaattcagctgtgaatccatctgatcctggactttttttgttggcaattttaaaattaccatttcaatctcactgcttgttatttgtcagacctctgagcccaagctaagccatcatatcccctgtgacctgcatgtgtacatccagatggcctgaagtaactgaagaatgacaaaagaagtgaaaatggcctgttcctgccttaactgatgacattaccatgtgaaattccttctcctggctcatcctggctcaaaagctcgcctgctgagcaccttgtgacccaccccccactcctgcccgccagagaacaacccccctttgactgtaattttcctttacctacccaaatcttataaaacggccccaacccatctcccttcgctgactttcttttcggactcagcccgcctgcacccaggtgaaataaacagccttgttgctcacacaaagcctgtttggtggtctcctcacatagatgagtgtgaaatttggtgctgtgactcagatcaggggacctcccttgggagatcaatcccctgtccttctgctctttgctccatgagaaagatccacctacgacctcaggtcctcagactgaccagcccaaggaacatcacaccaattttaaataaggaccccactggaaactggaccatccaactctcccggcagccacttccagagcccctggaactctggcccaaggctctctgactgactccttcccagatcttcttggcttagcacctgaagactgatgctgctcaatcaccttggaagcctacaggaccatcacagacactttcggtaactcttacagtggagggtaggtatatccagatgtacgagatgagacttatggaggctcacttgcccagagtttctcagctggtcacttgctcagcagaagttgaattcttgatccaggtctctgaagcatgtgcgagctaaagtttgagttatgaattcaaatgttgtcagggctcaggtgaggaaaagagtaaaactggctaggtggagactgaagatttggaagcaatttttggcatggaagaacttgagaccagcattaccagatcttcccatttttcaagagaaactgaaaatatcttctctttaatgtgaaatctctgtatttaaaatgctatatattaatttttttaaataaacaggatttgggttaggcaca

SEQ ID NO: 2073 - DNA, 5948 bp, Homo sapiens
tttgctttgttgaagatcagttggctctaagtatttggctttctttctgagttctttattctgttccattggtctatgtgtctatttttataccagtcccatgctgttttggtgactatggccttatagtttagcttgaagtcatgtaatgtgatgcctccacatttttttctttttgcttagtcttgcaaaaagcaagactctgtggcctcttttttggttccatatgaattttaggatcttttttctacctctgtgaagaatgatgatggtattactcatggagggtgtccagattcttggcgtcttgaacaaagaattggacaaaatgcaaaaacaaagcaaggaaagcaaaagcagagatttattgaaaatgaaagtacattccacagggtgggagtgggcctaagcagaggggctcaagagacctggttacagaattttctggggtttcaatactctctagagttttcccactggttactttgtgcatgctctgtgtaaatgaagagaatgaagtgaagttacaaagtcatttactcagaatgcaccctatgtaaatggagaggatgttacttggtgtgtatgatctatgtaaatggagacgatgaatgtgaagttacaaagtgtaaatggtgtaagtggagaggatggagtgaagttacaaaaccattcacattcctgtcattgctgaagtgcttccatttgatttaattctaggaagtcagcctggatcggccttatgttccctgcctccaggcactattctccagcctcagtggtattttgatgggaattgcattgaatttgtaggttgcttttggcaatatggtcatttacacaatattgattctacccatctatgagtatgggatgcgtttccatttgttttgtgtcatccatgatttctttcagcagtgttttgtagttttccttgtagaggtctttcacctccttggttagatatattcctacgtattttattgtttttgcagcttttgtgaaaggggttgagttcttgatttgattctcagtttgatcactgttggtgtatagcagaactactgacttgtgcacattaattttgtatcctgaaacttcgctgaatttacttaccagttctaggagctttttggatgagtctttatggttttctagatatacaattatatcatcagcaaacagtgacagtttgacttcatctttattgatttggatgccctttatttctttctcttgtctgattgctctagccaggacttccagtactatgttgaatagaagtgatgaaagtgggcatccttgtcttgttccagttctcaggggaaatgctttcgactttgccccattcggtataatgttggctgtggtttgtcatagatggcttttattaccttaagcccttctatgccaattttgtatgtatgtcccttctatgccaatagaagtatgtcccttctatgccaattttgctgagggttttaatcataaaggatgctagattttgtcaaatgctttttctgcatctattgagatgattatgtgattaaaaaaattctgtttctgtggtgattcatatttattgacttatatatgttgaaccatccctgcatccctgggataaaaccaaatagattacagtggattatctttttgctatgctgttagattcagtccgctagtattttgttgagaattttagcatctatgttcatcaaggatattgatctgtagtttttgttgttgttgttgttgttgttatgtccttttgtggtcttggtatcagggtgatactggcttcatagaatgatttagggcagattccctttttctctatcgaaaaggattggtactaattcttctttgaatatctgacagaattcagctgtgaatccatctgatcctggactttttttgttggcaattttaaaattaccatttcaatctcactgcttgttatttgtcagacctctgagcccaagctaagccatcatatcccctgtgacctgcatgtgtacatccagatggcctgaagtaactgaagaatgacaaaagaagtgaaaatggcctgttcctgccttaactgatgacattaccatgtgaaattccttctcctggctcatcctggctcaaaagctcgcctgctgagcaccttgtgacccaccccccactcctgcccgccagagaacaacccccctttgactgtaattttcctttacctacccaaatcttataaaacggccccaacccatctcccttcgctgactttcttttcggactcagcccgcctgcacccaggtgaaataaacagccttgttgctcacacaaagcctgtttggtggtctcctcacatagatgagtgtgaaatttggtgctgtgactcagatcaggggacctcccttgggagatcaatcccctgtccttctgctctttgctccatgagaaagatccacctacgacctcaggtcctcagactgaccagcccaaggaacatcacaccaattttaaataaggaccccactggaaactggaccatccaactctcccggcagccacttccagagcccctggaactctggcccaaggctctctgactgactccttcccagatcttcttggcttagcacctgaagactgatgctgctcaatcaccttggaagcctacaggaccatcacagacactttcggtaactcttacagtggagggatccaaaccagggttccaccaccatgatctcagccatgatgtctctttggcttcctccaatctgtaagaaaaccaatctggggactctaccagcggctaagtatgtttgttccaattatgcagtctggatttgaagaaataaccacaggatgggttctgggacccaccaaatccactgtgagacagatttaagctgaaactacattgatcacctgacctctgtaagcctctacctgctctgactggactgacattatgggtctcccagaatcaatatacagttgacccttgaataatatgaatttgaactacacaaatccacctatatgtggatttttttcaacaaatgcattaaaaatgtttttgcaacaatttgaaaaaaacttgcagatgaactacatagactggaaatatttttaaaaaattaataaatagcctgagcatggtggctgaagactgtaatcccagcactacgggaggctgaggtgggtgggtcacttgaggtcaggagttcgagaccagcctggtcaatgtggtgaaaccccgtctctgctaaaaatacaaaaattagctgggcatgctggcatgtgtctgtaatcccagctactcaggaggctgaggcaggaaaatctcttgaaaccaggaggctgggctgcagtgagccaagatcgtaccactgcactccagcctgggcaacagagcaagactccatctcaaaaagaaaaaaaattaagaaaaatgtaagtatgtcatgaattcataaaatatatgtagatgctagtatactttatcatttactaccataaaatatatacagatctattacaaaaagttaaacttatgcacagatacacagtacttggtgccactagcagttgagagaaatgtaaataaatataaagatgcagtattacattataactgcataatattaactgtagcatacactgtactactgtaataattttgtagccacctcctattgctattgtggcaagctcaagtattgtatcttgttaaaacaccatataatactaatcctcaccaaataagcagttcatctctccagtaaattgcatattgcagtaaaaaatgatgtctcacagttttctcctgttattcattgtgtttagcgcaatactgcaaaccttgaataacaccatgggactcaaaaaagggccagtagtgatgctggaagtgctactaggatacagaaaaaagtcataacattacaagaaaaatgtaattacttgatatgtaccatagattgagttctgcagctgtggttgttcatcatttcaagataaatgaatcaagtgtaagaaccattgtaaagagagagagagagaagaaaagagaaagaattcataaagcccttgctgcagctacttcagcttgcataaaacccttgcacatttttcggctgggtgcagtggctcatgcctgtaatgccagcactttgggaggccgaggcggatggataacctgaggtcggcagtttgagacaagtctaaccaacatggagaaaccccatctctactaaaaatacaaaattagccggggttggtggtgcgtgcctgtaatcccagctactcaggaggctgaggcaggagaatcacttgaacacgggaggtggaggttgcaatgagccaagatcgtgccattgcactccagcctgcgcaacaagagcaaaactccatctcaaaaaaagaaaaaaacccttttatcttgtattgaaaatgtagtttttatgtggatgcaggattgctacaagaaaggcatatctatgaactctaatatgatttcagaaaaagcaaagtcattacatgacaatttaaagcaaaggtgaaggaactaaagctggagaaattaagccagcaaaggatggtttgataattttagaaacagtttggtttttaaaaaaagtcaggataacagaaaaagcagcttctgccaaccaagaggcagcagacaagttcccagaagtcattacgaaaatcactgaagagaaaaggatatctgcctgaacagcttttaaatgcagaccaaaagtcctattgtagaaaaaaaaaagccacaaaggacatgtattagtaagaaagataagaaccaggatttaaggcaaggaggaataggctaactctactgttttgtgtaaatgaagtggagtttataatcaagactaccttatctagaaagccactaaccctcaagccttaaagggaaaaagtaaacaccagctgtcagcctttggttgtacaacaagaagacctagacaacaagaactctttttctggattggttccattgatgatttgtccttgaagtctgaaagttcttttgatattagacaatgctcttggccactcacaatccaatgagttcaacaatgaaggtgtcaaagtggtctactcgcctccaaagacaacatctctaagtcagtctctaggtcacagtgtcataaagacttttaaggttcatcccacatgctactctatggaagaattgtcaacactatgaaagataacttatgacaaagagaacatcattaaagtctggaaggatcactccattaaagatgcaatcatttttatagaaaaagccacaaaagccatcaagcctgaaataaattcctgctggagaaaactgtcaaggtgtgcatgactttacaggatttacaacagagccaatcaaggaaaccatgaaagagattgtggatcaggcaaaaagatgatgggtaaagaaggctttcaaaatatagattttgaagaaattcaagcatgaatagacacaccagaaaaattaacaaaagatgacttgatcactgccaggcaatgaggaagaagacatagaagaagcaatgccaacaaacaaatttatatgagacaatctggcagaagcattctgattattcaagattgcttttgatttcttttatgacatggaatcttatgggcattgaacctaaaacaaatagtgaaagaaggtttggtgccatatagaaacatttttagagagttgaaaaagcaaaaaatgtcagaaattacaatgtatttcctcaaagttacaccaagtatgacagcctctcctgcctccccttctacctcctctccctcttctgcctctgcctctaagttagcaataccaacttgctcttcttcctcctcctgctcagcctacttgacatgaagatgatgaggatgaaggcctttatgataagccactcctacttaaatgaata

SEQ ID NO: 2074 - DNA, 3319 bp, Homo sapiens
tttgctttgttgaagatcagttggctctaagtatttggctttctttctgagttctttattctgttccattggtctatgtgtctatttttataccagtcccatgctgttttggtgactatggccttatagtttagcttgaagtcatgtaatgtgatgcctccacatttttttctttttgcttagtcttgcaaaaagcaagactctgtggcctcttttttggttccatatgaattttaggatcttttttctacctctgtgaagaatgatgatggtattactcatggagggtgtccagattcttggcgtcttgaacaaagaattggacaaaatgcaaaaacaaagcaaggaaagcaaaagcagagatttattgaaaatgaaagtacattccacagggtgggagtgggcctaagcagaggggctcaagagacctggttacagaattttctggggtttcaatactctctagagttttcccactggttactttgtgcatgctctgtgtaaatgaagagaatgaagtgaagttacaaagtcatttactcagaatgcaccctatgtaaatggagaggatgttacttggtgtgtatgatctatgtaaatggagacgatgaatgtgaagttacaaagtgtaaatggtgtaagtggagaggatggagtgaagttacaaaaccattcacattcctgtcattgctgaagtgcttccatttgatttaattctaggaagtcagcctggatcggccttatgttccctgcctccaggcactattctccagcctcagtggtattttgatgggaattgcattgaatttgtaggttgcttttggcaatatggtcatttacacaatattgattctacccatctatgagtatgggatgcgtttccatttgttttgtgtcatccatgatttctttcagcagtgttttgtagttttccttgtagaggtctttcacctccttggttagatatattcctacgtattttattgtttttgcagcttttgtgaaaggggttgagttcttgatttgattctcagtttgatcactgttggtgtatagcagaactactgacttgtgcacattaattttgtatcctgaaacttcgctgaatttacttaccagttctaggagctttttggatgagtctttatggttttctagatatacaattatatcatcagcaaacagtgacagtttgacttcatctttattgatttggatgccctttatttctttctcttgtctgattgctctagccaggacttccagtactatgttgaatagaagtgatgaaagtgggcatccttgtcttgttccagttctcaggggaaatgctttcgactttgccccattcggtataatgttggctgtggtttgtcatagatggcttttattaccttaagcccttctatgccaattttgtatgtatgtcccttctatgccaatagaagtatgtcccttctatgccaattttgctgagggttttaatcataaaggatgctagattttgtcaaatgctttttctgcatctattgagatgattatgtgattaaaaaaattctgtttctgtggtgattcatatttattgacttatatatgttgaaccatccctgcatccctgggataaaaccaaatagattacagtggattatctttttgctatgctgttagattcagtccgctagtattttgttgagaattttagcatctatgttcatcaaggatattgatctgtagtttttgttgttgttgttgttgttgttatgtccttttgtggtcttggtatcagggtgatactggcttcatagaatgatttagggcagattccctttttctctatcgaaaaggattggtactaattcttctttgaatatctgacagaattcagctgtgaatccatctgatcctggactttttttgttggcaattttaaaattaccatttcaatctcactgcttgttatttgtcagacctctgagcccaagctaagccatcatatcccctgtgacctgcatgtgtacatccagatggcctgaagtaactgaagaatgacaaaagaagtgaaaatggcctgttcctgccttaactgatgacattaccatgtgaaattccttctcctggctcatcctggctcaaaagctcgcctgctgagcaccttgtgacccaccccccactcctgcccgccagagaacaacccccctttgactgtaattttcctttacctacccaaatcttataaaacggccccaacccatctcccttcgctgactttcttttcggactcagcccgcctgcacccaggtgaaataaacagccttgttgctcacacaaagcctgtttggtggtctcctcacatagatgagtgtgaaatttggtgctgtgactcagatcaggggacctcccttgggagatcaatcccctgtccttctgctctttgctccatgagaaagatccacctacgacctcaggtcctcagactgaccagcccaaggaacatcacaccaattttaaataaggaccccactggaaactggaccatccaactctcccggcagccacttccagagcccctggaactctggcccaaggctctctgactgactccttcccagatcttcttggcttagcacctgaagactgatgctgctcaatcaccttggaagcctacaggaccatcacagacactttcggtaactcttacagtggaggaacccagacatacatccatggcagggccagacgaactcaagtggcacttgccacactgaactcagaatcactacatgaagcttatcgtgcctggctccttttttgacaaagttaagctctcccaggaggctcctcaggtttttgcaagaaggcttgggtttatttgctccatcaggttggcaaaaatgtttggatcacacttccactcaagcaacatgtctggattctcagagtctcctgatgcaaacaggtaggtatatccagatgtacgagatgagacttatggaggctcacttgcccagagtttctcagctggtcacttgctcagcagaagttgaattcttgatccaggtctctgaagcatgtgcgagctaaagtttgagttatgaattcaaatgttgtcagggctcaggtgaggaaaagagtaaaactggctaggtggagactgaagatttggaagcaatttttggcatggaagaacttgagaccagcattaccagatcttcccatttttcaagagaaactgaaaatatcttctctttaatgtgaaatctctgtatttaaaatgctatatattaatttttttaaataaacaggatttgggttaggcaca

SEQ ID NO: 2075 - DNA, 3066 bp, Homo sapiens
acttttgtaatatttgaaaataaaccaactttatttgaatcagtcaataccaatcaagactggaacacaaattggtaattggttcagattcatgaggaaaacactcagctgtatcttcattaaaaggcattttacatttattaaggcttgaaagcaagtcctgttattcatcaccatagttaaaggtctcgagaaaatcaagtaactatcatttggagtgtctttgtaaaatgaaacacttgttcttttacaaaagctaagcatcttttgttaagctagttaactccccagcttataaaataggacaacgaggtggccaggaaagtaagacaaattcaaacatcagctggataatttatattttaaatatatgtatagtcaatattgtgaaatctctaactctacataaaatacttcagatgactggatccttaaaagtacattttaccaaaaacagattgcttctatagaaacacagaatagcccaaaccttatattgaggcaacgtattttatttatttttggttgcaagaaaggaattggatctatttctttaacgttaaatgaaattatgcacactttggatcatacataattatgaatcgaaagtatcctgacactaagctgggagatgcatactgacaaaggggaagaatgtgtgttgatgaggagggcacatgttgcttgatttgaatgataaagagaaatggatagaagacaatggggctgtgtgcagcaggtcctgttcgcttaagttttcctaacatcagaatcagggtgcttcacatgcacatgtctttctctgatgctttcttaagattctccttaatgtcatttaaaaaaataagaaagtgatcccttgggaatcattgtacttagttttaaccatgagttaacatttcctttttccaaggaggatgacaccagcatcttgattcaccgtgcagttgagatggcccctggccagtgggaattgaggcgagtcacagaagtacttaccaaatactcacctgctgcttctagtttaatttaattttagacacacactctcacagtgatgctaaactctttacaagatagacccgcagcttcctgcctctgcctctctcttagttctatttgtccaggccttgctgatttctgggactctcatatggtcaagatctatttcaggcatgacctatcttatgacagttctaagatgcttggtattgtctgtctgtggagtggccatggggcacagaactgtgaagagcttctgttgtttcatttgataagggcctggaaagtcagcctgggaaaactcgcacttggtgtggcctttttctgataagatcaagacttcactggccccaccagcacaagaagggaatgctgaggacagggccatttcccaagataaaactagtttgggatcgtgtggccaaataagctgatggactctgtttccgacatttcagctcatttgcttagtgctaggtcactctacctctcgtttaaaagaatatagctatgctcacatctgtgactctgaatttatcaagcatttgactttctttatcaggagatgaagaaactgtgctttggatccatcatgattttacttatccagcttactttttacagttattaaaatcttactcaataccttctctctgggccaaactcagaagcaggcattgctgactagacagtgaattcaactcagtcattctgagtttgactcttgcttctgccttcgtctcccactaccctgcttcccccacccccaatagtgctgtgcaagtcaaagaagataaataaatacaaaataaaataagatctcaacacaaatacatcccctttctgtgccaccaaaatgctttctgagcgatttgtattcattcaggaccaatgaaaaggaagcctcctaccctatagctgtatagttgtggggtcccaactgcagaccctcccgtgctccctgagttgttcttgggacacctaaggacctcaccacactgttgctgagacatgatgtgctgcacatatgataagaaggccagacaggctgaagcatctggagaaagatctcttttgaaacaaaaaaaaaaaggaaggtaatattaatattattgttactttaatataccataataaatctagtcataagacaccataactaactcttagtccatagtcacttgcattatatgataatccagtgctgaaatataaagaaatttctgaattaagtacccagaagtgccttccttctgtactcctccctctctttcaaatggctatcattgatcatataacacccccacctccttgtcttaatatatttatctctgtaaaactagctcaaccacagaagggacatctagaaacagcaatattgatttggtttggcctgtttgtttttaaggactttccagttgctgaattctgaacatccaatccgagtccttggaattctgcagacttctctggggtggagtggcctcaccggaggcttggttctgttttctctgtggcaattggctatgattcacagatgtgtttccagaacagcccaactgtgggtctcagggaagtaaactgcctcttaggtcatcctgcctgtgctgtaaattcggggaaggatttctgagtacagcaggatttcacactaattaaaaggccttcgggatcatttcagccctcatcccccaggaggccagtttggggcttttccctacagtaaaaaaggactctttcctcaccagttctccttgttaaacatctccagggcacaatttccagggggacctggaaaggttccttttgaggtggaaatgaatcaactcattccgccttttcaaagctttctcaggcttataaagtgtcctactgagaaagttcctcttcctcaatgggctctaggagacctcctgcttcctctcctctgatttgatcaatgggttactttttttcttcagagatccctggaggcagggctgaacatcgtcactatgctaggcaaggatcccagtgagcaaggaaaggcctgcagatgcctctcccaacgaagacctgtgcacc

SEQ ID NO: 2076 - DNA, 3066 bp, Homo sapiens; identical to SEQ ID NO: 2075

SEQ ID NO: 2077 - DNA, 3066 bp, Homo sapiens; identical to SEQ ID NO: 2075

SEQ ID NO: 2078 - DNA, 3066 bp, Homo sapiens; identical to SEQ ID NO: 2075

SEQ ID NO: 2079 - DNA, 3066 bp, Homo sapiens; identical to SEQ ID NO: 2075

SEQ ID NO: 2080 - DNA, 3066 bp, Homo sapiens; identical to SEQ ID NO: 2075

SEQ ID NO: 2081 - DNA, 3066 bp, Homo sapiens; identical to SEQ ID NO: 2075

SEQ ID NO: 2082 - DNA, 3066 bp, Homo sapiens; identical to SEQ ID NO: 2075

SEQ ID NO: 2083 - DNA, 3770 bp, Homo sapiens
tggatttgccatgtcattcccgcgaggcaaggatgagtcttacgcccattttacagatgagaagcctgagatccagggaggagcggggactttcccaagcttctactgtgctgggctgcctgctttctacccccatattagaggggagcaggttggacagatctgagatgtgccctggtgctggctgggcgacccggcggaggaaattgccaaacatctccaaaactcagttttcccatctgtgctatggggctcctgtgctctggctggccatgggcatgtccagtggccacacagatgggaatgagggctgttcccagagcacacgtcctcccctccatctgtgactcagccccacgcaccgtaacaaaagcctgaaccctgcccccaccttcctgttctctctcttctgagaaatgtgggtcgctgataaccatctgtgcgtcatttccctggggatgcaaccgttactcaggaagtcccagaacagaggctttggacgggcccggcccagggcctcaagcaagaagggacttgccccattgcacaggaggggaaaccgggactgatgatgaagcagttaggctgcagctgctggatgtgtctcctgatccctgagacccactcctcccatgcatcctcagagtccctcaaaccccacatccagagccagacaggatgaagcgactaagacacagagcactgaagcaatctgcccctcagaagtcccccagaggcgcgtgaaccctgagctgccccccagactctgggtttccccttcttttccccaaacagccctagctccccccaggcactcgcgttgctcagacctttgtgatggactctgagtgttgtgtgtgcatttctctgtgtttgttcatgtacaagcgtgctcgtgtgtgtgtgtgtatagatgtacacatgtacatgggtgtgtctgggtgtgtgatttgtttgcatatttgtgtgtggggcacgcgcatgtatccttggctgcatttgtgggtgcgtgcataggtgtgcttgtgtgtgcatttgtatgtgtgcacacatgtgcgtgcatgtgcatggggggattgcatgcaggcatgtgtgtatccttgtgtgtttgtgtatgtgcatgtgtgtgtgtgcatgtgggaatttgcatgcatgcttgtgtgtgtttgtgtatgtgcatgtgtgtgtgtgcatgtgggaatttgcatgcattcttgtgtgtgtttgtgagtgtgtacacgtgcatgggcgtgtttgagtgtgtacatttgtgtgtgcacttatttgtgtgcatctgtgtgggggcatctgcatggatccttgtgtgcatttgtgtgtgtgcacacgtgtgcacgtgtgtgcattcatttgtgtatgtgtgtgggtgtgtgcatgtgggcatgcgtgtgtatctttgtgagcatgtacgtgtgtgtccttgtgtgcatgtctgtgcgtgtgcatacatgtgcgtgtgtgcatttatgcgtgtatacttgtgtgtgcacttgtatgtatgcacatatgtctggaggacatggccttgccccagggtctggggacccttccctgcctgccctgccctgccctgccctgccctgaagtctggggaacttggccctgctccggggtctggggaaccctgccctgggcccctgcctgccctgggcccctgcctgccctggcggctcaccttgctctcgggcctgctgaatggaatctgcagccgctccatggcctcgatcatggcccgcatggacacgaagatgttctggtagaccaggggccggaagcccttgcgctcctcctccgagtagccggcgccgtggatgatccgcatctgcttgatgaagatgagacacagaggaccagagaggtttagtgacttaatttgggtcacacagcaagtggaaccccaggggagtaaacttggggtcgtgtgagtccttcaccaacaaaatgggacacggccagtcgagctggggaaataaatgataatcctgttgccacccgcgacacagatttgatgactcagggatgggtcatcacccgaagcctgaagagctgcgtgagaaccccctctttgcaatccattgctgtcctgaagccacaaaggattctgggacctctccattgccccccgacccccagacatcccccagctcctggatagaaatggtgggagtgatctgttttaggatacccccaaaggccatgcggcccagacgggaagttcctgcttcctcctgggcacggaggaggacaggaggaagtggaaccggcagatgccaggaaggaactgggttaaccgtgccaagccccagtcatcacaaggcaactggagccagctatgtgcacagagtccagcaccaggccctcacaggaaacgcagctgctggggaagtggggagccaggccaggcagccgcaggggcaggaggctcggcctctcagtcccgctctggctcaaactagctgctgacccccaatcaatcctgctgcctccttgggcctcattttccccatctggcactggggttctgtggtgtttctgtcccccaaggcaggcgaacagggcagtcaggagcatggactttggaaccagaattctaggtgcgagtctcagctgtgtgaccttgggcaagtcgctctgcctctctgagcctcagtttatcctttgggggaaactaggagtgcctgcctcaaagtgctaagaacaggccgggcacaatggctcacatctctaatctcgtcactttggggaggccaaggcagatggatcacctgaggtcaggagttcgagaccagcctggctaacatggtgaaaccccgtctctactaaaaatacaaaaattagctgggcatgatggtgcacacttgtagtcccagctactcaggaagctgaggcaagaggattgcttgaacccaggaggcaaaggttgccgtgagccgagatcgcaccactgcactccaaccggggtgatagagtaagactctgtctcaaaaataaaaataaaaaataaaatgtttaaagtgctaaggacataactggtccctttcacagctttattttcctgtttttgttgttgttcactttcttttcttttctttttttgtttttgtttagagactgggtctcgcaatgttgtccaggctggtcttgaactcctgggctcaagcaatcctcctgccttagcctcccgagtaactgggactacaggtatgtgccaccatacccggctcacggcttcattctgactctcccccttccccaatatgagggttgcttcatgtcagggacagacccacccccaccctggtcctttttgccatcttcctcaaaaggatcagccacctccaggtaaaaaaaaaacagcttttggattcaattcctgtttccaagaagggacagaggtctggaggttgccctcagacctgtctccagggatgaggtggtttaaaccacagtccacagtgctacatcagtgcctggggacatggatgtcatcccctgccctccatcagtagaaggggcttcctgctttgaggctggctgagtagtgcccagagtggtatgtggaagggactttcccagctccaggaagatatgatacagtgtctgggggaagttctccccaaaaatgattcattcattcattcattcattcattcagcatttcttgagcatctactatatggcaggctcattgtacacctgtgctagatgctggagacacagggatgaagaagacagatgtggtccctaccctt

SEQ ID NO: 2084 - DNA, 6943 bp, Homo sapiens
tgcagtgagctgagatcgcgccactgcactctaacctgggcgacaaaagcgagactccatctcaaaaaaaaaagtacaataaggtctcaaatgccttgtgttatggggtacatcatatttccccaaaattcatacgttcaagacctaaccccctagaacctcagtttgtgaccttctttggaaacagggccatcacacgaggaattaacccagatgaggtcgtactggagtagggtgggccctgatcctagacgactggtgtacttattaaaagaggctattggctgggcacagtggctcacgcctgtaatcccagcactttgggaggccgaggcgggcggatcacgaggtcaggagattgagaccatcctggctaacatggtgaaaccccctctcttctaagaatacaaaaaaaaaattagccgagcgtggtggcgggtgcctgtaatcccacctactccggaggctgaggcaggagaatggtgtgaacccgggaggcggagtttccagtgagccgagatcgcgccactgcactccagcctgtgcgtgtgcgtgcatgtgtgtgtgcacgcatgtgtgtgcctgtgtgcctgtgtgtgcgtgtgtgtgcctgtgtgtgcgtgtgcatgtgtgtactgtgtgtgtgcatgtgtgtgttcatgtgtgtgcgcatgtgtacatatgcgtgtattgtgcacgtgagtgcatgcaagtgtgcatgtgtgtggtgcatgtgtgttcgtgtgcatgtgttgtgcatgtgcactgcgtgtgtacatgtgtcccgtgtgtgcacgtgtgtatgtgcatgtattatgcacgtgtctgtgcgtgtttgtgtgcatgcattgtgtatgtgcgtgtgtgcactgtagtgtgtgtgtgtgtgtgtgtgtgtgtgtgtgtgtgtgtgtctggggtcctgaccaaacaaatgctgtaggtctgtgtcttgggttgctgcaatctgaccacaaaaggctgaagggtcaagttcatagccatgctgggcacacacaggcccgttcaagagcagggatccctccctttctgcaccagagcttcctgctcaggtgagggtccctgggccaacaagtgggcagggcgagggaggcggtggcgcacctcctggttgttctcctccaggcactggtcgtattcactcagtgaggccaggtagatgagggcgatcacgttctcgaaacaatggatccatttcttacgctctgacttctggcccccgacgtccacgatcctacagggaaccgaggtgccccctttcagagctcaggagcctgctccgtgacacccccaacccccatcacgtctgggatatgccaagatccataatagcgacagcaagaataggtgctagcctctcgtggatttgccatgtcattcccgcgaggcaaggatgagtcttacgcccattttacagatgagaagcctgagatccagggaggagcggggactttcccaagcttctactgtgctgggctgcctgctttctacccccatattagaggggagcaggttggacagatctgagatgtgccctggtgctggctgggcgacccggcggaggaaattgccaaacatctccaaaactcagttttcccatctgtgctatggggctcctgtgctctggctggccatgggcatgtccagtggccacacagatgggaatgagggctgttcccagagcacacgtcctcccctccatctgtgactcagccccacgcaccgtaacaaaagcctgaaccctgcccccaccttcctgttctctctcttctgagaaatgtgggtcgctgataaccatctgtgcgtcatttccctggggatgcaaccgttactcaggaagtcccagaacagaggctttggacgggcccggcccagggcctcaagcaagaagggacttgccccattgcacaggaggggaaaccgggactgatgatgaagcagttaggctgcagctgctggatgtgtctcctgatccctgagacccactcctcccatgcatcctcagagtccctcaaaccccacatccagagccagacagggtaagcagccgtcgagagggggctctggagactgagacgggagtgggatcagcaactgaccagttgggaactgtgggcatcacctctcatctcgggtctcagtgtcctctgagccctcactccattcattcgtctcactcctgggccacacctaaaaatcacttccttggcccagacttccccatgatttcccagcctctaccttcactcctaaacttttatccacccacccaccccattcatcgatttattcactcatccatccacccatccacccacccactcatccatccacccatccagccattcactcatccatccatctatccatctacccatctatccatccatccatcatccatccacccacccatccatccacccatccagccattcactcatccatccatctatccatctacccatctatccatccatccatcatccatccacctgtccacccatttacgaaatccacccaccgacccacccatccatctctccatttactcatccatccatccatccacccatctgtccacccattacccagctacccatccatccatctacccatctatccactcactcatccacccatgtacccatccacccaccctcccacccatccactcatccattcatccactcacccatccacccattcatccattcatccgtcacccaccacccatctacccattcattcatccatccatccactcatccacccatccatccacccattcatccatccatccatcacccaccacccatctacccattcattcatccatccatccactcatccacccatccatccacccattcatccatccatccatccatccatcccacccatccatccatctatccatccacccatccatctattcattcactcatccatccatctatccgtctatccatctacccatctattcatccatccatcatccacctgcctgtccacccatttactcaatccacccatccatccatcgcttcatctactcatctatccatccacccatctgttcacccattatccatctactcatacatccatctacccatctatccactcactcgtccacccatctacccatccacccacccacacccccatccactcatccattcatccatccattcacccactcatccatccatccttcactcacccattcacccatttattcattcattcatccatcacctgccacccatctacccattcattcatccatccatccactcatccacccatccatccatgcattcacccacccattcatccatccattcatccatcccacccacccatccatctatccactcatccatccatccttcactcaccaatccacccacccatccattcacccatcacccttccacccatctacccattaattcatccatccactcattcacccatccatccacccattcatccacccatctatccatctatccactcatccacccactcatccattcatgtatcacccatccacccatctaaccatccatccatccatccatccactcatccctctttcaatccatccatctatccatccattcatccatccacccactcatccatctatccattgattcatccactcatccatcctgccactccatccatccactcatctatccctcaacttatccatccatctattcatctatccatccacccattcatccacccatccattcccttccatctttcctttttttttttttttaaagattcccagaccaagtatctctcccatagaagtcatccttgggtactaacactactattgtgtcccagagctggttccttctcgtgggttctcggtctcgctgacttcaagaatgaagccgcagaccttcgcagtaagtgttacagctcttaaaggtggtgtggacccaaagagtgagcagcagcaagatttattgtgaagagcgaaagaacaaagcttccacagcgtggaaggggacccgagcgggttgcccccattccatctttccaaccatccacccacatttaccaacttctactctgacctttagctattcactaaagaagcagaagaatcaaactcagcccctaaccttgtgaggctctccatcttgtagaggagacccacagaaaacagataaattatgaaccttcctagtaaggactattgaagaggccaaaacaataggtttgggggatttagggaaaggaaggccaaataggggtaggtcaaacacaatcgctgtctctgggcatgactttgcacccctgctcagctccccgccatcagcccatggaaacagatcttgctaaggtcaccagtgaccctctaactgccaatcccagagtcattcttctcactgtattcttgacctttcctttcctgacctttgacattggccattgctctgctgggttagggttagggttagggtgctgcactggccattcccacctctgtctgccagctaaggtggagtccccctaggcccctcagactcaacctgtcccaaaggactccatcaccaccttttcatcctctagcccaccggctccactgtctacccccatcaccttgacaaaaaactcaggtgtcatttttgacttcctgttctaattcccacactcatccagtcctgcccattccacatcagaaacaactcttgcccatcccttcctttccatccccacgcccgctgtcctggctcctcctttttctgagtttcctgacttccagcctcacactctagtccatcccccagtgttgatgactacagggatcacctctgagctccccagaccaggcctccccagacctggtcctgactgtatagtctctatttcctcctccccagcagccccttcagggttaggactactgaactcctattcgtctttcaaaaccccattaatattccctcctccaagaagatattccctcctggatctctgatgcctcagcctgggctcctacaggtcccagtcctgactacctgggggcctggaggtgtctacatggagctttgcttcccctagcttggcagctccttgaaggctgggcctaagaaactcctactcatccctcagggccccagctcctttgcccttcctacaggaagccttccctgccccctaggctgggcctaggtggagcgctcaccgcaggttggttttctgcacggagaagcagtactcgttgatgccagtggtgggcatgcggctgcggagcacgtcctgagctgtggggacgtagccctcctcggtgatgcgctccaggtgggacaggtagctgcagagcaaggagtcctgaggcccagccttgcagccagcctccctttgcttcccaggccctacgaaaggcccagcaaggaccctgctgggggaggagagctccctgggtggaggtggggtccctggagttggcagatggcccaggagcgtcccccacctgaggcaatggagccccaaggaaaagcagcttcacacgcagagcagggtgacccgagggatggcgtgacatgaggaatggcctcatcgaggagtggtgtcccccgggagagctgctatggcaggggtggcgctaccccaagaatgctggtagcctgggaacagtcttcccagacatcaagccaccttggacatccaccatcacacctagtacaggatcccactaggaatagggtcacccccagaacagggtctcccctggaacagagtcccccctaaaacagggtcactttaggaacagggtccccccaggaacagggtcactccaggaacagggtccccccagaatagggtcccctcagaaacagggtcactcccagaaaagggtcccttctaaaacaggggcactctaggaacaggttcccgccaggaatagggtcactccgggaacagggttctctaggaatagggttcccccaggaacaaggtccccccaggaacagggtccctccaagaacagggtcactctaggaatacagtccccccaggaacaggatcacccctaggaacagggtcactccaggaaaaggatcaacgccagaacaggatcccccaggaaatagggtctccctgggaacagagtcacccccgggaacagggtccccccagaaacagggtcacccctgaaacagggtcctcacgggaacagggactccaaggcccagggtcactccaggaacagggttctccaggaatagggttccccccaggatcagggttccccccaagaacagggtcactctaggaatacggttcccccaggaacagggtcacccctgaaacagggtcctcgcaggaacagggaaccccaggcacagggtcactctaggaacaggataccccctagaacagggtctccccaaggaactggattccctcaggaacagagtcactcctagaacagagtccccctatgaatagggtcattccaagaacaagatcaccgccagaacagagtcccaaggaacagggtccacccaggaacaaggtcattccatgaagggagttcccccaggaaaagggtcacccccagaacagggtcccccgggaattagggtccccctggaaggacctcatcctggagcaggaccacctcacagcccatctgcgcccacaatatctcctgctgcaggaagccagccagcctggcccctgccctcagcccctccccacgcgcccatcccccgcagaccccagactcactacacggctgaatcgagcaggtggaattcccgccgacgctcatagtaggcccggatgccggcatccctccacagccactgcatggccgcagcgtagcgcttctcaaacgtggtcactttataggggtcctggctcatgaccaggctagcgt

SEQ ID NO: 2085 - DNA, 6943 bp, Homo sapiens; identical to SEQ ID NO: 2084

SEQ ID NO: 2086 - DNA, 1366 bp, Homo sapiens
ttctgggcatgttttcctttggaagtctcaccaggctgagcaggacttagaggaactccggctacgtttgctgtcccaacaaatagaccaggtatagagagaacaggccctgtgagagggttccctaagtgtcgcttcctccaagaagccctccctgatgagttgagccactttagtttgtgctcaggctcaccctgcacgtcttggttgctctcatcactgtaatgatctaaaacacacgtctgctcatgagacccgcatcccacccccgatgctggggccgctcttggattttcatgcctgctgccagcacccagggggagctccggaaatgtctgctgggggctcggaatacccacctttctggtaatgcagcccagcgggtcccagcctcgttttccagccctcactcaaaatggagtcgctctggttcgaacgcctctgacaagtgtgtacctacgtgtcaggcccatccttcctgcaggcctttgtcttggtgtcaccctgcctgagctggccccaaccacagtagcaacagtgatgctgatgtgtgactgctgccaggagcctgctcacatgaccgtgtggagaaagttctttccctgaggaccatctggagtggacgcgtgcactacccctctctgaatacaccctccccacgaggccctctggagcatcctgtagagccagcccctacccagagaccctgagcccagagaatgcgctgggtggtgagcctggggacgaatgcagagccctaggtctcctctccagaaagaccggattttgccatgttggccaggctggtcttgaactcctgacctcaagtgatccacctgcctcggcctcccaaagtgcagggattacaggtgtgagccactgcacccggcctcaggcaggtatttttaccagccgaatactcttgcactgtgcactcttcgtgttcatcatcagtcccccggatgggtgtttaaggcatttccaaagctctgttattaaaaacacgatgcaatgagtttctttcagcatttccccttgttgccgtgtgaatgcgtccgtggtataacttcctaaaagtggaatcgcttggtcaaagggtgggtgcatttagcaacctgatggctttccaggagacaagtgctgcctcccggccacgagcttttaagaagaactgttgatggaacccgagctggagtcccagggaccggggcgagttctccatcccaggggattttcagatgggacactggggagaagctgccctgcccatctgaactctatgatcccagtactaacactggtagctgtgccatccccagtatagagacagcaccgtgctcttgggagggtgagtcattggcccccg

SEQ ID NO: 2087 - DNA, 1366 bp, Homo sapiens; identical to SEQ ID NO: 2086

SEQ ID NO: 2088 - DNA, 1329 bp, Homo sapiens
gtatagagagaacaggccctgtgagagagcctcacacttgctgcctcctctgcctggaactctctccctctgctctcacagggttccctaagtgtcgcttcctccaagaagccctccctgatgagttgagccactttagtttgtgctcaggctcaccctgcacgtcttggttgctctcatcactgtaatgatctaaaacacacgtctgctcatgagacccgcatcccacccccgatgctggggccgctcttggattttcatgcctgctgccagcacccagggggagctccggaaatgtctgctgggggctcggaatacccacctttctggtaatgcagcccagcgggtcccagcctcgttttccagccctcactcaaaatggagtcgctctggttcgaacgcctctgacaagtgtgtacctacgtgtcaggcccatccttcctgcaggcctttgtcttggtgtcaccctgcctgagctggccccaaccacagtagcaacagtgatgctgatgtgtgactgctgccaggagcctgctcacatgaccgtgtggagaaagttctttccctgaggaccatctggagtggacgcgtgcactacccctctctgaatacaccctccccacgaggccctctggagcatcctgtagagccagcccctacccagagaccctgagcccagagaatgcgctgggtggtgagcctggggacgaatgcagagccctaggtctcctctccagaaagaccggattttgccatgttggccaggctggtcttgaactcctgacctcaagtgatccacctgcctcggcctcccaaagtgcagggattacaggtgtgagccactgcacccggcctcaggcaggtatttttaccagccgaatactcttgcactgtgcactcttcgtgttcatcatcagtcccccggatgggtgtttaaggcatttccaaagctctgttattaaaaacacgatgcaatgagtttctttcagcatttccccttgttgccgtgtgaatgcgtccgtggtataacttcctaaaagtggaatcgcttggtcaaagggtgggtgcatttagcaacctgatggctttccaggagacaagtgctgcctcccggccacgagcttttaagaagaactgttgatggaacccgagctggagtcccagggaccggggcgagttctccatcccaggggattttcagatgggacactggggagaagctgccctgcccatctgaactctatgatcccagtactaacactggtagctgtgccatccccagtatagagacagcaccgtgctcttgggagggtgagtcattggcccccg

SEQ ID NO: 2089 - DNA, 1329 bp, Homo sapiens; identical to SEQ ID NO: 2088

SEQ ID NO: 2090 - DNA, 8025 bp, Homo sapiens
atttgcttctaggaaaattaactaagatagtatctgtcaggcctctgagcccaagccaagccatcacatcccctgtgacttgcacgcatatataagcccagatggcctgaagtaactgaagaatcacaaaagaagtgaatatgccctgccctaccttaactgatgacattccaccacaaaagaagtgtaaatgcctggttcttgccttaagtgatgacattaccttgtgaaagtccttttcctggcacatcctggctcaaaaagcacccccaatgagcaccttgcgacccccactcctgcccgccagagaacaaaccccatttgactgtaattttcctttacctacccaaatcctataaaacggccccacccttatctcccttcgctgactctctttttggactcagcccacctgcacccaggtgaaataaacagccatgttgctcacacaaagcctgtttggtggtctcttcacacggacgcacatgaaatttggtgccatgactctgatcgggggacctcccttgggagatcaatcccctgtcctcctgttcttcgctctgtgagaaagatccacctacgacctcaggtcctcagaccgaccagcccaaggaatatctcaccaattttaaatctggtaagcggcctctttttactctcttctccaacctccctcactatccctcaacctctttctcctttcaatcttggcgccacacttcaatctctcccttaatttcaattcctttcattttcggggagagacaaaggagacacgttttatccgtggacccaaaactccagcgccggtcacggactgggaaggcagccttcccttggtgtttaatcatggcagggatgcctgattattcatccatgtttcaaaggtgtcagaccacacagggacgcctgccttggtccttcgcccttagcggcaagtcccgcttttctggggaaggggcaagtaccccaaccccttctctgcttttctgggcaaggggcaagtaccataacgccttctctccttgtctctaccccttctctgctttcctggggcaagggcaagtttccctcaaccccttctccttcacccttagtggcaagtcccgcttttctgggggggcaagaatccccaatcccttatttccgcaccccaacctcgcatctctgcccctcgatcccttatttcggtgccccgaccccttacttctgtgccccatcccttatttctgccccccgacctcttatctctgcaccccaaccccttttcccacttttttggaaggtaagaacccccgaaccccttccctccgtttctatactctctcttttctctaggcttgcttccttcactataggcaaccttccaccctccattcctccttctactcccttggcctgtgttctcaaaaacttaaaacctcttcaactcacacctgacctaaaacctaaatgccttattttcttctgcaatgctgcttgaccccaatacaaactcgacagtagttccaaatagccagaaaatggcactttgaatttttccatcctgcaagatctaaataattcttgtcgtaaaataggcaaacagtctgaggtgcctgacgtccaggcattcttttacacatgagtcccttcctagtctctgtgtccagtgcaactcatcccaaatcttccttctttccctcccacctgtcccctcagtaccaaccccaagcgtcactgagtctttctaatcttccttttctacagacccatctgacctctcccctcttggccaggccgagctaggtcccaattcttcctcagcccctcctcctccaccctataatctttttatcacctcccctcctcacaaccctggtccagcttacagtttcattccgtgactagccctcccccacctgcccagcaatttactcttaaaaaggtggctggagccaaaggcatagtcaaggttaatgctcctttttctttatcccaaatcagatagcgtttaggctctttttcatcaaatataaaagtccagcccagttcatgacttgtttggcagcaatcctgagaaactttacagccctagaccctaaaaggtcaaaaggccgtcttattctcaaaatacattttattacccaatctgctcccgacattaaataaaactccaaaaattaaattccagccctcaaaccccacaacagcatttaattaacctcgccttcaaggtgtacaataatagaaaaaagttgcaattccttgcctccactgtgagacaaaccccagccacatctccggcacacaagaatttccaaaagcctgaaccgcagcagccaggcgttcctccagaacctcctcccacaggagcttgctacacatgccagaaatctggccattgggccaaggaatgcccgcagcccgggattcctcctaagccgcgtcccatctgtgtgggaccccactgaaaatcggactgttcaactcacttagcagccactcccagagcccctggaactctggcccaaggctctccgactgactccttcccagatcatctcggcttagcggctgaagactgacactgcccgatggcctcagaagccccctagaccatcacggacactgagcttccggtaactctcacagtggaaggcattacacctaaaagtaatttgagcaccttgagcttagagcctaccttggctaatgtgaaacactccagctgtgctaagatggtcctcaatagtcaacaagcacttctgaaagtctggtaggtgtgtgcatttgaatgaatcctcagtcttctctaattctgtctggaaggattcattaaaggcctttctcatgtcttgattaattgcccttcaaggataaattttcacgacatatagaagccgtttttatctacagcatcaattttactgctataaatgagcaaaatgagtgtcccatctctggacatacctggttatgcaagaacttaacatcccctgatgctttgtgaaaagaacatttaagatcttttgcccatgtaaaatggaatccatctattaaaattgtaccttgaattgctaagtttgaaaagatcatacaatatctcatctttggtttttgaactgcagaaagttaatctgaaatagttcaatttgggtagtagaatttccaaaagctgcccaaaagacaaaatctatttgaaaaaagaaaaaaaaccagcaaagtgggaacaggttaagttgtctttcctttcctttggtcagtatcattcagtttggattataatccatgatttctgaaatataacccacttcatttgcccttaaagactaagacctctattaaaagcagagcatttcttgtcattctttccattgtattgaccactgagcgattcattaacaattgatctgcatctccttaaaggaaaaaaaaaaccaggtcaataggaagtcaatctgttgagaaggaatagaggaaatatgtgatgcagcaaggcacatctgtaataagactggagggatgtaggcaatggagagaacagtgacatggcccctacaaaaatccaatttctgaagtcagacaaacagactaaactagagtttaacacagacaaacctttatgctagaaaagtttatttgccacctattcctgatttagccattgtgatttctcttttgcatagtgttttgaatggaaattcacaggttacaatgttaagaagttactaaagaacaattgaggacaacataactgaaaatggggtggtaaaaagaactgttaaactatttctttgagccttagtaaaccatttcccacaattattctaaattcaaattggtcactgatgacaaataagcaatactttcaaacaagttttgttctcctgtctaaaactctatttaacatttgagatagtcattagctaaaatagattctctgactcaaggcaacattaccttctgctagccttggcattagagtggttggaagaaggaggcttcatgttctgcagttgtcagaagaaaacaaaccacttaaatttataacaagttaccagctagaatctgttgtaataatcacagtcttttgtgaaaatcaatgaagtgcatggcattttaattcactatctctgatcctcaaggcaaccaagcaagttggtattatgattactctgtcttagatagaaatcaaggttcaaagaagttacatgtgccccacatcgaatagctcataaatcctaaagttaatattggaagtcaagtcttactatttcaaaactcatgctcaatctactgctaacctgtagtcgtctagctttaatttataatatacaataaaaccttacctggaactctaataagtaaaccagataaaataaaagaggctctggttgaattgggaggagaaagcctggagcttgactacttagattccttccccttttcccaaccctctctgtagcagcccccagtgctctgctctgtagcactgggggtggctacagagaggctctgtaggaaaccctatagttggccttctgttggggctcttcccagcaacatcttgctccataaacacaagcacctgtatgcatatcaggggtcagtcacaaactcggatgcttacaggtgccccaaacacaatcctgctgcacctttggagtgatggaagtttcttttcattccctagccatgagttttaaagttattggtctctcaaccaatggggtttttttaattgaattttaatttctgaatccaaattccaaactcagaatactgaggaatgatattaatagaaggccatggaaacatacgatagtcaataaaaagagaaagatctcatttaataaacatggtacataacctataaacttgacattctgcatttttgtatactgcaaacccatatacggtatatgtgctatgtgtatttcaaagtatagtatgcatgtacccaaacgtaaacagtcaaattaaattcctctaatatttctgtatgtattaaatgattttttgtaaaaaaaaaaaaaaaaaaagaaactatctgctaagaaattctcccctgacaatgctactcagggcagaatgatgttattttaaattcttctctcattaaaagaaaaaagagtttgcttcttcagagtttgtgtgtatttataccagagcttaactggcattttcattgtggtgtttatgaatcgtgatgcagttccactgcagctcctgacacactcattaatttgttcccagcggcagttcattaccaacatcacaagcaaaacatgcgctctccctgggcattgaaggtccaccggaaattaagcagacggggctgcaaagcacctcagagtgaagccagccagcttcatctgctgcagcaggctggaggcaagcacaaggagcggcaggaatgaaaggcttcagcgccttccctggtgtctctgtgccttctgagttttcagctgacatggagcagtgattccctgaaaaggatgggatcttgctccctcaaagatcagccttctttgatgagcctgctccaggtggagtggagcaaccactttagctttttagtgcagagaagacttaggaagtttcattttccttgactggggttctgctttctgtactgacccttcctggtcagtggggagctcggagctctgagttggagcaccttaccaaaatcttctctgagtggggttaagtaagccagcagactctgcaagaacagagccttgctgaatttagctttccagaaagccctattttaagggaactcagtatttcagcaagatgctggattagggggagaaaacaagtagtctgttaattctttgttgttgtcagcagccttgcaggttcctggaccatgacacatcagcacagtcctaagtaacagaagactcaggtcctcaccatgacctcaaacagcatgatctctgtgaatctcagtaaatcattctgagcttcactttccttgttcacaccatatagctatttatatctgctccacatgatgggcaaggtcactgggaagtgtagattatataaggcatgggaatggcttcacaggttcatgtgggacatcacatggtgaggcacagagatcagaaggtttgggttcaaatcagctctgccgagctggagaaaccatgttagtacttgaccctggtgtttcaaactcaaaatcagaataagattagggataggaaaaagaccacacgagatacttctgagttttaaatgatttatttgaatgaggtcaactttcgttcacttctaaaggaagatagaagtgtgagttttgtaattagcctagagaaccgggggagcaagaccctactgaacaagcctcctccagagctcgccccaaagtctggagtgcaaaatgtccacctcgttatgattaatgaagcctctggatatagatcagaagactagaaatgtctgtgaaaggagctcttccaggggctcagccaaaaccaggagaattgccctcgactcctctctttccttgtttctaagccatcggcaattttgctcagctccatcgtcaggaagtcccaaatcagaccactgctccctgattccacagcttccgtcctggtccaggctccataatctccccctgaacctctgaaagagcctcttaagcagactcctgccgctccccacccttgcttctcttgtctgtttcttcaagcagccaaagggatccctgttaaaatgttaagtgcaatctcatcagcctctgttcaaaaccctcagatggctttaagcagagtaaaatccataattctcaccacagccagggggaccttggtgacctcattcctccatgagggtatctccctccactctcctcatcccgttttctgttccagatgcactgaccatctagtcctacctgggaacatgaacaccaggaatgctgctgcctgggaagactttcactttctgttctttctgcctgaaacactccttcctgggaatccacattaatccatattctttctttgctagagtctgactgaaatatcatctgtgcagagaggcctatcttaccaccctattttaaataatacatgtatgtgtacgcacacccatgtgtatgcactctccatctccttacttgctttatttttctttattcactcatcatcttcttctatacatccattcatttactcttctatcgtctgttttatactcctgcccttgattagaatataaatttcctaagagtacagacttggtctgtttgattcactcttccagtgcccaaaatagtgtctgacacatatcaattatttaataattatttgcagatatgacagcatgaatgaattagatcagataatctaagaactgttttgcagtcatcacagggcactgtaataaagccattagaaaaataattaattgagcttgatgatgtagcaggtagtcatgactgtagctggcaggtcccagaagatagtcacattaactatgttgtcatgagaacaagcctaggttgtaaggctaaatcttctacgatgttgtagagaggcaacctcccccacagcaggaaaagccacccctttaatattcattatgaagcaaagagactaagtgaataatttacatgctacctgtgttctcctccatgctagccctgatatattttcaatattccattcctcttgctccctcagctctgtttcaggcagcaatttcatgccacgcagaatatgaatctaacaggtgaatttccatccagggtccaattctcttactactgatgtggagaaaaccgtaaacaaagccacagtaaagcctcctttttgaggctgagtaaagccagatgaaaggcaagagagactcagcaaaacatatttaggagatgggaaaataaataaattcctttaaaagttgcataatgttcaatagcatgtatccactgttacgtattcaatctttaccttgttgatgcattttccagcttacttttcattttcttcctcggcaaagctgcaataaacattctcctat

SEQ ID NO: 2091 - DNA, 2337 bp, Homo sapiens
ctaaattatcatacaatcagattaagttggtggaactaaaacagggcgcattacctcaaacagccagcatttacaagaaccaaattgatttttttttcttacaaaagtcaggcaacttccaaattaagtcactttttaccatataccctggagaataacatggcccgacacaccacacgtcccacttatctagttcaagcgagtaacataacgtgagaaactgcactgtgtaattcctttattttctgcatattagtgctttaccaacactacaaccataaagaacacaattccaagtactgtactttttagtttggggagatcacagtctacagactcatttacttatattaaacaagattaacctcattcaaaacttactgcagtttataaattcacataaatacagaaatggatgcaattaaacaacttcaggatcttatttttaaaattcttagataattttttctgcaggctataattacctgctccagtcaccaatggttattgttcaatttaactacatcaattataaacctcttatatccttaaagaaaattttaagtgaaaattacaatttcttaccaaaaggtttagggttttccaaatttcaaatatttgcttccccctcccccctttccagtcaaacatttcaaataaactaaaaataaccacatctcacctgcaacattcaataatagcaatcacttgatgtataaaattttaactatgcccccagttattttaagacacaaaaaaatggctgcctaccaatctgtcttcacaagttagaaatactacatttaagatttaacatgagggtttcaagtttcctccagtttaggcatttatacctttgtgcttgttttgtttcaggatgttactatagcattgatattggataacccatatttatatactttaaaatgcaatcatttgaaacactaaaaattacatttatggtggagctttggaaattttagaaagcaaccagtgttcttagatgtgtttatcagcctcatttctagagctctttctactaaagtgaaactgagaacttcgtactttagttgtatcctgaaatcaaaaaaatccctctgcaccaacaggagcctacatgagaatacccttttgcatctgctttaagtaaaatgtttgttaagagttttactttgaatagttcatttttttatagtcttacacttctcatacatctttggtaaaagctccattatacaatatggccaaagtgtgaaggaccaatactgtccaactataccatgatatcccgctcaattttagttttcagacaccctcataaacaaaacccactccaccttttcctgtatactgcctttgcagtctacatttctgaaattccctatttaattccttgaggatcactaaaattaatccttaaggctatataggaaccagatgctgctttacaattctgcatcaagcattaacatttggttcaaaatattatcatagtggtcgcaatccagttactggtcctaaccagctaaccaagtaatcttgttaggatctggatatcaccagcgagcacactgcttacacatgaagaaaaataagtttacattcattgtcatctgtaggttctttctcttcatcctacgtcccctttaatagtcatccctcaagtctacacatcattcattcatcacgcttccttccttaaaggagacagtgtactattgaaccaacaggatatcttttttattatttgcatgagttaatcctacaaacaaaattaaatacctcttttataaaacatcttttccagtgttctaattgatggagatgcggatcactcatctataaaaaatgacttacagcttcagcttaatcagttgctataatgtgaaaacaggaatgtgtatttttttcaactaggtaaaaggtgcatataatttgaattgttaaatgttttattaatgaacaaagtaaaccttttagtaatttttaaattactggtcttaggtgtttgaaacaaggtaaaagtatacattccagttttgcccaaaagtcacttaaaatatctacaaattatttaatctgtgtgtggtaacaccattattgctccaatttctggaaagagtctattttcaaagtttaaaaaagaggaaaaacagcaaagtggctaactttgcagtggaaagaaaaagtgtccttcatgggttacactttcatatttttatgcagcattaagttatctacgttatggggaacttgggttttattcctactcatgcatgatgtgtttcagaacttacttgctgacataggaaaatgaaagattctctcgaaataaaa

SEQ ID NO: 2092 - DNA, 1789 bp, Homo sapiens
tagtagattaattatttcaataaaacaataaaatttctatgagagggtaaatggcataacaatacactccttctcaagtgcagaacttgaaaacaccattcccaagcagaatataaatgcattttttggtgtattattctctgatatttcctcttttgaatagcagagaaagaagtatgtgtgtggcactgtggttaaatatggaatgcaggctctaaaggattccttttcctctgaaagtcttaacaggcgcctcacctttctctggttttccttctagtctcatgcaaagactaaacaacaacaatcaactcgataaaatagtgtccataggccagcttaggttaggctggttgcatggaaagaatgtgactgggaattcatatcctagagtcaagccagaaacttaatgattaaacaaatcacttccttgaacgcagtctttttccaaggttctgttagccatactctcaggaagctgtgaagtagggagatctacgtgggggtctctttgtactgagactcatcagcatctcggaaagcagaagggcctgaattattgcaggcacaagtgggaggctgggacagcatttctgacttcctgggagaagatgtcgaagacacaggagaagacaagccagggagaggggcttagagcagattctcccttgcagcctcagaaggaatcagtcctggtcacaccttgatctcagacttctggcctccagaatggggacttaaaaccaacatcccacactcataatgaaaacctggcaggaggcagaacaggattggagctgcttcaaagccttaggtccagagaactcatcacctatgcagatcctcaataagactcaaagctgattccgcctcagaaaccatggagacccaaagccaaattcaaagtgctgaaagttaactcatccaatcagtcaactcttgtacagacctcctttttttttgttcttggagtttgttttattctaataaaggtgttttatattgttgttgtattattcttaaataccatattttagttgctattataaatggtacttctattgccgttttgtctaacattttctggtggtcaaatttctagctagtgtggaagaacactgatggtttttacttattgattttctctctggcaatctcactaaaccttatgataagtaataaaccttatgatagtagaaaaggttgatatgatatgatagtagtaatcctctggattacccatcccctcttgataatctctgttgaaataatcacattatgtgcaactaatgacaatgtcactgctcttatagtctctatgtgcatttctttttcttgtcttactgctttgactcattcagttgactgccattcacagaacagatgtggaacggttgttttcgttatcatgtgcctaaaaagaatgtgattaaaatttgccagttcaatataatattggatgtagggttttaataaataactttcaacaaactgcaagagtcatcttccctttctagtattctaatggcactggttttttaaaaataataaattggtattgaagttgtcttatgcttttttctgtatccatttccattaagataattatttggattttttctacttttcattatatgatatattgaataattatattttctgaggctgaactctccttgaatctctgttacaaatgctgcttgtcatgagatactatttttcatgctgtcgttaaattagtaaattaatttttatttaggatcttaaatctacatatgtaagtaaaact

SEQ ID NO: 2093 - DNA, 411 bp, Homo sapiens
ttccaatacaaggttgaatgaaacagaatcttctggagaggaaagaagaaaccatgtctagacaaggtgctggaaagacccagggaagacacaggctttggtatcaggatgatgctggcctcacaaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcggagcctgttattggtctattcagagattcaacttcttcctggtttggccttgggagggtgtatgtgtcgaggaatttatccatttcttctagattttctagtttatttgcgtagaggtgtttatag

SEQ ID NO: 2094 - DNA, 1906 bp, Homo sapiens
gtgagggcggccctgggcctcccgcgggggaaggaagagatgaagccacgtgacagggcccaaagccgggccccgagcgcgccgcagaccggatgcgggaagtgggctcggggccccgctcccctgcccggctcgcccgcccgcgtcagctgacctggcttccgcgggccctgcgccctcgcgctcccgggccccggccgcccccacgccccacgccgcgcccgccggcccggccctccctccccagctggcccggccgccgcggcctcttccgcccggcgcccgcgcattcctgccattcccccgagtcggcccgcgggctacggccgcctgcggagcgcaggaaccttcacctcccgaggacaggcgccttcccctcgggacccggctcccctgctgcctgcgccgctctgtccccctgccgctgcccaagcctccagcaggggccaccgagggctccaggagcaccccaggcccgttcttctggcccacagcgcccctcctgtgaccctcagcgaccctcctgtcctgccctccggcggcgcggctgtctggagactctgcaccgtcgcggcctcgcagcctcgcagccccgcgccgggtggggaggggagggtggcgttcctgagtccgcggaggaaagggtcgcagctgcagtcgcgccagccctcgggcctacatccgctccgccgcgacgcggctcacaaactagggaggggagaagggaagaaagacccgattcgggaacacggctttgtccctggaactgtacctcatgtcccctcacttaatcctcccaagacctgtggggcgtgtcgtcattttagggctggagatgaggaaaccgaggctcggagagatgaagcgttgtacggccaccgagcggctgctttgcaacgaagccaaagccaacgttttgttcttagcggcggtcgtttgagccacgcctcaccgcaacgagtctgccatcagccaagagatggagtgaaggtacctgagcgcaggaaccatggtcttcattgctgcctcagcattagcggaagtgccacgggccggctcccagggggccagagtttcccaggaacaccattgagtaccactgaactagagtctgcaagttaaaagagaacttacttgaaggtcgatgttttctcttgctgattccatctcgctgccctcaagtcccttcacacgcaccgggtgccgggaacagactgcgtgggctcctccaggctccgccgtctgagtctctgctgctttcttcgggtgggagagagcacacagctggcgggacagacctgccattcatccctctgatgtgggatgcccgtcttggctgcagcctctgggggaggtgtgcacctgcacacacgtgtgagtgtatgtgtgtgcacatgtgtgtgctccaggaggtggcacatggcacactgataggtgaccttttgagttggtagtgacagcatcattttcaccagtggctccagtgaccttccagtcccagcggagccatctgaggtcacccagcctgctttgagctagtagctttatgactggcaaagaaatcctgcatgtttatcaagcaaattgaaaaacagcctgaggacaacgctatctgacttcaccgctgggtccagtccccagtcgccacgggtggagtgacctccagcacagtctcaatactgaggcagagggatttccgttgttctttgctttgttccctatatccctaaaagtttttaaaaaaattgtagtttacctaataggctccaaagcataggctttgttctgcaaagtgagtgaacaatacgtttttactgacggattgtttgattccttcaactcctcccttgattagccatagagggagcagggagtagttgtaccttcgaagcttgtttatgcaaac

SEQ ID NO: 2095 - DNA, 8749 bp, Homo sapiens
aaattccttctcctggctcatcctggctcaaaagctcccctgctgagcaccttgtgacccccattcctgcccgccagagaaaaaccccctttttcctttacctacccaaatcctataaaacggccccacccctatctcccttagctgactctcttttcggactcagctcgcctgtacccaggtgaaataaacagccttgttgctcacacaaagcctatttggtggtctcttcacacagacgcgcatgaaatttggtgccgtgaatcgggtcaggggacctcccttgggagatcaattccctgtcctcctgctctttgctccatgaaaaagatccacctacgacctcgggtcctcagacccaccaacccaaggaacatctcaccaattgtaaatcgggtaagcagcctcttcttactctcttctccaacttctgtcactatccctcaaccactttctcctttcaatcttggctccacccttcaatctctcccttctcttcatttcagttcctttccttttctgatagagacaggagacgcattttatccgtggacccaaaactccggcgccagtcatggactcaggaagacagtcttaccttggtgtttaatcacggggggacgcctgcctgattattcacccacatttcagaggtgtctgaccatgcggggacgcctgccttggtccttcacccttagtggcaagtaccgcttttctgtggggcaagaatcccccaacctcttctctccgtgtctgtaccccttctccacttttctagggggcaagaaccccccaaccccttctccttcacccttagcggcaagtactgcttttctagggggcaagcaccccccaactccttctctccgtgtctctaccccttctctgcttttctgggggcaagaaccccccaatcctttatttccaagtcctgacctcttatctctgtgccctgattccttatttccatgccccgacctcttatctctgcaccccaaccccttatttccatgccccaacccctttcccacttttctagggggcaagaaccacccccccgaccccttctttccatgtctctactctctcttttctctaggcttgcctccttcactaggggcaagattccgccctccattctcccttcttctcccttagcctgtgttcttaaaaacctaaaacctcctcaactcacacctgacctaaagcctaaatgccttattttctcctgcaatgctgcttgaccccaatacaaactcgacagtggttccaaatagccagaaaacagcactttcaatttttccatcctacaagatctaaataattcttgtcgtaaaatgggcaaatggtctgaggtgcctgacgtccaggcattcttttacacattggtccctcgctagtctctgttcccaatgcaactcatcccagatcttccatctttccctcctgcctgtcccctcagtcccaaccctaagtgttgctgagtttttctaatcttccttttctacagacccacctgacctctcccctccttgccaggctgagctaagtcccgaatcttcctcagcctctgctcttccaccctataatccttttatcacctcccctcctcacactccgtccggcttacagtttcgttcctcgactagccctcccccacctgcccagcaatttcctcttaaaaaggtggctggggctaaaggcatagtgaaggttaatgcccctttttctttatcggacctctcccaaatcagttagtgtttagactctttttcatcaaatatgaaaaacccagcccagttcatggctcgtttggcagcaactgagacgctttacggccctagaccctaaaaggtcaaaaggccgtcttattctcaatatacattttattacccaatccgctcctgactttaaataaagctccaaaaattaaattccagccctcaaaccccacaataggacttaattaacctcaccttcaaggtgtacaataatagaaaatgttgcaattccttgcctccactatgagacaaaccccagccacatctcccacacacaagaacttccaaacgcctgaaccgcagcagccaggcattcctccagaacctcctctcccaggagcttgctacaagtgtgggaaatctggccaccgggccaaggaatgcccagagcccgggattcctcctaagccgcctcccatctgtgtaggaccccactgaaaatcggactgttcaactcacctggcagccactcccagagcccctggaactctggcccaaggctctctgactgactccttcccagatcttctcggtttagcagctgaagactgacactgcccgatcgcctcggaagccccctagaccatcatggacaccgagattcagcctccaggacttggactgtgcaccaactagatgctgaaggctataactgcagccctaataaacaactttgaaaattgtggcagaccttattaaaaaaggggagcaggagccacggtagctcaggctggttgccctggcactcagggaggtgaggctacacgttagaggccaacctggtcaccattggttaaaaaaaggggagcaagtgagatataatagatgctctaacacataattatctctgttactagaaaattaactaaatgtgtatgctttactgatatggagttgttggaaaaatatttgtcaattaggacactaatatatttcctagccaggtcccattttattttaatttaccaatagtcaattaggaagcagttattatcagaacacaacaagatgataaaatgggttggaccaaagaaaatgggaagaaaaaatgatcatccttgataatgaccacaatcaccagagcacaggtatgcccaggcctccctctgtgtcccacccccatttcttttaatttatctgttagcctagaagaagaaataacatcaataattctatgcaatagaactctgtcatagaaatacataacttaatttaaaattttatattatctaaattaggaaaacccacactcataatttttcagtgttaaagttttctcatcaggaaatgtggctaataattactgaatggattgatacatgtgaagtcattagcacagtgcttggcctatatttaatatccagtaaagttaacagtcattattgttatctttccatggtggttgtaatcatcattatttagtactcactgttaatctattgaagaaagtgtaaaatgaaaagagtgcattaggattttacttctgtgggtttacattttttttttttaccagattgattggcgataaattaatgcatgtccagaatgattgctgtgtaaaattatgatgcacatgacatttttactttcaaaattgttatatcctctgtaatgaaatcttctgcctctccaagaaggtgtctctgattgggaaatttaacaaacccctctacccaattcagtgtccactcagccttggctctttcaactccctttcacatgtcttggagaaatagcttattctgttaattttagggttctgttcttcatcttgcaggcattgtaggagatgtctgagcagtattggtatatgactattaaaaactggtaacaggttaagagaatttttggtgctgaaatttgtagctctaaccaaggaattaatttgatctaaattgaactttaaaattctggtttttcttttttctttttttaagacggagtctccccctgtcacccaggctggaatgcagtggcacaatctcagctcattgcaacctccacctcccgagttcaagcaattctcctgcctcagactcctgagtagctgagattacaggcatgcaccaggacacctggctattttttttttttctttttttagtagagatggggtttcaccagttgatgaggctggtcttggactcctgacctcaagtgatccacccccctcagcctcccaaagtgctaggattacaggcatgagtcactgcgtcaggccaaaattctgtattttcaattagagtcaaagcccaaggatgtctctaccatcttgtagcccttgccaatagcctactcttgtcttccagggttcctccaaatctctctccaaatatttgttatctactcattcaatacccttcttcaaccatcctcttgctttggaattgacatgaaccaactaggcccgccttattggtaggaattcatttgccctgcctgccagcccccatagagacagaaccattgcctagtgaaagaagattttaatgacgtgatgaaaatattttagaaagcaccttgaagattagtatttttatgtaacttctgttggagagatgtcttcaggagactgaagtagaagagcgactgtcaaaatggaaagtcccagagacatccaatttatgtaaatcaacatcacctgaattcagaatctcatccagatttcaacaaagacttctgaatgccaacaaagaagaggactgaatttacagactctcactctaacaatatatgctgttcaatttgaaaacagaataaaattattttggcagaaactgatttttaatgacatatattgtttaaatgtacaactttttatttttacacatttgtggtaaaaacagtgaataaggaaaagcaaaggaaatatatcaatatggaagttttacttaatttgttcataaactaaccagaggcaaacaattttagtacttcacttattttttgtattatgttgattttgtgtttgatatggccaaaaatacctttctgatcaaaattatatattgatagaaatgacttatgtaggcaaagttttcatttttactgttacagacagtgtgtttgtatatttttacatgctgttcaataatttttagccatgttgatctcaatttcatttgactcttttagtagtgtccaccatcatttcagactattgaatatataagagactcctgagtataaaagtccttgcccaaataagaaaaggttgtggaacagaagagagaaaaacacatttgtgtgcactcaatcatctcttcttctttcgactcttttaatactgatataaccactatttttaacccttaatggatatgcaagcagaaccattttcctacttgttacgctaccatttttgtctcttcctgaaccataggagctagggatttagatgccatgtaagtgacaacatgagtgcagaagacacaccctgggaaccagcacaggtgtgtagacaacacagattaatctcaggtacctgttagacagaggtgttctctccacacatctgatctgaatcgtgctgagttcttgtatactaccttgatggcttcctgatacattggcatttgggatgcgaaaagtttttttgtgtcgtcgtgaacagcaggtgctggtgactccttgttgtgaagacagtgaaggactgtgacttgaaggacgattaacagttgcaacttccatgcagctttcttcaaagacttgttcgtccacaaactcgtgattctgttccacagttgtaagtaaatgaagaaacagagaagcacatttttaaaaacgaaatacatagctttatttttaaagctcaaatctgcccaagtatagttagacttgatacaatggttaaataaaaccattttcataaagattgacatcaaaaccacttctttttggcatttatgtggaactatctctgtagttaaacctagagattgacatctgtaggctgatttagtgtccctttatagactaactttatcttgaaatatcatttatttatttaaacataaaatctggaaggtatatgataaggaaaaaaaaaacctaaaaaatgcatatagataaaacccacagggaaattagaaattcccactgactttattttttaaaaaggttgaagttatggaaaatagattattttaataggatgccccaagttagattgtctgttatatattagcaaatcttttcacatgggagtgaaaacatttctaaattagaaaatgagacccctaagacactatccatttctttatatgttcctctaaaaatgcccagtacagaaaaatatgacttattcgttacataagtaaaatataattgtctgccgaatgtgtcactctgtgttcgacccagaagggattagcattgaacttttgtggccttttttgtaatcttcgtaatacatcactggcatcactggctgtactcatgatctctgtatgcatttggggtttttccgtcactatttcctaacttccagcccagtagcaaatagcaataggcatcatttcgcatatcgtattttatagaaacatggtatcaattttgcttttaaaatgtttgacaaaaaacctcctgaaatgcctatggaagaatttcacctcagaaatataaaggaaaacatttttggtctgaactactagagaatgacctcaattactattttgtttttctttgcatgggtggggatagtcttataatggaaggctttgcacataccaaattccacttaaccatctctcatcctaaaatatgagtaaaacaattgaagcaagacactggctaataagaaatagattatgttttagctactcgttttgtcatttctttgctgagacaagcattttgaaataaatgaaatttaacattctactctttaaagtctagagaataatataatcagacaagacagaatttcaaagaaatatttgaaattaatatttcaaatattaaatttcaaagaaaaaatggtgcacaaaagattcacaatctgtttccttctcttacaatgcatggtttcacatacctaagttataatgcatgagattctaatttgtctcatcagtgattgaaagtgcaggagtcattctgttattagttactacatacttttgtaggtagcataatttatattagttggtgttagtgatttttgattttaaaaaaagccctcaaaaaaggaaaatacagggaacagaaaagataggaataaaaatattttatttatttatttatttattgagacagagtctagctctttttgcccaggctggagtgcagtgacactatcttagctcactgcaacctctgcctcctgggttcaagcaattctcctgcctcagcctcccgagtagctgggaatacaggctcccgccaccatgtctggctaatttttttgtatttttagtagagacgaggtttcaccatgttggtcaggctggacttgaactcctgacctcagttgacccgcccaccttggccttccaaagtgctgggattacagacgtgagccactgcgcctggccaacattttattattaatgtatcatttaactttcaaatttatcctactaggttacagacctgtccatatctttatttaaaaatgcaagtataatcatgttactaccttgtttaaaacatttaaatgatttccatgaactaaagatcaaaattgtccacatggctgcaaagcctaacattatctggacactgcctttcccttcagctcctcttttgccatgctacactctcttcttctgaccactcttaaattatttcacttcctcctaggctgagttctttccttcttcaggtacttgtatcacctgttagccccttcattgctctgcctagctaactcctagtcaccctgcaggtctccactcaagttcctccaggaagccttgcctgacctgtcccctcatggctctgccctctttactctcttgactgtggcaccgttgttgctttccatgttcgctgctcttttccagtaacagccctgtctgggattttgttttataaacagaggctaaatggtagcagaggccacacctcatttcatggcgtttcttgggtctggctcactcttgggcacataataggcaagtagtaaatatttgctgaatgactctattggtaaataagtacatgaacaggcaatactttggaactgagaatacaaatcatgtgtcacccgagagtgagtgagctgacatgatccaaatatggtgaagattttgttctgctctgtgattatcatagattatgactcctatttacaaactggttaagaaattggtagatttgccaatgaggaggtccaaacaagagcttgtaagtggagaaatacagactcactccttagcacccaagggcataccagtgattacatgagtcatttttctaatgagaatagtttctattatctatctctattcattatggttgtgaatgaaacaaatgcttatattccattgttctctgttttttgttattgctattgctattctcttgatctagatgctagggaccctcgagcaccattaatttttttctgtctaattcgcattttaagaatcacagaaaatgatattgtgtaggatttactattggaagaccactcttcatctgcattaactgacttcttagactagagttaagacagcagctaagaataaaacattttaaataagtttctaaaatactttccaaattgaaatgtcattacatctttcaaagtaatttcaaatattgtggggttttggtttgtttgttttttagcatgttttccagtaatgcagacagtgaaatcacactcggaagcattaagtatgcacaaaagcaaatggaattactgtcagagagcaagggaaggcagtcatgctgtctccttaccgtggttttttccaggcagtgaagcaggtggtggtgctgggtttcaaagctggagccgg

SEQ ID NO: 2096 - DNA, 1938 bp, Homo sapiens
ctgatgctgcacgccggacaccaccaggctctgctcggagatcccacgcaggtctggggcctggaacaactcctgcaggcctgcccagggccagagatggctggtcagagctgcccttggcctcacaggctcctggagctgcttgggagggtgtctgagatcctggccagggaacagcttgaactcacagatacctgcttcattcctatccggtttccaagactcagcttaaacaccacctcctccaggaagccttccctgatccccagctctaaagtccaaccaaggtacattttcagtgttctcccaggtgagctggagagaagccctctctgtcttatcgcttatgctgtagtaagtatgtgattgctcgtctgcccaccccattagactcagctgtttgtacatggtgggctcccggtacctggtacagtgcctggaatacagcagctgcttagcaaatggctgaaggatagatgctttatttatttattttagttattataatttttttttgagatggagtctcactctgtcatccaggctggagtacagtggcgtgatctcggctcactgcaacctcctcctcccaggttcaagcaattctcctgcctcagcctcccaagtagctgggattatgggcatgcgccaccacgcccggctaatttttgtatttttagtggagacgggtttggccatgttggccaggctggtctcaaactcatgacctcaggtgatccaccctctttggcctcccaaagtgctaggattacagacgtgagccaccatgcccggcctttatttttatttttgagacaaggtcttagttcttttgctgaggctggagtgcagtggcacaattatggctcactgcagcctcagccacctggggtcaagagggcctcccacctcaacctccccagtagcatgcaccacacctggctaatttttgtattttttgtagggacggagtttcaatgtgttgcacaggctggtgtcggactcccgggctcaagcaatccacccacttcagcttcccaacgtgctgggattacaggcatgagccactccacccagcatttctttaacagtgtgacaccccagcttctcctccttccccttccagggaagccagcgaggctcacatgccatcccaggctctctacccagactctccttgcaatgcgaggtcttgggcagcaaagcagagccccattccccgggccaccccaacttcctctaggacagagggtctgggggctcatattcaaccctctccccgctcccgaagccctggaaaagagcaggacacaggacagctctgactcagctccactgccagccagacgcttcctccttacccgccctgcccagcctgacctcgggggctcgcccgcaccctcctccttacccagctggctgagggtggccaccaggtccatttggtgtttcagatacagcttaggcagccggaccttggtgggcctctcccacaccagagctttccctccacagcgcttcccagcgtctggaattcctgtgttgatgtccattcactgttgcactgtgtatcctccttcctaagagcagagacctggcctccctcatgctccacaaaaaccctagtgcttagaacagtatctggaacacagcaaatgcccagtatattttcactgaattactaaacctcaaagagcctggagcctcagtcctcctgccaggtaggatgggggatcatgggaccttttgcagttgcctgcctaggggacgtggaggcaaggaaggcgagacagcctccacccatccctgtgcctgctccacagcctgtccactcccttccccacctcccagcctcaggcccagcctgctggacaaccaagggtgacctggatctcaggctgctccagcaagaaccagcgcagcgggtacgtgcgggcc

SEQ ID NO: 2097 - DNA, 1938 bp, Homo sapiens; identical to SEQ ID NO: 2096

SEQ ID NO: 2098 - DNA, 4596 bp, Homo sapiens
ctggaaactctacctgcaaacataggaagcacgaacaatatatctgaacaattaaaattggcgtacaagggacatacctcaatgtaataaaagccatctatgacaaacccacagccaacataatactgactgaggaaaagttgaaagcattccctctgagcactggaacaagacaaggatgcccactctcaccactcctcttcaacatagtactggaagtcatagccagagcaatcagacaaagaaaagaaataaagggcatcatcagtaaagaggaagtcaaactgtcactgtttgctgatgatatgaccatttaccttgaaaaccctaaagattcctccagaaagctcctagaattgataaaagcattcagcaaagtttacagatagaagattaatatacacaaatctgtagctgttctatataccaacagtgatcaaatggagaataaaatcaagaactccaccccctttacaatagctgcaaaaaaaaaaaaaaaaaaaaagaaaatacttaggaatatacctaaccaaggaggtgcaagacctctacaaggaaaactgcaaaatactggtgaaagaaattatagacaacacaaacaaatgtaaacacatcccatgctcatggatggatagaatcaatattgtgataataaccatactgccaaaagcaatctacaaactcagtgcaatctccatcaaaataccaccatcaatcttcacataattagaaaaaaaatccaaaattcatatgaaaccaaaaaagaccccacatagccaaagcaagactaagtaaaaagaataaacctggaggcatcccactacctgattttaaactatactataaggctatagtcaccaaaacaacatggtgctggtataaaaataggcacatagaccaatggaacagaatagagaaccctgaaataaacccaaatacttacagctaactgatcttcgacaaagcaaacaaaaacataaagtggggaaaggacacccttttcaacaaatggaactgggataattggctagccacaggtaggagaatgaaactggatcctcatctctcaccatatacaaaaatcaactcaagatggattaaggacttgaacctaagacctgaaactataaaaattctagaagataacgttggaaaaacccttttagacattggcttaggcaaggatttcatgaccaagaacccaaaagcaaatgcaataaaaacaaagataaatagttgggacttaattaaactaaagagcttttgcacagcaaaaggaacagtcagcagagtaaatagacaaccctcagagtgggagaaagttttcacaatgtatacttctgacaaaggactgatatccagaatctacaatgaactcaaacaaatcagtaagaaaaaaacaaacaatcccatcaaaaagtgggctaaggacgtgaatagacaattctcaaaataagatataaaatggccaacaaacatacgaaaaaatgctcaacatcactaatgattagggaaatgcaaatcaaaaccacaatgtgataccaccttactcctgcaagaatggccataatcaaaaaatcaaaaaaaaatagtagatgttggcatggatgtggtgatcagggaacacatctacactgctgttgggaatgtaaactagcacagccactatcaaaaacagtgtgaagattccttaaagaaccaaaagaggaacgaccatttgatccagcaatcccactattgggtatctacccagaggaaaagaagtcatcatacaaaaaagatacttccacactcatgtttatagcagcacaattcgcaattgcaaaattgtggaaccaacccaaatgcctatcaatcaactagtggataaagaaactgtggcatatatatatgatggaatactactcagccatagaaagggatgaattaaccgcatttgcagcaacctggaaaagattggagacgattattctaagttaagtaactcaggaatggaaaaccaaacatcatatgttctcattgatatgtgggagttaagctatgaggacataaaggcataagaatgatacatcggactttggagacttagggggaagggtgggaggggggtgagagataaaagactacaagtaggtggcattgtatactgcttgggtgatgggtgcaccaaaaactcataaatcaccactaaataatttactcttataaccaaataccacctgtaccccaataacctatggaaaataattttttaaaaaaatatttaaaatatatattattttattatttatctgtggttttgtttttggccttaaaaacttctttatttgctattaatagagcaacacaaacattctttggttgatgtttgcattaaatagttgctctggtacatttcttagctcagagtctctcataaggccacaaggtttaactaaggattaagcttaaaagagtcctcctgtggcttcactggctgctgaccacggatattaggtctttatcctatgggcttctccattaggacagtttgcggtatggcagctgtactctctttctctttttcttggttgctgtgaaggaagtcagctgccatgctgtgagcttccattgaagacagaagtcttccttctaaatgccacgtgagtgagcatggaagtcaagccatgcaatgactgtcactctggctagcaccttgattgcaatcttctgagaggccctggtccaaagtcaccctgcaaaaccaatgcccagaattactgacatatttatttcaagctaataaattataggcgtaatttgtaatatgcagaaatagataactattacgtagatcaaatgaaaagattttccaatgtgtagaaactacataaattcttttcttacaggacaatcttattctaatcaataacatttgcttttaaggcagataatcctccaagttttctaatgatatctgaaactattaactgattctgtgaattatgaaatctgaaaaggaattggaagttgctaaaaatctatcatttgcattgaccagtgtgaagcacagtggaatgagaatgcgtgccctgacaccaaagaaaaataagtgactggaaagctgaagaatcaccggcttcagtgacatggaacccagtgatttgatttttgacgagtatcgggtgactttgaggtggtcaagaaaccacactttaagaacaatgtccaaaaaggggaaaaaaaagagcaaccaaagaaaaaaaatccataaaattgcacagaagaaaagaaagaaaaataaaatacacaatatggacgatggagaaaaacagttacatttctttatggatcaagaagtttgtgtacacataatctcattttgagatatataactatttttgtctttcagaagtgaatcaaaatatttcaaaatgctgtcttatgaaactacaatattctcacagattagaaaagtttttctgtaaaagtcagatagtaaatattttaggttttgcagtgtcttttgcaactactcaactttcctactgtagcacaagagtagctgtggtactgtgcaaataaattgcttgtgttccaataaagcttcatttacaaaaacatgccatgggccatatttggcctgtacactgttgtttgccaagtcctaatatagttgcttagcaagtattgtgagctatttgaggaagacatgaaagttcattgggttgctaaaaagtatgtagaaattcaaaggaaaattaaaatttaggctaagttataatacactgttttaacaattgtaaaatgtaagagaaatttacaaataaaaatcccaaataaaagtcttcttgtcaggtagattctgagaagcaaagaatagttaaaaagtaataagctacttttagtccttaaaagaaaagatgtttcttctgaatagctttatagtagttattaagattataacatgtgctgagcaaatcttagtagagggagaaataatatttttaacttgcatctaaagaatattagtagaaaatcttacatctggggaatggaaaatgtctcattaaaataaagagaggacatctacatccttttcattgactctaaaaacatggcttacttctttggaaaaggtttctggttgcagattcaaaatatatcatcagtgaccaaatgtcaagggttaagagatgttcaatgaaatgtggttagtgaaatgtcatgtggcagaattctgatggtgaaatgctataaaatgaggggtcatggcaacctgtggtgtgaaagaaaatgtcagtgatggaatagaacagtaaataaccctatcctgcttgttatctaaatggagacttggcagttcatttcattttcacctgatcacttcaattcctccctctttatgcacatatcagtgcccctttgctcactctttctttttcccacatatattttaagtgatacatttttaatgcttttaaaagttgaataaaaaatgatagaaatcctagctagctattttttttctcacaacaaaccctgctaaacaaaagatagtaagcgtaagatatcataatatgatagaaggttgtccttgagccaattagattctgg

SEQ ID NO: 2099 - DNA, 4596 bp, Homo sapiens; identical to SEQ ID NO: 2098

SEQ ID NO: 2100 - DNA, 4596 bp, Homo sapiens; identical to SEQ ID NO: 2098

SEQ ID NO: 2101 - DNA, 4596 bp, Homo sapiens; identical to SEQ ID NO: 2098

SEQ ID NO: 2102 - DNA, 2102 bp, Homo sapiens
cggttatgtttatttggttcagcagatagagaacgcatctctaaaaaccttttacttaccttaactagcaaaacttacaacatttacctttcaaaacatagtgacatttaactccatataaagtaaaaggaggttctttagtatcatggagtagaggaggggatttaaggatgccaacatgccacttctttcttgttaccacacctgtgggtcctccaaggctctccaacatttgcacatgattggattatgacaagaacagagaattatgtagcctgcctcttatttttgtccccttttcaactcaggtccaatgaattcagagaaaaagatctacgttaagaaaaaaatgcaaggaaacagaacactggcttttaaagcatttaataagtcaaaatcaaataaaagtgatttttaaaaagaataaatttacatacagtacataagcaagacagctgaaggtttctaaaatagaaacctggtgcatatggccccaaaacaccacatgctttgattacactcaggaagcatgagttgcctatttgggtgagaaaatcccatgttacagtgcgatcactgggcacgttttggagtaattccagccactgctatgtaagtgtttttaattcaggggtgtcttctacgttttcatcttctgaatatcttgtgacggtgcaggtttgagcaaaactggcatgaaatgagagctgttttagatgaagattgcaagatggatggcttggcccacagtggcagtgggttgggggtggaatgtggacaattaggaaaaaggcatgtcattctatctggctcctggagaggcagatagtcctgggggctttggtgtcacagttcccaaaagcaaggttggccagaccataggcttacattgtggtgagcttgccttttaaattaatctccaagatgccagatcgagagggatggtggacctagactgaagccaaaccagtagggggctctctttccccagagagaaactccaaatgtcttgaaaggagcctgaaccataccctttgaaggggcaagcaatggtctgagacagagagaggatttaacagagcaaagtgctgtgtgagaaatgaatggaagagggctagcaagacaagggtgtgaatcaggtaatgcctttttcaccccgatgaatttttgtctgattctcaccacagagcaggagtgctcagaaactgaggttggcgtcaccaatatacacttttcattctccagttgcagtaatcaaatactttaaaaagtgaccaaccatgacaaatccttggctcattctttaatgtgctgtggctgatatattcatcctcagcccaaattagttaagtacagccttaaatatatcaatatagctgatcggccttcctattgttgggacttaaaactagagacagcagtaaaaattatgtatatgatatatatatatatataaaatgatatatatatatcatatatatgagaggccagcacccactctgtgacaatgatcacaatccctctttttaaaaaatacaagtgggaaaagctgatccttttgtcagctggcttcagacaagtcaaccacaattatttggtgtaaatatccagtgttgcgaactctggctgggcagctgtgtggatgaaaatacagaaaagtgccgcatccggctgacagccactgctctgcaggggcagatgaaggctgggagtacctgtaagctaaggcccttcccctgagttgtgctgcaaatactgggcagagtttgatgtaaaagcagtcaaacggcaggtcatcttgatctttgccttctaactataataaatatgagaagaattttaagtaaaaacaggatgttttgctaaaaattctttttttttttttttgagagagtctcgctctgtcgcccaggctggagtgcagtggcgcaatctcggctcactgcaagctccgctcaccgggttcacgccattctcctgcctcagcctcctgagtagctgggactacaggcgccctccaccacgtccggctaatttttttgtattttcagtagagacggggtaccgtgttagccaggatggtctcgatctcctgacctcgt

SEQ ID NO: 2103 - DNA, 2102 bp, Homo sapiens; identical to SEQ ID NO: 2102

SEQ ID NO: 2104 - DNA, 2102 bp, Homo sapiens; identical to SEQ ID NO: 2102

SEQ ID NO: 2105 - DNA, 2102 bp, Homo sapiens; identical to SEQ ID NO: 2102

SEQ ID NO: 2106 - DNA, 10862 bp, Homo sapiens
gaatcacaaaagaagtgaatatgccctgccccaccttaactgatgacattccaccacaaaagaagtgtaaatggccggtccttgccttaagtgatgacattaccttgtgaaagtccttttcccggctcatcctggctcaaaaagcacccccactgagcaccttgtgacccccactcctgcccaccagagaacaaaccccctttgactgtaattttcctttacgtacccaaatcctataaaacggccccacctttatctgccttccctgactgtcttttcggactcagcccgcctgcacccaggtgaaataaacagccacgttgctcacacaaagcctgtttggtggtctcttcacacggacgcgcatgaaatttggtgccgtgactcggatcgggggacctcccttgggagatcaatcccctgtcctcctgctctttgctctgtgagaaagatccacctatgacctcaggtcctcagaccgaccagcccaagaaacatcgcaccaatttcaaatccggtaagcggcctctttttcctctcttctccaacttccctcactatccctcaacctctttctcctttcaatcttggcgctacacttcaatctctcccttctcttaatttcaattcctttcattttctggtagagacaaaggagacacgttttatccgtggacccaaaactccggcgcgggtcacggactgggaaggcagccttcccttggtgtttaatcattgcagggacgctctctgattatacacccacgtttcaagggtgtcagaccacgcagggacgcctgccttggtccttcaccattagcggcaagtcccgcttttctggggaaggggcaagtaccccaaccccttctctccttgtctctaccccttctctgcttttctgggagaggggcaagtacccctcaaccccttctccttcacccttagcagcaagtcccgcttttctacggggcaagaacccccaatcccttatttccgcaccccaacctcttatctctgcaccccaatcccttccgagccccaacctcgtatctctgcaccccaatcccttatttccacgccccgacctcttatctctgtgccccaacccctttgcccacttttctagaaggtaagaacccccgaaccccttccctccgtttctctactttctcttttctctaggcttgcttccttcactgtgggcaaacttccaccctccattcctccttcgactcccttggcctgtgttctcaaaaacttaaaacctcttcaactcacacctgacctaaaacctaaatgccttattttcttctgcattgccgcttgaccccaatacaaactcgacagtagttccaaatagccagaaaatggcactttgaatttttccatcctgcaagatctaaataattcttgtcgtaaaataggcaaacggtctgaggtgcctgacgtccaggcattcttttacacatcagtcccttcctagtctctgtgcccagtgcaactcatcccaaatcttccttctttccctcccgcctgtccccttagtaccaaccccaagtgtcactgagtctttctaatcttccttttctacagacccatctgacctctcccttcctccccaggctgctcctcgccaggccgagctaggtcccaattcttcctcagcctccgctcctccaccctgtaatctttttatcacctcccctcctcacacctggtccggtttacagtttcgttctgtgactagccctcccccacctgcccagcaatttactcttaaaaaggtggctggagctaaaggcatagtcaaggttcatgctcctttttctttatcccaaatcagatagcgtttaggctcttttttatcaaatataaaaatccagcccagttcatgacttgtttggcagcaaccctgagacactttacagccctagaccctgaaaggtcaaaaggccgtgttattctcaaaatacattttattacccaatctgctcccgacattaaataaaactccaaaaattggaatctggccctcaagccccacaacaggacttaattaacctcacctttaaggtgtacaataatataaaaaagttgcaattccttgcctccactgtgagacaaaccccagccacatctccagcacacaagaacttccaaatacctgaaccacagcagccaggcgttcctccagaacctcttcccccaggagcttgctacaagtgctggaaatctggccactgcgccaaggaatgcctgcagcccaggattcctcctaagccatgtcccatctgtgcgggaccccactggaaattggactgttcaactcacctggcagccactcccagagcccctggaactctggcccaaggctctctgactgactccttctcggcttagcggctgaagactgatgctgcccgatcgcctcagaaggcccgtagaccatcacggacgcccaacttcgagtaactctcacagtggagggtaagtccatccccttcttaatcaatatggaggctacccactccacattaccttcttttcaagggcctgtttcccttgcctccataactgttgtaggtattgacagccaggcttctaaacctcttaaaactccccaactctggtgccaacttagacaatactcttttaagcactcctttttagttatccccacctgcccagttcccttattaggctgagatactttaactaaattatctgcttccctgactattcctggattacagctatatctcattgccgcccttcttcccaatccaaagcttcctttgcttcctcctcttgtatccctccaccttgacccacaagtataagatacctctactccctccttggcgaccgatcatgcaccccttaccatctcattaaaacctaatcacccttactccactcaacaccaatatcccatcccgcagcacgctttaaaaagattaaagcctgttatcactcacctgttacagcatggccttttaaagcctataaactctccttacaattccctcattttacctgtcctaaaaccagacaagccttataagttagtttagttcaggatctgtgccttatcaatcaaccaacttgttttgcctatccaccccgtggtgccaaacccatatactctcctattctcaatacctgcctctacaacccattattctgttctagatctcaaacgtgctttctttactattcctttgcacccttaatcccagcctctcttcgctttcacttggactgaccctgacacccatcaagctcagcaaattacctgggctgtactgccgcaaggcttcacagacagcccccattacttcagtcaagcccaaatttcttcctcatctgttacctatctctgcataattctcataaaaacacacgtgctctccctgccaattgtgtccaactgatctctcaaaccccagcaccttctacaaaacaactcctttccttcctaggcatgattagcgcagtcagaattcttacacaagagccaggaccacaccctgtagcctttctgtccaaacaacttgaccttactgttttagcctagccatcatgtctgcgtgcagtggctgccgctgctttaatacttttagaggccctcaaaatcacaaactatgctcaactcactctctacagctctcataacttccaaattctattttcttcctcacacctgacgcatatactttctgcttcccggctccttcagctgtactcactctttaagtcccacaattaccattgtttctggcccagacttcaatccggcctcccacattattcctgataccacacctgacccccatgactgtatctctctgatccacctgacattcaccccatttccccacatttccttctttcctgttcctcaccctgatcactcttgatttattgatggcagttccaccaggcctaatcgccacacaccagcaaaggcaggttatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagctggaggatttgccccacccaggactggcaaattagttttactcaacatgccctgagtcagataactaaaatacctcttagtctaggtagatactttcactggataggtagaggcctttcctacagggtctgagaaggccaccgcagtcatttcttcccttctgtcagacataattcctacagtctgataacagatgagcctttattagtcaaatcagccaagcagtttttcaggctcttagtattcagtgaaacctttatatcccttacggtcctccatcttcaagaaaagtagaacggactaaaggtcttttaaaaacacacctcaccaagctcacccagcaacttaaaaaggactggacaatacttttaccactttcccttctcagaattcaggcctgtcctcggaatgctacagggtacagcccatttaagcttctgtatagacgctcgtttttattaggccccagtctcattccagacaccagaccaacttagactgtgcccccaaaaaacttgtcatccctactatcttctgtctagtcatactcctattcgttctcaactactcatacatgccctgctcttgtttacactgccggtttacactgtttttccaagccatcacagctgataatctcctggtgctatccccaaactgccactcttaactcttgaagtaaataaataatctttgcgggcaggactatgctgaatctccttaggcactctctaatcagatatcctgagtcgtcccaattcttagaccttttatacctgtttttctccttctgttattccatttagtttctcaattcatccaaaactgtatacaggccatcaccaatcattctatacgacaaatgtttcttctaacatccccacaatatcaccccttaccacaagacctcccttcagcttaatctctcccactctaggttcccacgccacccctaatcccgcttgaagcagccctgagaaacatcacccattctctctccataccaccccccaaaaattttcgccgccccaacacttcaacactattttgttttattttgcttattaacataagaaagcaggaatgtcaggcctctgagcccaagccaagccatcgcatcccctgtgacttgcatgtatacgcccagatggcctgaagtaactgaagaatcacaaaagaagtgaatatgccctgccccaccttaactgatgacattccaccacaaaagaagtgtaaatggccggtccttgccttaagtgatgacattaccttgtgaaagtccttttcccggctcatcctggctcaaaaagcacccccactgagcaccttgcgacccccactcctgcccaccagagaacaaacccccttgactgtaattttcctttacgtacccaaatcctataaaacgcccccccgacacttatctgccttttcggactcagcctgcctgcacccaggtgaaataaacagccatgttgctcacacaaagcctgtttggtggtctgttcacacagacgcgcatgaaactcttcataacacaggttaaaatatgcgttcttttcttagccagggtgacttcatgcagggctgttcttcatgttattaggtggcctttaatatctttgaaatatggcacaattagaagcctgaaccttactctaatgtttatagcagcactttatcaaacttggtttcggatcatatacaaattctgacactagagggagtgcataatgtattacagaaagggaaagcatacacctaataaattcaaggtaaaaatgcagagtagcaagacaagactttcattatcttccgttcagtaagccccatgcctttcccccacaaccccgaaattactagaggcctctttcccccttagaactgtagtttgaattggtaggaggttggtaggttgcttgaagaactgtgaaaagagtgttttattttagagcctttctagtgttttgttttcatttttaaaaaattgagacatagtatttcctacctctcatacattagatggcaaaattaaaattactcctggccgttttgttctgtttctgacttggttaagatgcttaactatatagtaatgtcacctatagaatgaaaagactcgggctttatcctttgcttaaaaaatgtagtctagtcttatgaaagggtaagcattgtttttagcattcagcttcataatttattcccttactataggtgctgctctgataatttaacagccaatgtcaaacaattaacaaataatatttaaggcatttttatttcctaatgtcaaaaatttctcatgctctaaccaaatggaatgcctaatgcctgaaaacatgtaaatgactacaaatatgactgagctattaacacagcaacaagagattcgactggctgaaaaagtgaatgatcattgccaccagtaagactcaacaactgttctcgaaaaatgtgatcactgctgtgtgctttcctaaaacctttttgtgtattcattatacattccacaattatcgtaaatccatcttgtactcacacaaatctttgaactaccggtaaactgtctctttaatggaaatgaaaattagaaaaattaaaaagcaggctcattatgaaaaatcctgtactttatccagatgaatgaaatgacccacacaaatgaaacatccagactcacattaccttttcctaaaataccgaaaccatgtctctgactagggcatatttgtacagacttacctgacagagagccttttggttaatgatatttcaccataatgacttctggaaagttaaaccagatttcaggcaatagactatgcagggtgtatgtgtgtgtgtgtgtgtgtgtgtgtgtgtgtgtgtgtgtccatctgcatatatgtatgtgtctatgtgtgtgtgctgtgtctgtctatgtccatctgtctgtgtgtatgtgtctgtatgtatgtctacatgtatatgtgtatgtgtgtctgtatatgtatatatgtgtgtctgtgtgtatgtttctgtctgtgtgtgtcatgattttttattcaaaagcacacaagtaaacacatcatgagaagtactatttcaacattacagttccagttaaaacacatatgaatcaatttacacaatatcacagtttctagatagcaaatatcatatggagcaagtttgaatcctgccccatgtttggatgaatgccagatattttactcttgcacacaccaaataatgggggtgaggatgcagcagattctacggctcttcagtctgtggtgcccatgcacgatttctacctgttttcaaaggttctcacctttgtgttgccctaatgatgtttgcctgtgctttaatcttattaagtgcagtttgagtgtgctgatgagcccagacactctgcctaaattggtcacttgatttttccccacctcttacacctgacactctctctatccaccaccacctgtgatcaagcttctcttccccccttggtgagtatcataaacctttctcacttttcatccacacattacatttacttattttcaaactgttgtacattgctcatatatatttatctttatcattcaattgaaatgttttcttttcacctgtaaaaattggttagatatattggattgggatgaaattaatcataattttccccattaaaaataatttttcatgtaacagctttcacttagtggcagaattttcaggaattaattcaaaatggtaagaaagggatacacaaatattgaaacacagagcaccccaccggacaagtctggtaagtccactcacattctccaggggaacaaagggcaagcctgggagagaagagatgaagtacccaccctctgcattagtgtttatggtattttattttttttctttgagatggagtctccctccagcgcccaggctggagtgcagtggcatgatctcggctcactgcagcccctgcctcccaggttcaagtgattctcttgcctcagcctcctagtagctgggattacaggtgtgcgccaccacacctggctaaagtgccatgttggccaggctggtctcgaactcctgaccgcaagtgatctgtctgcctcggcctcctaaagtcctgggattacaggtgtgagtcacaagtgtttagtattagtgacagtgcctcagtgttgcagatggtttccagagttcccagaatttttgttttggggatggggtggggagttgcatgggagaaagaaaagtgtctcaactcagaatcttggggagattcaggagataattggataaccagacaatccccacagatatctttagtgattttttaaaaattactttattttcttaatttttttactctttacaactatgttggtattctgtttctagactgtgatttaggttaaacacaaagtttatttagtatttgtttacccaattatatcatctttacacataaaataattttataaaaacattaaaattactaccatttgtaacctgagtatcatgattttatctatcctatgtacaggattcaaaacataaaaagtttcccaaaaaaactttctgtcaaacagtaggctggttagcatcaatactaccatagaaatccagtctggcctgatcttttatcctcagatctctagttgtatctgaaatggaatagataccccaaaagtagaaaatactccttattagatgcattgtgtgagaaatgattgtttgagatgttaaggaaaacaacactatttctgcagcaaatctaaattctaaacatgcataagaggatgccctatgttggtctgcaaagaaacaggttgaaagaagcaccacactattgttctgtccattaaaaattaatcaacagtggtgaagaaatgcttttactaacatagaaagatgtttacaatacactgctgagtgggaaaaaagtaagttacaagacagaatctgtgtttttcttagagaaaaaaatgtatatgtagcaaaatgtaaaaaggagctctctatagtataattatagatatttttatcactttcttctgcttatatgtatttttctaagtttttttatataatgagcatgaattacttgtttgatgctttatgtatgaagtttgaaaactctactagctagtaatagcttgatactgactttgagtaaggtttagaccagtgatcttcatccctggctgcacacagaatcacttgggaagagggggttaattatgaccccatgttgtagaaaagggtgggaacagtaaccaattaagtcagaatcttgctggagggggcagggaaggagcactgtttttatttatttcttgttaagttccttagacaattctaatatgtagtcaaggataagaataattagtttcaacagtatcggtcacagtttatgatcagattcaccagcgaatgttatctgaacattcccattttacttctccctgaatactgcctaacttagaatcactggcttttctaacttgaagacagcttagttcaattctgatgatcaaatgtgttgatttcctattgtgtgccattacttgctaggttctggcagttgaaggtgaatagcacccagaccctccccttactgagtttgcattccccttatggagcttgcattccagtaagggaaacacactgggggaaaaaactgctgcaatacaatgccgttggttgtatgatagaagcatgcacatggagaactggggggatatggtgagaggcacccacttaggggggtttggggagatctgcctggaggagaggatcatgtgttccccttggaaggtacatgactggttcaagatcacacagacaagtgtgaggggccaaatcaggaacagaaccttgctattcaacacctactcctgtaccatttgatgactccgacaagctgagacaaaaggcctgactcaagggtacagagaacaccctcccttctagaatatccccttcctgtacacgcccacacatgtgaaataaaccacagaagtatcagctgtaagatgttattaatgaaggcaggcctctcaggcattctgacctggcacaaaagttgtcagattaatggtattagaaaatttgcaaatcaaatggctcattatgtatgatactgtacttgcaaataggattaggttgattatgcactataaatagcatttttaaaagactccctcaaggccgattgggctgatatcttgctagtcagattttttttgaataaataatatttgtacatatttatggggaacatgtgatattttgatacatgcataagatgtgtaataatttaaccaggctctcaaagtaaagggttactgaactgctaaacagatgacaccttgtagtcagagcttagctgcccagtgtagtgctggagagctagggtttggttcgtgattgcctttagagacatcttttcactaagcctctggtgacagagccttgatcgttttagcacctggacaaagtgatcacagggggcttctgtcatgcacaatagagccagtgctgcagcctgagacaggcttggccacaggaggccactgcccaggccaggagagcaactgcattcctagaggaatgaaggcaagggaatgggagaaatccaagaattttaaaacacatgataaaatgaagaaataagacaatgaaaaaagacatcaatttcttttttttctttctattaattctacagtttca

SEQ ID NO: 2107 - DNA, 3721 bp, Homo sapiens
cagctctgccaggccagggagggaggggaatagagagcccagggaatgagggcgggactggggggggggggcggagcagtgggcggggccatggggctcaagggctgagcaaatctgaacagcaggcagtggacgtagtcatggggctcaagggcggagcaaacatcaacagctggtggtgagcggggtgacaggtggactgaggaaggcagggccatgggcttggaggcgggacacgcgtcagtagcaggtggcggcggggctatggagctcaaggatggagcaaatgtcaacaggcacagatgatgggaggtgaggccatgggtctaggggtggggcaaacgtcaacagcaggcagtgggcagggtcacaggaagcacaaacagtggtgcgtgggtctatggcctgggggcctggcaaatgtcaacagcaggcggtgggtggggccacgagaggaacaaacagcggtgggtggggccgtggggctcaagggcggagcaaacgtcagcagtaggctgtgggcgggtctgtgcagggcggcgctcaccgtccttctcctcgatgtccacgagcttggtgatgaagtccttcagctgcgccacgccctggcgcacggtgggctgcagcggctccatccaagcctccttggccctggaagccggcgtgtccatgttgcccacgttctggactgcctggaggtgacagcaggaaggaccaggttctgctaggtttaactgacgctgctgcactggataccccaccccggtgccgggcacataggtgcagcctgagagtaagcagacctgggttggaaggtcccgcgattcaccaccgacaggatgggcggccttggcaacccccgacccctcgcaggcctgttcccttatccatgagatggaactcggacaaggtggccacaggaaggctttgcaaactgtgaagtgcagtgcctacgtgggcgtgccagtggcctcgccggagccggtagggaacactctgcagtccaggccagggccccggtaggacacccagctgtgcatcccgcccgtggccgcaaggcccgcaccttggccaacaggagcagggtgcggctggtgcgggcgtccgcgtggcgctcccgcaggtggaagagcttgggcgacatgatggcgggagagaagaagcgcaggcacaggaagctggtgacggcgatgaacggtacattctggaggggtgcggaagagcgcgggctggagtcccccagaccagggctcctggcagccccctccccttaggctccgtccctgaccctcgccgggacacagcctccctggtcctccccagcgctccctggttccccaccgctcttcgcccgcccctcgccccagcccagtccaacccggcccagcctagcccagcgggtggagggcgcacctcgtgctgggcgccggggaagcgctcgcgcacgcgccggaagagctggcggaaggtggcgcgcaccacggcggggcacgcgggaaccgagcggctgagcgcgctcagcagggcccccaggtgggcgcgcagcgtctgcgcgctctgctccagcacctcggcctcggtctgcgggcggtgcagcccggaacacctgcgtggaacggggcgggttggcagaggaggtcacggtcagcgccagggccacgacaggaacagtggctctcacagcagccgggacacggacacaggggacaatacacgggtgggcagaagcacaaacacacatgctgacagggcctgatcccaacccgctgccgctgcgccccgcacccccccggagttacccccggcctcaccctacatccttaacttccactttgctggggtccagctccacgtacttctcctcaaacaccttgttgatgatggggcccaggacgccgtgcaggtactgcatcccggccacctggggaccaccgcaggtcacattgatcctgtctcccccagtcccactccagctgcccaccttctcccggcagccgcccttgcaccgtttgcctgccgtatccgcccaggagggggacaggtacacaagcagggcaaactgtttattcatgaatgaatgaatgagtgagtgaatgaatgactagaattcttagcccttgtaatcctagcactttgggaggccgaggcaggaggatcacttgaggccaggagtttgagaccagcctgggcaacatagtgagactgtctctaacttaaattttaatcacacacacattcttttggggggggggggtgcggggcacggagtctagcacggggcccaggctagagtgcagtggcgtgagctcactacaatctctggcttctggttcaagtgagtctcctgcctcagcctccccagtagctgggatcacaggtgcccaccaccatgccaggctaatttttgtatttttagtagagatggggtttcgccatgttggccaggctggtctcgaactcctgaccttaagtgatccgcccgcctcagcctcccaaagtgctggaattacaggcatgagccactatgcccagccacattcttaaccttaaagggctctcaatatggagatagaacactggagtcgaagtcccagccccctctgtcgctctctctgaagctcagtgttgtcatttgcaagatgaggacaatatagcatgcaacctcaccttcagaaaagactccatggactttgaggccagagagttgctccggaacagggtgttggtcttttgttacttggtcataagtaggcgttttccttttgatttggttctaggaggttagtgtgcattggcgttctgttgcctgcttccagcccctattctcctgcctcaggttcattagaaaagactgagtttggggccgggcagggtggctcacacctgtaatcccagtactttgggaggccaaggtgggcagatcacgaggtcaagagatcgagaccatcctggccaacatggtgaaaccctatctctactaaaaatacaaaaattatctgggcatggtggcacgtgcctgtagtcccagctactcaggaggctgaggcaggagaattacttgaacttgggaggcagaggtttcagtgagccgagttcgtggtcactgcactccagcctggctacagagtgagattccatctcaaaaaaaaaaaaaaaaaaaagaatgagtctggcccctttttgtctttctctcatcctctttgcctttcaccatgttatgatgcagcaagaagcccctcatcagatactagtgccatgaccttggacttcccagcctccagaactgtgagaaaataaatttctgttctatgtaaattacatagtctgtggtactttgttatagcagcacaaaacaaacaagacaacaagcaacaatcatgtgaacagaaagaaaaatgggcataacaaatgaaccatgtttttgtccaaattaggttcacaagcccttatctgcaccatccagactcaaacaccttaagattttggtagttcatttggtagcaaaaactgaccttaattgtcatgaggatatttagagtcgtcttatattccacttagctgattattcacacatatcacacacttagctgattattcacacatatcacagcaaaagcatgaacatgtctgattaccagttcctgtccagatcctgtgataagggcttacccaggacatacatggtataacttttctgaaatcttagattgaattccaaagc

SEQ ID NO: 2108 - DNA, 3721 bp, Homo sapiens; identical to SEQ ID NO: 2107

SEQ ID NO: 2109 - DNA, 2534 bp, Homo sapiens
tcgttgcagagtctgtagtagcgcaggtcgttgaccagcctgtgcacattctgggtgaatgagggcaggtcctggaaggcaggggcatagctgcagccaacaacacaccaggtcacccacccaccagaccccaacagctacttccatcccagagtgtgcactgaagataggggagcactttctaaaactcaaaacttctattcactgttgcactgcgtgtcacagagactctgtgccaggcgctgtgggagaaaaagaacaagaggaatacgtccctagggcctctcgggtgccagacactgctgcaatcaacatacagacatcaactcactgagtcctcaccacaaggctgccaccaagccctaccagaaccactagtctaaggacagaaagaccaaagcgctgcaccatgaagaagctggccccagctcacactgaagagaccagcacacttgctcctgagtccggcccctcaaacgcagacatggctgtggtgacagccctcttcttcaccatggccccttgaggtgacgcgcacaccgagcaatgtctgcagaacctttacccacggggctccaggccgcccctgcccctcgagagccacccgagcagcagcaaacacagtcccaaggcctgtcccactgggcgcagcgtgggccatggaaggccctgggccagaagtgaggccctgacctccgccatcatgcacacggtgagaccctgctttttttttcagtgtaggtcccggtgaggactcaaacaggcccagcaagccccagcagagccatgagcaggaccaagttcattttcctgcccaaccactattcctcttccagaactccattcaaagcctgcctcttcccaaagtctgcacagatgcctcctatttcctggccccagcagccagctcagcgcctctgtcctgagcaatctgcttctggggagtgtgtgcaggctctggggccagaacacccaggtctgcctcctgcttcgcagctctaccacttccaagttctgtgaactgctcaccttctgagcccccaccatctgtgaaatgggggagtaacaggacccacacttcagaggcttgttagaaggcttactcgagccaagacatgtcacatgcttggcactatgtggtccacagagggtgctgtattggcctgtctaccatgaaagacttggtgaaggctgggactggtgccccagttcctggcccggggcttgagaagcagctggcttcaaacacacagtgcgtgactgaatggaaggtggtgattcttttattttaccctcaaaaaaccaactaagggatgtcttttaaatcagtggctcccaaatgccaaaccagaatttcctgggtagaacacagaagtctgtttctccatttttaataagtaccccaggtgcttctgatataactagatttttttttttgagacaaagtcccactctgccgcccaggctggagtgcagtggcacaacctccgctcactgcaacctctgcctcccgggttcaagagattcttgtgcctcagcctcccaagcagctgggattacaggcgtgtgccaccacacctgactaattttttttatttttagtagagacagggtttcgccatgttggccaggctggtctcaaaccccctaacctcaagtgatccgcccgccttggcctcccaaagtgctgagattacaggtgtgagacaccgcgcctggcctataactagattttgaaaccacagctttaaatcaaaaagttgactgatattgatgtcgttagaagctgatcattaagtattaggatctggcctctagaaaaaggaaaaaacatatccaggggctgaagtgaactggaagaggcttaggagagaacaagtcccaagaaaaggaagaccccaagacaaaggagaacaggatgagtctaagcaaaagcttccctgccacacgtggcaaatgaggaaagcaggcggccaggtttgcaccagtgagagcagtgtgtgcatctgagcactacggtggagccgtggacaagctgcttcacagaggactcaggtcaagaaccccaagaggaccagggagaaagcgatttcttttcctaatttcatcaagtataaaacggtacaaggaaaagttcccagaagttcctatcaggcaagagagaggcctggtcacctgacacaggaagaagagaacaggtgagccccatggggaaggaggtcccaggcactgtcaggctccaacaagatggcctcatggacaccaagagccagcagcacccagctcccaccgaggtgctgcacgggtggggacagcccacctgacagtccctgcacaggtggcagcagtgggacaagagggtgagtactaggagggctcctcccaggacctggcagcaactcagcccaagctgagctggggctggtctggaaagagcccaagacagccggggaacctgggtcccacctctaaccctggggacccagaagtgcagctcccaagcaccaaccatctcagcctgaatgcaagcctgg

SEQ ID NO: 2110 - DNA, 6556 bp, Homo sapiens
ggcaacgccggaactcccggaactcccgtggcccgcgcctcccctcgctcggcgcccctcacgccacgacctccattcccggctctcctcgcggcgcggctgggtcgttgccaaggcgataagggagggcgccgctagctcctgaagcgggacgtgaactacatttcccataaggagcctcgacgtggggccgttcagacttggccaatggcggcccaggaacgggaacgttcgggcgggccctgcgtggggcggggcttccggcgtcggctttcggcgctggctttggggcggtttgcggcagtgggatcattgggcggtgggcggtgtggaggagtctccgctggtccgcagaaacgaacgaaggcgcgagaatcgggaagttctgcctcagtgacctgtacgcgtcctagccgcagtgaatgttgctgaaccccggtgacctcacagtggaggggcggccccatggggccatcggaccgcgccgcgcgggggcgttcgccagggcctccgcagaagcccgcctgtgcccgcaaccgccccgaaattctctccctggcaccgtgtccgctttacggagcccggagcaaggctcagaaaaatgtcccagccaaaaacatggtacatgcctgtcatcaggcaagtcttcaaagagcggctgggaccaggggccgagggacctcgtttagaggcggcttagggggaaggtcagcagttgtgtttcagttgtgttgggttttcggcgccccacaatgcgggcgacgtatgggccacaggtgtggatgccagggacaggtcgccctgcacatggctgaggcacggtaggcttgtagtctaccccatatcaggccatggtgatctcaggtatgggggcctgggagaggagagtgagtacatggctgagtacgtcagagcacggggtcagggacacatcaggggaggacgctggcaggagaataaccgggctcctgggtgtcctccgctgaattcagacgcgttcatgttagagcaggtgggcctgcgtcctcccggacgaacggagttcttaggcaaggtccagaggagcttctacctgaagtggtgctggagaactttgcactcagtgctgggtgagaccactggcaccataactctccccagcctcaactctggtttttttcctctgttctttccatgttccccttggaagtcgctgttggtcgtggcactgaggcccagatcatgccacctcctctaacaagtggctgagtggacaccccacacattctacccaagggccgtgagtggccaagatcggggctcagaagtctctgaatcttcacagctggtcacgttcagctcggtcacttcctgtctgtgtttgtcttggagtaaggattattctcgcttgctggggtcatggtgttttggcctctcctggcctggactctcaaaaactcatcatccttcataggtctgaaggcttctacattcccaccagcaggtggaccatatgaactcaaaactagttgtggcagagggaccctgaagagatctacccctggtgaatgcccccaggagtgggctgttctcacacctggtgcccagcctgtgccctcgcaggtcttggtgcctccactcagctcaattccagttttctggccatgccccgctgtgtccctttctctctccttagtgcctagctgtgcaatgtttgcctctccttaacatgtcctcagctgaccccatatcctcagtccttgcaaccctgttcctcagtgacacctgtgtattctctccagtggagacacaggtgggacacccccaagctcatggtacatgcctgtcatcagtacccctggactgtcatggtgggtcagtctgccctaggctggactgaccaacctgttcattcccccacaggattgccctttacagttcatgagttcccccaactggagtgcagacaagagcactgattgatggaccaggtagacttgaaaccaggaatagcacaaaagttatcaaagaggctcagccatggagattgcaagctggggatggaagtatccctggaattgagctgttctcacacctggtacctgagttatacccctggtgtctgggtaccaaggtcactagccttgccacttttctatgttcctgatcccctactaaacagtccaccttttcgcctacttcccctgactcctgtaccctgtcccctctttctgcctagtttgaagacactggtcatcccataacatgtcctgggctaatacatatcctcaaatcgttcttgaaaatctgttcctcttccctcctccccctccccctccccccccccccgctctttccacggtctccctctgatgccgagccgaagctggacggtactgctgccatctcggctcactgcaacctccctgcctgattctcttgcctcagcctgccgagtgcctgcgattgcaggcgcgtgccgccacgcctgactggttttcgtattttttttggtggagacggggtttcgctgtgttggccgggctggtctccagctcctaaccacgagtgatccgccagcctcggcctcccgaggtgccgggattgcagacggagtctcgttcattcagtgctcaatggtgtccaggctggagtgcagtggcgtgatctcggctcgctacaacctccacctcccagcaacccgccttggcctcccaaagtgccgagattgcagcctctgcccggcggccaccccgtctgggaagtgaggagcgtctccgcctggccgcccatcatctgggatgtgaggagcccctctgcctggctgcccagtctggaaagtgaggagcgtctctgcccggccgccatcccatctaggaagtgaggagcgcctcttcccggccgccatcacatctgggaagtgaggagcgtctctgcccggccgcccatcgtctgagatgtggggagcatctctgccctgccgccccgtccgggatgtgaggagcgtctctgcccggccgccccgtctgagaagtgaggagaccctctgcctggcaactgccccgtctgagaagtgaggagcccctccgcccggcagccgccccgtctgagaagtgaggagcccctccgcccagcagccaccccgtctgggaagtgaggagcatctccgcccggcagccgccccgtctgagaagtgaggagcctctccgcccagcagccacctcgtccgggagggaggtgggggggtcagccccccgcccggccagccgccccgtccgggagggaggtggggggatcagtcccccacccggccagccgccctgtccgggagatgaggggcgcctctgcccggccgcccctactgggaagtgaggagcccttctgcccggccagccgctccgtccgggagggaggtgggggggtcagccccccgcccggccagccgccctgtccggaagggaggtgggggggtcagccccccgcgcggccagccgacccgtccgggagggaggtgggggggtcagccccctgcccggccagccgccccgtccgggaggtgcggggcgcctctgcccggccgcccctactgggaagtgaggagcccctctgcccggccagccgccccatctgggagggaggtgggggggtcagccccccgccctgccagccgccctgtccgggagggaggggcgcctctgcccggccgcccctactgggaaatgaggagcccctctgcccggccaccaccccatctgggaggtgtacccaacagctcgttgagaacgggccatgatgacaatggcggttttgtggaatagaaaggggggaaagatggggaaaagattgagaaatcggatggttgccgtgtctgtgtagaaagaggtagacgtgggagacttttcattttgttctgtactaagaaaaattcttctgccttgggatcctgttgatctgtgaccttacccccaaccctgtgctctctgaaacatgtgctgtatccactcagggttgaatggattaagggcggtgcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctcccctattgtcctgtgaccctgccaaatccccctctacgagaaacacccaagaatgatcaataaaaaaaaaagaaaaaaaaaaaatctgttcctctgtgagatgggcctgatctctcccacgggtggagcagaggagtagagggtccagggcctgagtctcccataggctaagtatttgccctgagtcataaagccagtgggaggcagtgctacagtttgattccaggaagtctcagaccaaagttctctcttaaccacttacctttcctgggcttaatagttagttcatttatgtttttcctggcactacttcattggacctcattttagtttcttcttttttttttttttttttgagacggagttgctctgacacccaggctggagtgcagtgccacgatctcacagtaacctccgcctcccgggttcaagcaattctgtctcagcctcacgaatagctgggacgacaagcgcgtgccaccacacccggctaatttttgtatttttagtagagttggggtttcaccattttggccaggatggtctccatctcctgacctcgtgatccgccccgctcagcctcccaaaatgctgggattacaggcatgagctaccgcacccggcccatttgttaacattgtaaaatgaatattagtacattattattaatgtacattatatgggttttcacaaatgcataaattcatgtatccaccattacaatatagtacaaaatacttttactgcccccaaaaattacttgtgctactattcattcctccctccctccctccctccctcccactgagtccctggcagtcactgctttactgtctctatagctttaccttttccagaatgtcataaacttgtaatcatacagtatgtagctttttcagtctggcttctgtcacttaccaatgtgcatttcagactcctccatgcctttcataacttggtagcacagttaattttattgctgaatgatattccattgtgtggatgtaacacagattagccatttatctattgaaggacatctgggttgattcaagttttgagcaattatgaataaagctgctataataatttgtgtggttttcgcatggacataagttctcaactcatttgtgcaaatacccaggagtgtgattgctgtatcatatggtaagactatatttaactttctgtaagaaactgccaaactgtcttccaaagtggctataccattttgcctttctatcagcagtaaacgagagttcccattgcctcacaaccttgctagcatatggtgctatcagtgttttgcattgtagccattctaatagatgtatagtagtatctcattattgtttcaatttgcagttccctaatggcatatgatgtggagcatattttcatgtgcctatttgccagctatgtatctatttttcttaggtgaggggtctattcagacctacggcctttttttttttttttttttttttttgagacgcagtttcgctcttgttgcccaggctggagtgcaatggtgcaatctcggctcgccgcaacctccgcctcccgagttcaagcgattctcctgcctgtcagcctcccgaggagctgggataacaggcatgtgccaccacgcccagctaattttgtatttttagtacagatggggtttctccatgttggtcaggctggtctcgaactcctgacctcaggtgatccgcccacctcagcctcccaaagtggtgggattacaggcgtgagccaccgcgcccagccttgaattgtacactcaaaatgggcaaattatatggtatgtaaattgttttttaaaaaaatctgttatgttttgaaagaacaagtagatgtctgggagattctttggagaagtacttaatgtgaaattttccacaacgataaaaatgaaagcacccatccccctggtggggggacacagatcacaggtagcttgtggcccctcttgggcacttcttctcccaccaccctctgctccttctgcagaggcttacagagcagaggaaaccccaacctagggcgagactcccagctttgccacgccaagccgggccccaggggagccagtgcgaactctagcctactccctgggatgagaggacctcagcactaaccaggtctgcaagtgggtgtggggttagagtggatcaactatgtgatcctatcaacctacgttcgaatttgactgcatttaaaaaaacactttacccccccaaacggagtctctcgctctgtcgcccgggctggagtgcagtggcgcgatttcggctcactgaagcctccgcctcccggcttcaagcgattctcctgcctcagcctcccgagtggttgggactacaggcgcccgc

SEQ ID NO: 2111 - DNA, 341 bp, Homo sapiens
cgccgcttgggtacctcggatgtgagggcgatctggctgcgacatctgtcaccccattgatcgccagggttgattcggctgatctggctggctaggcgggtgtccccttcctccctcaccgctccatgtgcgtccctcccgaagctgcgcgctcggtcgaagaggacgaccatccccgatagaggaggaccggtcttcggtcaagggtatacgagtagctgcgctcccctgctagaacctccaaacaagctctcaaggtccatttgtaggagaacgtagggtagtcaagcttccaagactccagacacatccaaatgaggcgctgcatgtggcagtctgcc

SEQ ID NO: 2112 - DNA, 971 bp, Homo sapiens
catccctccaaggcttccataaggctaaggcatctccagctcaggagatgctgggcctgctcatggctttgttgctgctggggcctggatgatcttcctctgcgcattgtgggccattgacgctgtgccttctccattcctccatctgtttagaaacacctgccactgaggtcctggcataacttcttcctttggaaggagctccttaatctatagaccaggggttcagtcaccccagacctatccattcccatgccacccatccaaatggtccccaggactcagctggaactgaccaaagcaaagacaagccccagaacaccttggtataactttattcacaaactccagacacccaggcctggcttagcacagagggcatgttcttgccagtggcaaaaaaacccgatacagcatgtttgttaatactaaccattttaatttaaattaatagcatgtctggaagacaaatgtagttgatagaaaatataaaaactttactgtacaaattttacatcacattcaaaaaaagcaagtgtgtggcttgtggccacagaagatgctaggtttgcacgctgatgagatcctggctaacactgctgcatagcacaaactccaactggcttcacatttacgtctccaccctccccccacaccaaatcaacacagaataacacaggtttccagggcttgccattcctctctgtgacctcaagaggaaatgccgtaggatgacagagggtgttttgatttggtgacatggagagatcaactttgctacacactgctcacaaccccaaactagctaggattcaagacttcgagttagacagaaacccagggggctgcggctctggtggttaaaggcaggcagtgcagaggtggcaggctgagagccagctgcccccagtccttcagttccacctttggggcccagtggcttctgggttccttgaagacaacagggcccc

SEQ ID NO: 2113 - DNA, 971 bp, Homo sapiens; identical to SEQ ID NO: 2112

SEQ ID NO: 2114 - DNA, 971 bp, Homo sapiens; identical to SEQ ID NO: 2112

SEQ ID NO: 2115 - DNA, 1598 bp, Homo sapiens
cattttattatttattaagactgttaacaaaaaataggctttatttttcctctgtacttaaaaactataaatttacttgggtcactaacagtgctctcagtctgagagaaaattacataataacaacaataatgaacaaagcacttagcatgtgccaggcactgttctaggtgcttttacatattcagtcatcacttttcacaacagctctatgaggtaagtactgttatctccgttttacagatgaggaaactgaagcacagaaaaaccaaggttcagtcagacagctagtatgtggcagagtcaagatttaaatctaagaaacaggatctggaatctgtactcctaaccattacgccacactgagatggttcccaaacagcaggaagaagaagtgttctttccctataggtaacagttcactcattcttttggtgcagtaatggacagtctgtaccgaactctccaatataaaacgtgaggaattaaaatgtatatagagcctgaaaactcacttacttttataatggttccaagcaaagaaaatgctttatgggttcaaacatgtcaaatttatgaactcttcgtttttttgtggaaactggctggcagtctctatttacaatatctctcctctattataaaaaacattgcagtggagctatgtgaacattttttcccctttcccttagagaaagcaaattaagtcaaaggtgatacatatccttggagttggctgaaaaagaaattgggagaaatatgagaatagccttgtggaacttggtttccacaattctcaaatttaaccatgaaattaaaattagatacaggggatagattttcctggtcataagcaagtcaggcagtgagctccaaagaattcacatactcctccttctaattcttttaaaattccagcttctaaaggacctgagaaatatgatcactactaaactcactcatgtattaaataatgattaggaagagctaagagttgacacagaggaaggccaggaaacatggtaaatgtgggtaagggcattaagaagtttgcagactacaccatatctctaaagcctcatgattttgctaaagtattgtaactcaggagagaaagcaagacaccctcatgggaattcttttgagtttttcattcttttccccctccactcagttccatccagatgtggcagcctcagtagctagtagaaaaaaaatttggccagggtcagtggctcaggcctgtaatctcagcactttgggaggccaaggtgggcggattgctcaagctcacaagtttgagaccagcctgggccacatggcaaaccctgtctctacagaaaatacaaaaattagccgggcatggtggcacatatctgtagtctcagctatttgtaggctgaggtgggaggatcacttgagcctgggagtttaaggctgcagtaagccatgattatgccactgcacttcagcctgggtgacaaagggagaccctgtctcaaaaggggggaaaaaaggccaggcattgtggcacgcgcccagagtcccaacttctcaggaggctgagtcaggagaatcgctcgaacctgggagacaga

SEQ ID NO: 2116 - DNA, 1598 bp, Homo sapiens; identical to SEQ ID NO: 2115

SEQ ID NO: 2117 - DNA, 1598 bp, Homo sapiens; identical to SEQ ID NO: 2115

SEQ ID NO: 2118 - DNA, 1598 bp, Homo sapiens; identical to SEQ ID NO: 2115

SEQ ID NO: 2119 - DNA, 1598 bp, Homo sapiens; identical to SEQ ID NO: 2115

SEQ ID NO: 2120 - DNA, 1598 bp, Homo sapiens; identical to SEQ ID NO: 2115

SEQ ID NO: 2121 - DNA, 1598 bp, Homo sapiens; identical to SEQ ID NO: 2115

SEQ ID NO: 2122 - DNA, 932 bp, Homo sapiens
ttctcctggggaaagggctgttgctgaagtggccggttttcttaagcatcgacatttgcatccaaaggttcaagcagccgcctcaggttccagaggctgaggaggaggataatttaaattaaaaacacttcggctgcctctggtatccttatctgcttctctcccttccttgagcacctgcccactgaaattcccggtatgacagcctcgtctgagacgcagagaaaggagacaaagacacaggggaggggtgaacctcagaagaagcctctcccaggtgggctggagcctggcagacatggaaaggaaattgttaaacccaggacctccccagtggttgctcacagtcctgagccttaggataaaaggtttctgagaaagaactagtttgggaaaaaaaaaatgaaaagacatttcatttccaggctgcctcctctgagccttcccagattctcagtctgtgatgaaatagacagaacaccaagctaccaggaagggcacctgcctcctagatcggaatcttcgtccattcgcacttaggtgatcacttgccttcgagagccccatccagaagacgggagtaatgagccctgctctgcccatcacgggccgctatgaggatgcaaaagcacttaggaaagaatttaaatgctacacaggcacacgatattgttacgcacagtcaaagctggtgcatcgggcacttcatcatccagaaacctcttttaccttacaatgtgagataaacttatatacctttctataatgccttacttgtatggggggaaaaaaaggcagaagtgagctgacaaaacacaaaccttttcccttaggatattccagggcatgtcataaagcgagacgcacaggacagaggggagcagtggcgctgaaccacagccgcaaaggcctgagttcacagtccgggctgt

SEQ ID NO: 2123 - DNA, 932 bp, Homo sapiens; identical to SEQ ID NO: 2122

SEQ ID NO: 2124 - DNA, 932 bp, Homo sapiens; identical to SEQ ID NO: 2122

SEQ ID NO: 2125 - DNA, 932 bp, Homo sapiens; identical to SEQ ID NO: 2122

SEQ ID NO: 2126 - DNA, 3492 bp, Homo sapiens
tggctgccgcgagcgggcggacgctcgcaacctctgatggaggggggctcaagttcacggctgcggacggggatgcgggggatgcagggacccgggaggccagggaacctggccagttgttttgggccaggggtgcgggcgaggggtggttgttgtttccccacttgtggggcccgaagtcatccaccggcggccgccaccgcgcggggctggaggctgagaatccaagtacgctgccacccccccgcacttccgggggggcgggaataccgcccttaaggtggctctgtgaagtcccaggtgggggcgagcctaaggggacttaagtttaggggcggtctcccgagagtcggccccccacgttgagaacactccgaagtttgcatctcggtcaagttcaggagcgacggtccgcggggtcgtctggctgctcgtagaagccgagagatttgtattgcccgaaactggacgctcagctgagtctccgttgcaccccacttcatcctccgggaccgtgggggaaagggcgcgggggttcacagctttgcctcggaggggcagtttttatagtgggcgcaattggtgggtaacagggtccagatgggaacaagcgtgtaggcgatccgaaactcggggaaccccggtgttagtctactccccctcccgcccccggacaacacgcacacgcttaacacaacacgcacaacataacgcgcgcgcgcgcgcacacacacactccatccgcgccgagttgcttccgggaaaacaagcccagaaggcggcggacactcgcataaagtcacgcagtagtactcggagcccggggtagaacctggacttcaaatctctgcactcccggccgggtggtgggcgcatatcctgggtagcctctaggaagcgctagacacatggaaccaaggcagattcagcctggcagctggcaagtcatggagcactgcctgtccatctgcgagctaacaacagtcgcgctggaagtcaacaagggaaatggaaagggagagacccagcctccacaggggctcacgccctgggacctgtgccagtgtgaacaaggttttccggttctagccagaggaagctgcagccaggcctggcagtctcccctgctcccttccaccagcttggttcctgtttctgctggtcctgggagcccccagcagatggactgcccttatcagccggctccaggccagaggaggaatcctccggtcacgtgtggctctctggagggagagagacctcataaatacatacagcccacgcagaggaaggggggagggtcaaggggaaagaaaccttgacattctggcgactgggccaggattaaagtccaccaggcatagtccttattggctatttctatgaggaatctcaaatccacatggcttccctggatgacaacgctgactttgactagccctgggatctggggcattcccagtgtgctgctggcttgatccaggcctaatcctttgcccaggactgacctttcacagtttacagagcactttatctcctggctcagtgaagtctcacagaaccctccagagagaagggagtttatcatcaccctcaatttacagatgaggaagctgaggctgcgattgtaactgactgactgctggctacgcagctacaagtgaccgagtccagcctgaaagccacatatattctcccacaaaatccagagctgccaaacacatcctcctccatgagtcttgctttgtgcccatcactgagctccatgccccgggcgagccatcgttcctgcctggcgaagtccacaatccaataaggagggaaggttgaagggatgaatctcaacagaattgtgcacagtgaaagaagccaatgaaagaagagtacatattgtataattccatttatagaaaactctagaaaatgcaagctgatctacagtgacagaaagcagatccatggttgtttggggaagtgaggcagaaggaaaggattcagagaagcacaaggaaccttttagggtggtagacatgcttactatctggtactgagagtttctcatgtctgcacgtatctaattgtacactttaaatacacacagtttattgtatgtcaattatatctccataaagctatttaaaaagaggaacgtaagtggggaaaagaatgaaggaagttggctggcgtataattaagtaagtctgtgagcagtcttaaagtggggacacaaagtaccatgggcacgtaagagaagaaggtagagattcattcccaaacggaagagatcaggaaggagttcttagaacagggtttcaacaaagctcaaggtatggataagtaagggtcaggttaagaaagattcagatggaagatacagatagagtttatttgggaaatagagagtggagtattatacacacgcacaattcgcctttttacccaagttttgaaggactgaagttaaaactaacagcaactatcctctcttttcttcagaaattcagacacatgccctacttggcaggcagctagttttgctaataagattcctgcccttctccctccctctctgtgcatctcatcccttcggtcccgctgaggcccctaccctctcggatttcctctttgaactgaactgccaaatacttgccagcttccagggccctgagtacccacatttcagcctcttccaaaccccagagtaagaaggagatttggggagttctgggtgggcatgtgatgggagactaggtccaacataaaaagatatttccctttttcttccatactttttggcttagtaattgacatgtgaccattggagaattttgaatagtttattagaatacattgtgatagagaagaaggaaattcaagaattgttacaatgttgtacactgattaactggctaatttgctgcaaaaccaattctgatcactgctcttatggtttgtaatacattattttgggtttggatgatcctgttattcatagctttacataaagaaatattccaatgacatatgaaacccatatatgaaattgtgggttagctcttgctttcaattttgtattatgtttgttgattttaaactgtctcctttcaaaagtttccttattaattaaataaaccactcagccacattcccctcatctaactcagtacccaagtgtaagctcaattctggagtcgcctttccaaccttggcttaagggacattagtcactaggaacaaaacatggcatttgaacagctgttttgggtattcagagtccaaaccctacaggtctggagaaggtgggggttgggggaaggaaaccaatatttacttactgaatacctactctgagccaggcactggggacttcacagagagtatgtcttttaattttctgaacagctcattaatgtgttctgcctcctctaggcatagcaaggttaagaatttatcaaagatcacacagctcataagtggtggagctgggacttg

SEQ ID NO: 2127 - DNA, 3492 bp, Homo sapiens; identical to SEQ ID NO: 2126

SEQ ID NO: 2128 - DNA, 3093 bp, Homo sapiens
gcgacggtccgcggggtcgtctggctgctcgtagaagccgagagatttgtattgcccgaaactggacgctcagctgagtctccgttgcaccccacttcatcctccgggaccgtgggggaaagggcgcgggggttcacagctttgcctcggaggggcagtttttatagtgggcgcaattggtgggtaacagggtccagatgggaacaagcgtgtaggcgatccgaaactcggggaaccccggtgttagtctactccccctcccgcccccggacaacacgcacacgcttaacacaacacgcacaacataacgcgcgcgcgcgcgcacacacacactccatccgcgccgagttgcttccgggaaaacaagcccagaaggcggcggacactcgcataaagtcacgcagtagtactcggagcccggggtagaacctggacttcaaatctctgcactcccggccgggtggtgggcgcatatcctgggtagcctctaggaagcgctagacacatggaaccaaggcagattcagcctggcagctggcaagtcatggagcactgcctgtccatctgcgagctaacaacagtcgcgctggaagtcaacaagggaaatggaaagggagagacccagcctccacaggggctcacgccctgggacctgtgccagtgtgaacaaggttttccggccccaggaagcaggcctaagtactctcatttcatcactgaggagcctgagacgttcagtcattgattggacagccctcaccattcaagccctccttggtttacagcagcagaaagagaggctctgaaggttctagccagaggaagctgcagccaggcctggcagtctcccctgctcccttccaccagcttggttcctgtttctgctggtcctgggagcccccagcagatggactgcccttatcagccggctccaggccagaggaggaatcctccggtcacgtgtggctctctggagggagagagacctcataaatacatacagcccacgcagaggaaggggggagggtcaaggggaaagaaaccttgacattctggcgactgggccaggattaaagtccaccaggcatagtccttattggctatttctatgaggaatctcaaatccacatggcttccctggatgacaacgctgactttgactagccctgggatctggggcattcccagtgtgctgctggcttgatccaggcctaatcctttgcccaggactgacctttcacagtttacagagcactttatctcctggctcagtgaagtctcacagaaccctccagagagaagggagtttatcatcaccctcaatttacagatgaggaagctgaggctgcgattgtaactgagctccatgccccgggcgagccatcgttcctgcctggcgaagtccacaatccaataaggagggaaggttgaagggatgaatctcaacagaattgtgcacagtgaaagaagccaatgaaagaagagtacatattgtataattccatttatagaaaactctagaaaatgcaagctgatctacagtgacagaaagcagatccatggttgtttggggaagtgaggcagaaggaaaggattcagagaagcacaaggaaccttttagggtggtagacatgcttactatctggtactgagagtttctcatgtctgcacgtatctaattgtacactttaaatacacacagtttattgtatgtcaattatatctccataaagctatttaaaaagaggaacgtaagtggggaaaagaatgaaggaagttggctggcgtataattaagtaagtctgtgagcagtcttaaagtggggacacaaagtaccatgggcacgtaagagaagaaggtagagattcattcccaaacggaagagatcaggaaggagttcttagaacagggtttcaacaaagctcaaggtatggataagtaagggtcaggttaagaaagattcagatggaagatacagatagagtttatttgggaaatagagagtggagtattatacacacgcacaattcgcctttttacccaagttttgaaggactgaagttaaaactaacagcaactatcctctcttttcttcagaaattcagacacatgccctacttggcaggcagctagttttgctaataagattcctgcccttctccctccctctctgtgcatctcatcccttcggtcccgctgaggcccctaccctctcggatttcctctttgaactgaactgccaaatacttgccagcttccagggccctgagtacccacatttcagcctcttccaaaccccagagtaagaaggagatttggggagttctgggtgggcatgtgatgggagactaggtccaacataaaaagatatttccctttttcttccatactttttggcttagtaattgacatgtgaccattggagaattttgaatagtttattagaatacattgtgatagagaagaaggaaattcaagaattgttacaatgttgtacactgattaactggctaatttgctgcaaaaccaattctgatcactgctcttatggtttgtaatacattattttgggtttggatgatcctgttattcatagctttacataaagaaatattccaatgacatatgaaacccatatatgaaattgtgggttagctcttgctttcaattttgtattatgtttgttgattttaaactgtctcctttcaaaagtttccttattaattaaataaaccactcagccacattcccctcatctaactcagtacccaagtgtaagctcaattctggagtcgcctttccaaccttggcttaagggacattagtcactaggaacaaaacatggcatttgaacagctgttttgggtattcagagtccaaaccctacaggtctggagaaggtgggggttgggggaaggaaaccaatatttacttactgaatacctactctgagccaggcactggggacttcacagagagtatgtcttttaattttctgaacagctcattaatgtgttctgcctcctctaggcatagcaaggttaagaatttatcaaagatcacacagctcataagtggtggagctgggacttg

SEQ ID NO: 2129 - DNA, 2387 bp, Homo sapiens
gcacggtcacctgggtgaggggcagcggaaggggcggcggagcaccgatctcatggatgggctccgaggggcttgcgggaggggggcgccagtgttcggggccgttttggcggctatgcaggattggcaggagctgcgatgctcacacttgcctcgccgaccgccatttcacatccagcagaggaggcgggggcagccgctgagacggtttttcacaaggtgcattttagtggttaccaggttgccacgtatttgaagtggtgtgagagctactcgtttggaaccgttgtggattttcaaataggaaaatcaaaaggcccaaagagacagctcactggaaatgacctcattcttgatggctgctgctaacttatggtgagatgctgggtccctgcccaataccacatggacatccaatcaatttacccagggacaagtccactcaagagcatcatttagaagagggaaaaggcactggggttatttgtttttggagtatgtgcttaaggaaatctagagtattcccacgagcattctgctgagatgaacaatcagatgacctcgtgtgagatttggaggagagaaggaaatggagagcatgcgtctgccgcttctgtggtttctgtcggtaagcacagtgatgaggtgctgagttttccccagaaggcctcccagtgtcctattaccagcttcacaagcgtcgagggcagggcatgggcatctattgttcaccagtggagatctatctggcacagaaccgatccaaccattgcagtggtcacagcggtgttggctttctgattctcaaccttcctgaccgccagaggagacagcctctttggtggccctgttctgtggtattgtgctaaccggtggtgggactaaaactgtctctataatgttttatttcttaaaaaaaaattctgaagcaaatgtgacaatatgttaacattcttaaaatctgggtagtgggaacatggatgttgttatttgtggtgtgtttgaaattgtgtcatattataaattttaaaaaaatgttttgactacaaaatctctatgtatatgcccagtttttgtagattgttgcttacgcttttcatatttttacccaaggagtaatcaggaattctaaaagtcttatgtaacaggatttaaaataaaattacacagaatctcaactgtactatattttgaaaatatgaatgattaagattattttttatatttttattaatatagagaaaataatttctataaaatatgctttcagctaatgggggatcccattccatatttttttctttttcttttttttttttatttctccaagaaaaactcattccagttcttttgcattaaattctcttataccaaaaaaattgtttcaaaagttgcttagttgttatagaagatgattgcttatatgataaagaaatgttaaggccttgataatattcaaaagcttctgtataaaaacaataccatggaaattaatgacagagtaaactttctgaattaaagttctctttcaaactatgagtaagaggagaattagctggcttcttttttcttttttttgaggcagggtcttgctctgtcacccaggctcaatcacagctcactgcagccttgacctcctgggctcaggtgattttcccaccttagcctcctgagtagctgggaccacaggcatgagccaccacacctggctaatttttgtattattttggtagagatgggatttcgccatgttgcccaagctggtcacaaacttcctgccttggcctcccaaagtgctgggattacaggcatgagccactatgcccaacctcagttggatgggtttgtgtgtatgtgtgtgtgtgttttgtttgttttttagtttttgagacagagtctcactctgtcacccaggctggagtgcagtggcacaatcacggctcactgcagccatgacctcttgtgctcaggcagttctcctgcctcagcctccttagtagctggaaccacaggtatgtgccaccacacccggctaatttttgtatttttttgtagagatgggttttcgctatgttgcccaggctggtctcaaattcctgggctcaaacaatccacccacctctgcctcccaaagtgctgggattacaggtgtgagccaccaagcccagcctagctcctctacctgaacttatttttcattatcctaaagtgataaaatagatcaagaagatcagaacaggcttaaattgatgctataaaaccaattactctgtattatctttgcaactcttttgtaagtctaaaattgtttgaaaataaaagtttattttaaaaattactattctctttcctattcaacacaaaacttatttcataaagatgcttac

SEQ ID NO: 2130 - DNA, 2387 bp, Homo sapiens; identical to SEQ ID NO: 2129

SEQ ID NO: 2131 - DNA, 2387 bp, Homo sapiens; identical to SEQ ID NO: 2129

SEQ ID NO: 2132 - DNA, 2387 bp, Homo sapiens; identical to SEQ ID NO: 2129

SEQ ID NO: 2133 - DNA, 5721 bp, Homo sapiens
gcacggtcacctgggtgaggggcagcggaaggggcggcggagcaccgatctcatggatgggctccgaggggcttgcgggaggggggcgccagtgttcggggccgttttggcggctatgcaggattggcaggagctgcgatgctcacacttgcctcgccgaccgccatttcacatccagcagaggaggcgggggcagccgctgagacggtttttcacaaggtgcattttagtggttaccaggttgccacgtatttgaagtggtgtgagagctactcgtttggaaccgttgtggattttcaaataggaaaatcaaaaggcccaaagagacagctcactggaaatgacctcattcttgatggctgctgctaacttatggtgagatgctgggtccctgcccaataccacatggacatccaatcaatttacccagggacaagtccactcaagagcatcatttagaagagggaaaaggcactggggttatttgtttttggagtatgtgcttaaggaaatctagagtattcccacgagcattctgctgagatgaacaatcagatgacctcgtgtgagatttggaggagagaaggaaatggagagcatgcgtctgccgcttctgtggtttctgtcggctttctccatatttacgtgcttgtaactctggcatgacctttgctccagtctctaccagagggcggtgcctggattgaagtggaaaagccctgttttccagccatgacccagggagcaagcactgactcctcaggggaacaggagacctgccaactaggaccctgggagcccccatgctggcagtgccctgggtcatctcaggctcatcagcaaatcctggggggagagcggggctggagggcgaagaagcccaggagagttcctggctcagaacccctctctgaggctcccaatacagagcccaggccccacacccagggcctctgagtatttttgtttattgtatgtaaaatactagtgtatttttgtttaagtctcacaggtaaacaggttctctcatactttgccaagggaaatgtgatctgtgcaatttggcaataactatcagaattttaaaagcttatgccctttgacctagtaatttcacttctaagaatttcccctgcagagatatgtatatcttgtatgaaatgaagaggctacgaagacaggcaacgccgcagtgtttataatagcgaagaccagacacaacccacatgtctaaaggttctgatttttaaaactgtagtatatctgtacaatgagcactccacatcctttaagaatgaggaagggctgtgtgaactgaaatggaactatctctaagatttattaagttaaaaaaattcaagagtagcacagtgtgtagggtatgccatcatttgtatgatataaggtcgtatatctgccatctcaaatgaggaacagtggttgcctctgggaagggaattggatggctaggaatggggtaggaaagaggtttgcttttcagaacattttatactatttaagttttgtaacaagtgcatctattttgacttaaaagataaaaaatgaaaaggaaaggctccactagtgattctgatgctcacaaagattaagaaccaatgcgaatgaggaactcatgacaccgcccaggagacagtgaacatatctcttcaaatatcaaaaacctttcagcagagggtgagaacatgtgcctggggtaagcatgggtgggcatgagctgggtacagaggtgattcccagggacatacaactaccttgccctcctgggatcaggtcttcctcccaccttagcctcccatattgttgggaccacaggcatgcaccaccacacctggttaattttttttttttttttttttttgtagcgacagagtctcgccatgttgcctaggctggtctcgaactcctgggctcaggcaatccttctgcctcgtccttccaaagtgctgagattacaggcatgagccactgcacccagcctgacagtagcttttaatctctggactctcatcaccgtttggactgtgagctgtggttctagctcttggatctgatgggcatcttccctcaaatatgtcagtttctctctccaggtcccttgctttgtcttcctttttgcctcctcgggcctgatacctttctctgggcttctctactctgccccgagctgcctagttttgcgaataatgtcacatccagatgtcagcagccctgatgtccatgtgacaatgctcccttgctgtccatgtgacaatgctcccttggtgtcccagtgacagattttcccatgcttcaccctctctcttttttaatttttttttctgtacacagctctcagtcaagccccttgagctgcctccaactgtttgctcatgtctgttcccagcaatcttttcctcttttagcacaatcttccttaacttactagttttttgaaacagagcctattagtcttcacagcgctacctttctgatctcagagttcaccaaaaagcttttcctcccatcatgcctgcctccctttcttcaggtccgttagagtccaccgtggcctgtgtgggaagcaagtctctcccagggcacacatgaacagacttcatgcccacatccacagtgaacagtggcttctgccttccagatgggcttaccctaaatcaacacatattcctaggatgtgggaacatatgcaatacttaaatgcacaggctctgggttcagactccctagggttaaattctccctgtgccggctagctgcatgattagatttgtgatcttgacaaagttacctaacgtctctgggcctcacttttctcatctgcaaaatagggaaaatagcaacacttctccataggggtgtggtgaggataaagagtagatgtaaataaagtgttgaatgtagagcctggcacatatcaagctcttaaaaagcaatggccattttgttatttttaccgcaacgacaactgcagttattatctggcttcagagctctctttttaaaaacagtattccctggttttacacccaggtgctaatactattctatgaagctaatgtatagagaccatatctttttaacaaacgtgtatatatgagtcatttccggcacatttgatacacatcatctcgtttggtccttaaaacaagcctaggccataagcagggtacgtgttaccactttgccattcctgttttacagaggcttagacacattgagaagcttttccatagtcacttaacaagtgatgggtgaagccaaatcaagcctttagatctccaagctctttccattaaaccatataaatcacgggttggcaaactttttctgcaaaggggacagatagtaaatagtttaagccttatgggccacatgctgtgtctgtttcatattctgctccttttttatttttattttttttaagaaaagacaccctttaaacatataaaaaccattctgagcaacaggctggtgctaaaaacaggtcatggtaaccattggctctagggttgtagtttactgttgatatagattgtacactgataagccaaaatacaaacctaatgaaactgacatacttaaggaactttactctttgttagcaatcattgttaatatttattgaatggtgactacgtgggaaatgctgttccaagtgtgatagatatattaacttacttaatcctcacacccactctaatttcctaagtactattgtcagactcattttacagacaggaaaagcaaggcatagagaaggtaagtaacttttccgaggtcacatggctattaagtagcagagctgtgattcaaatataagcggtttggcaccagatcctgtgcacttaaccgcttgcatctcggttgggagcactgactggttcagctattgggagggaagaaaggggatggggaagccacataacccctaggagattctgtaataaatatgcttcagagccattcaccttgaagctgaggaggcatggaagcaggccacctgtgttctgtacagcatcaccaggctggaaatctgccatggctttccttcacgccatcacaagaggatacagatgaggctgcagaggcatcttgatttgagaaaagcatttgactggatctcattaaattttaatcattaactgaattcaaaataaattgaaaactggttgacagagcaccaacaaagggtgatgataaatggtgatgcatctagaggggagctatcttccaggggacaactctaaggcaaggacggatgggatttaatgaaggtgttatgtccccagaagaagacaaatagcacagcaaggaacagaggaaggacaggagtgagcagcctgagtaattaataaaccatattaacagctcctccataatcaggccttggtgatcacaactgcttggattttttcttaagctttctttgagtcaggaataggtttgaagcgtcctagagacacacagcatgaatatttcaggtggacattaaaaagaaatctataaatttacagctgggaggatcctgagatctacttcggatcagaaactttcaattacaagattcccaaggccttacttcattccccagagagtaatctttttaataaatgtccaaaagtcatggatttaaaaaaaaatctttaaactcattaatgtcctttgtttcctgcccaaatgcatgcaaactttcataacactggtttgctgagtggaaggttggttttgagtgaactgtttggctcagattcaaactccaatgaacaaatacttccaagtttacttgctgaatttcccatacagagaagttcttccactgggcttgccagaggatttgaaacagtggtgagccctggaaggaagggaatatttactggcccttggacataaacccagcacagtaagactcacatcaggctgaaggcagtgcagtatgaaccgacctgatttgaggaagtttgctctgggactcctctgagctactaaatgaggaggagaaggactaatgggaacacactgactccatcacattagaagttataataaacatttagagaacaacctcaaaccagcccatgttttttttttttttctgtcgttgtcattgttttggtttttgtttttttgtttcttcagataagatggtttctctaagcacatgtgtgatccctaattcagccacagccacggagtgaaggagaggaaggggtagaaaggaaaaaccaagagaggaagaggaagggagagaaaggaaggaaggagaacggaagagaagtaaggaaagtggggaaacgctgaaggatttttttgtatttgccttttattggtgtaggagagacacttatttacttgtaatttgtatgtagtgctgggtatgagaaggggcagttggaagagaagggaaagaatgaatataggtgaaaggtaagagtgtcatagggtaagctgggaggccaggaagagtttggacagacagctcagagtaggaagagagttcagagcggggagggagacctgttgactctgggaaggggaaagggaaaaaacactggcatcctgactgcagggaaacaatgaggcagcggagagcaagtatccctcattgctgagggagctgccaagaccccaggcagcctcagtctgtggggtgcggcctgtggggtgcgaggagaggggcacaggctgggagctccggtcagtcct

SEQ ID NO: 2134 - DNA, 5721 bp, Homo sapiens; identical to SEQ ID NO: 2133

SEQ ID NO: 2135 - DNA, 5841 bp, Homo sapiens
atgatgtcacggacgcaaccactggggggaggggagaggggggtgtgtgtggcgaagggaggctgcgagtagtgcgggggagggggctcggcgggaaaaggagcgagagggcgggcgcccgggcgggacacggagggcgggggccgagaaggggctttctccccctccccgggcacgcggcgagggaggcggccggcggccggcagcgcccgcgcgggatcgatgactcggctggcgggcacggtcacctgggtgaggggcagcggaaggggcggcggagcaccgatctcatggatgggctccgaggggcttgcgggaggggggcgccagtgttcggggccgttttggcggctatgcaggattggcaggagctgcgatgctcacacttgcctcgccgaccgccatttcacatccagcagaggaggcgggggcagccgctgagacggtttttcacaaggaaatgacctcattcttgatggctgctgctaacttatggtgagatgctgggtccctgcccaataccacatggacatccaatcaatttacccagggacaagtccactcaagagcatcatttagaagagggaaaaggcactggggttatttgtttttggagtatgtgcttaaggaaatctagagtattcccacgagcattctgctgagatgaacaatcagatgacctcgtgtgagatttggaggagagaaggaaatggagagcatgcgtctgccgcttctgtggtttctgtcggctttctccatatttacgtgcttgtaactctggcatgacctttgctccagtctctaccagagggcggtgcctggattgaagtggaaaagccctgttttccagccatgacccagggagcaagcactgactcctcaggggaacaggagacctgccaactaggaccctgggagcccccatgctggcagtgccctgggtcatctcaggctcatcagcaaatcctggggggagagcggggctggagggcgaagaagcccaggagagttcctggctcagaacccctctctgaggctcccaatacagagcccaggccccacacccagggcctctgagtatttttgtttattgtatgtaaaatactagtgtatttttgtttaagtctcacaggtaaacaggttctctcatactttgccaagggaaatgtgatctgtgcaatttggcaataactatcagaattttaaaagcttatgccctttgacctagtaatttcacttctaagaatttcccctgcagagatatgtatatcttgtatgaaatgaagaggctacgaagacaggcaacgccgcagtgtttataatagcgaagaccagacacaacccacatgtctaaaggttctgatttttaaaactgtagtatatctgtacaatgagcactccacatcctttaagaatgaggaagggctgtgtgaactgaaatggaactatctctaagatttattaagttaaaaaaattcaagagtagcacagtgtgtagggtatgccatcatttgtatgatataaggtcgtatatctgccatctcaaatgaggaacagtggttgcctctgggaagggaattggatggctaggaatggggtaggaaagaggtttgcttttcagaacattttatactatttaagttttgtaacaagtgcatctattttgacttaaaagataaaaaatgaaaaggaaaggctccactagtgattctgatgctcacaaagattaagaaccaatgcgaatgaggaactcatgacaccgcccaggagacagtgaacatatctcttcaaatatcaaaaacctttcagcagagggtgagaacatgtgcctggggtaagcatgggtgggcatgagctgggtacagaggtgattcccagggacatacaactaccttgccctcctgggatcaggtcttcctcccaccttagcctcccatattgttgggaccacaggcatgcaccaccacacctggttaattttttttttttttttttttttgtagcgacagagtctcgccatgttgcctaggctggtctcgaactcctgggctcaggcaatccttctgcctcgtccttccaaagtgctgagattacaggcatgagccactgcacccagcctgacagtagcttttaatctctggactctcatcaccgtttggactgtgagctgtggttctagctcttggatctgatgggcatcttccctcaaatatgtcagtttctctctccaggtcccttgctttgtcttcctttttgcctcctcgggcctgatacctttctctgggcttctctactctgccccgagctgcctagttttgcgaataatgtcacatccagatgtcagcagccctgatgtccatgtgacaatgctcccttgctgtccatgtgacaatgctcccttggtgtcccagtgacagattttcccatgcttcaccctctctcttttttaatttttttttctgtacacagctctcagtcaagccccttgagctgcctccaactgtttgctcatgtctgttcccagcaatcttttcctcttttagcacaatcttccttaacttactagttttttgaaacagagcctattagtcttcacagcgctacctttctgatctcagagttcaccaaaaagcttttcctcccatcatgcctgcctccctttcttcaggtccgttagagtccaccgtggcctgtgtgggaagcaagtctctcccagggcacacatgaacagacttcatgcccacatccacagtgaacagtggcttctgccttccagatgggcttaccctaaatcaacacatattcctaggatgtgggaacatatgcaatacttaaatgcacaggctctgggttcagactccctagggttaaattctccctgtgccggctagctgcatgattagatttgtgatcttgacaaagttacctaacgtctctgggcctcacttttctcatctgcaaaatagggaaaatagcaacacttctccataggggtgtggtgaggataaagagtagatgtaaataaagtgttgaatgtagagcctggcacatatcaagctcttaaaaagcaatggccattttgttatttttaccgcaacgacaactgcagttattatctggcttcagagctctctttttaaaaacagtattccctggttttacacccaggtgctaatactattctatgaagctaatgtatagagaccatatctttttaacaaacgtgtatatatgagtcatttccggcacatttgatacacatcatctcgtttggtccttaaaacaagcctaggccataagcagggtacgtgttaccactttgccattcctgttttacagaggcttagacacattgagaagcttttccatagtcacttaacaagtgatgggtgaagccaaatcaagcctttagatctccaagctctttccattaaaccatataaatcacgggttggcaaactttttctgcaaaggggacagatagtaaatagtttaagccttatgggccacatgctgtgtctgtttcatattctgctccttttttatttttattttttttaagaaaagacaccctttaaacatataaaaaccattctgagcaacaggctggtgctaaaaacaggtcatggtaaccattggctctagggttgtagtttactgttgatatagattgtacactgataagccaaaatacaaacctaatgaaactgacatacttaaggaactttactctttgttagcaatcattgttaatatttattgaatggtgactacgtgggaaatgctgttccaagtgtgatagatatattaacttacttaatcctcacacccactctaatttcctaagtactattgtcagactcattttacagacaggaaaagcaaggcatagagaaggtaagtaacttttccgaggtcacatggctattaagtagcagagctgtgattcaaatataagcggtttggcaccagatcctgtgcacttaaccgcttgcatctcggttgggagcactgactggttcagctattgggagggaagaaaggggatggggaagccacataacccctaggagattctgtaataaatatgcttcagagccattcaccttgaagctgaggaggcatggaagcaggccacctgtgttctgtacagcatcaccaggctggaaatctgccatggctttccttcacgccatcacaagaggatacagatgaggctgcagaggcatcttgatttgagaaaagcatttgactggatctcattaaattttaatcattaactgaattcaaaataaattgaaaactggttgacagagcaccaacaaagggtgatgataaatggtgatgcatctagaggggagctatcttccaggggacaactctaaggcaaggacggatgggatttaatgaaggtgttatgtccccagaagaagacaaatagcacagcaaggaacagaggaaggacaggagtgagcagcctgagtaattaataaaccatattaacagctcctccataatcaggccttggtgatcacaactgcttggattttttcttaagctttctttgagtcaggaataggtttgaagcgtcctagagacacacagcatgaatatttcaggtggacattaaaaagaaatctataaatttacagctgggaggatcctgagatctacttcggatcagaaactttcaattacaagattcccaaggccttacttcattccccagagagtaatctttttaataaatgtccaaaagtcatggatttaaaaaaaaatctttaaactcattaatgtcctttgtttcctgcccaaatgcatgcaaactttcataacactggtttgctgagtggaaggttggttttgagtgaactgtttggctcagattcaaactccaatgaacaaatacttccaagtttacttgctgaatttcccatacagagaagttcttccactgggcttgccagaggatttgaaacagtggtgagccctggaaggaagggaatatttactggcccttggacataaacccagcacagtaagactcacatcaggctgaaggcagtgcagtatgaaccgacctgatttgaggaagtttgctctgggactcctctgagctactaaatgaggaggagaaggactaatgggaacacactgactccatcacattagaagttataataaacatttagagaacaacctcaaaccagcccatgttttttttttttttctgtcgttgtcattgttttggtttttgtttttttgtttcttcagataagatggtttctctaagcacatgtgtgatccctaattcagccacagccacggagtgaaggagaggaaggggtagaaaggaaaaaccaagagaggaagaggaagggagagaaaggaaggaaggagaacggaagagaagtaaggaaagtggggaaacgctgaaggatttttttgtatttgccttttattggtgtaggagagacacttatttacttgtaatttgtatgtagtgctgggtatgagaaggggcagttggaagagaagggaaagaatgaatataggtgaaaggtaagagtgtcatagggtaagctgggaggccaggaagagtttggacagacagctcagagtaggaagagagttcagagcggggagggagacctgttgactctgggaaggggaaagggaaaaaacactggcatcctgactgcagggaaacaatgaggcagcggagagcaagtatccctcattgctgagggagctgccaagaccccaggcagcctcagtctgtggggtgcggcctgtggggtgcgaggagaggggcacaggctgggagctccggtcagtcct

SEQ ID NO: 2136 - DNA, 5841 bp, Homo sapiens; identical to SEQ ID NO: 2135

SEQ ID NO: 2137 - DNA, 5841 bp, Homo sapiens; identical to SEQ ID NO: 2135

SEQ ID NO: 2138 - DNA, 8619 bp, Homo sapiens
tgatggccacatagtttttaagaactttggcaggcacttaggatcctggcatctctctgaaatgagaagcttttgcaacctaagagagagagaagaaaaagtaaatatatctggaaaccaccttcttggccttccttacacatacagaaaaacttacagatccttttcttcataatgagttagttctttacaggtaccacagcccttctcaattcctcaaataactccctgtggtgtaaaaggacctatccagactagacactccagttttgctcttcagatagggttgctagatttggcacattaaaaataccaaatgtccagttaaatctgaatttcaaatatatatatatatatatatatatatatatatatatatatatatatatatatatgtatagaatgtctcatgtaatatttgggtgtgcagtgaggggcatacttaagcaattatttgttgcctgtttgaaattcaaatataattgggtatcctgtattttgtatggtaaatttatcctctgattccacttggaggaagctagttaagtgcacttgaacttatcagcccaagggcacaaaaagtacctatcccagtgcaatgcaatagaattttctgtgatgatagacatgttctatgtctgtgtatccaatacagtagacaccagcaacctgaaatgtggtgagactgaggaaactgaatttttgacttaattatttaaatttaaaatatcacatgtggctaatggctactgtatcagagagcaaagccctaaaaagagtcatgtatctcccttcaatttagcaactgggatttaagatccagtgatggttaaaatgatacataactcaggaatacactcctaagtctctgtggcttagatagtgactactccgtttctgcacaaacatgttttgctgtcaacataatcattctgggtttttttccctgtatttactgaagatatattatatggaaaggatgtgaagggccagggtacaggtagatgtgaaggtaaagggtacaaggtaaggtaaaattctccaacaaacttatcctagcaggtaagagtgttaactgaataatctcagcattagaatataaaagctggggtcgggcacagtggctgaggcctgttaatcccagcaatttgggaggccaaggcaggcggatcacttgaggcctggtgttggagaccagcctggccaacatctgaaactccatctttactaaaaatacaaaaactagccaggtgtggcagcatgcacctgtaatcctagatacttgggaggctgaggcaggagaatcgcttgaacccgggaggcagaggttgcagtgagctgagatcgcaccactgcattccagcctgggcaacagagctagactctgtgaagaaagaaaggaagggagggagggagggagggagggaggaaggaaggaaggaaggaaggaaggaaggaaggaaggaaggaaggaaaataaaagctgggaggttccattaccacaaagtaaacattaagtggatgaaacagcacaaatttgatcacacataccagctgtgtgaccattttctttccatgattttaagcaaacatctattaaccctagacccagagcatattaaagagaattattttatgcatgatgccagctagcagagaacaggcccttaaaagaattaacaatctagacaacttagaattatcagtacacatgatgtctggagaggtcagtgcagaaactgggaaaatggtaagagtgtggaaaacaaatggggtgtaattcaaaacttcatagtgttcctggtagctgggtaaggtgagtaggtaatgtattgacaatgatttatagatagacatttttatagaaattcagataattacactctgtgcagtgaaacagctttctgggctaaaaaaatatctattctctggtttatataccagatacttgcgttcccactaagtgtcaggccctctgctagatgctgggatataacagtgaatgaatacatcaggtccctactttgtggagctaggtttaatggaaagaggcaaacaacaaggaatctcataaataaaacttcaaactgcatttgaaagaatctaaacaggatgagtgacagaacataatttgaggtgggaaatggagaaagtttacttttttctctctttatactttaaaaaaaatatacttgctcattttaacagttcacacagagatgtttataaaggtttacctctcctcaccccattctattaggttggtacaaaagtaattgcagcttttgccagtgaaagtaatggtaagaaccacaattacttttgcaccaacttagtttcagctatctgagataattactgtggtatgttttcttccatacggttctctatttactctcatcagttgtgtgtgtgattttgtttcaccggattattgtttcaggtagctgcataacattccatagtataaatggatgtctcactatgtcaacagtattcttattttagttatttaaatgttttacatgtataattaggtttttttttttcttattacagttttgagtagtttttttgttttgttttgagatggagtctcactctgttgcccaggctggagtggtgcgatctcggctcactgtaacctctgcctcttgggttcaagctattctcctgcctcaggctaccgagtagctgggattacaggcatgtgccaccatgcatggctaatcgttgtatttttagtagagataggttttaaccatgttggccaggcgggtctcaaacccctgacctcaagtgatccacccgcctcagcctcccaaaatgctaggattacaggcatgagccaccgtacctgaattcttgtgacagttttgaaagagtccttacatatgtaaccttacctagtggggcctttattctagattgttgacactctccctttccaaatgtctattaatacaatttaatagacattgtcaggaaaagttatgaaaaactatatgacaatggcaattcttcctcatcctttgcagtcctgagtatactggctttagtggttgtctattcataggtaagaaatggtatcccaggctgggcacagtggctcatgcctgtaatcccagcactttgggagcctgaagtgggtggatcatctgaggtcaggaggagttcgacaccagcctggccaatatggtgaaaccccatctctactaataatacaaaaattaggccaggtgcagtggttcacgcctgtaatcacagcactttgggaggctgaggccgtcagatcacgaggtcaagagaccgagaccatcctggccaaccaacatggtaaaaccccatctctaataaaaatacaaaagttagctgagcgtggtagcaggcgcctgtagtcccagctactcgggaggctgaggcaggagaatcgcttgaacccagggggtggaagttgcagtgagttgagatcatgccactacactccagcctgggtacctgagcaagactctgtctcaaaaaaaaaaaaaaaaaagaagtggtatccctttgttgtattaatatgcataattttgaattactaggaaggttttttgtttcttgtttttcatatgtattggccatatgaatttaatacatgatataaaataccgtttaatcatcttttatattatgttgtttgccttttcactaacgttttgcagtttgtccctgtaaattgaggttactaaccccgtatatgttttggaaatcctttatcccaacttattgctctttctataactctctttacatatattctgtcttaaaccacttttggacctatctagtctgtgtcctttcctagatggcttttgtgtttcctcctcacttagcaatgacaccctccatcaccatttccaaacacacacacacacacacacacacacacacacacacaaatgaggtatataaagggtctcctaaaatgtcatctgatatttgttatttcatattctcagatttttaatccatttaggtaggtctattttagatagccttgtctgaaacagagctgggacctgatgagtgaaaatgagctcaccagaagaaaaatcaaacaggcatttcagagattgaggccaagaagttaaatgtcttaaatgggcagagcttagctgcttgatgtgaaaagagaccagcgtggctggaacagcaaaggagaacagcagaagaggtgaacagaggccagagatggtcactgagtgggcccttaagtcatggtaaggagtatggagaatgaattattgcatgtattgaatatgtaggtgacgtgactcacagatactttggatttgtagagatgaaggaaatgtagcaagtgacactcttagaatgttgatttgagtaaatggtagtgtcagttattgaactggggagaactggaagggataacaggcttaaggagcacgtttattcctgtgtcttggaagtgtttagggtgaaagacctattagagttctaaatggagatgtcaagtgaaaatgtggctacacacatttgcatttcagaaaaaaggtcaggctggagatgtaaaattggaagtttactgcatatagatagtctttggaaccgtagtattgatgaagccattaatgagacagaacaaagactagggaccagagccaagctccaagtttctaaaatttagaggatagtatagtctggtcattttgaggtgaatacttaataacagaacaatttgttgaagtgtaaatttagagccctacacttttagctctgactattaacgaatacaggaaagaatggatatggttatctgcctggtgtctgtgaaataatttaagccaggaagagatcctcaccagaaactgactatgctggcaacttggatcttagatttccagcctgcagaattgttagaaaataaatgtctatcgtttaagccaccagtctgtagtattttgttatggcagtccaagctgactaagttttggtacccaggcgtgggatgctgcaacaacaaatacctaaacatggggaagtggctttggaaattggtgatgggtaaaggctggaagagtttgaggttcatactagaaaaagccaattgtgaagggactattgaaagaaatatggacattaaaggcaattctggcaaaggctcagaaaggaagagagctggacagaaagcttccattttcatagaaacttagatttataacgatcatggatagaatattaaatatgctggttaaaatatggactttaggccaggcgtggtggctcacgcctgtaatctcagcactttgggaggctgagggcacagatcacgaggtcgggagtttgagaccagcctggccaatatggcgaaaccctgtctctactaaaaatacaaaaattagctgggcatggtgatgtgcttctgtggtcccagctactcgggaggctgaggctgaagaatcgcttaaacccggggggtggaggttgcagtgacccaagatcacaccactgcactccagcctgggatacagagcaggactccactccccccgccacacacacacaaaaaatatatatatatggacattaaagtcaactcttgtgaggtctcagatgaaaatgagggacaggttattggaaactgtagaaatcactgttcttgttacaatgtgtcaagaacttggctgaattacgctgtagtgtttactggaaagaacttataagcagtaaaactggatatttaccagaagagatgtctaagcaaagtattgaaggtgtgatttaggtcctccttactgcttaaagtgaaatgtgagaggaaagagccgaaataaagaaggaatttttaagcaaaacacaatcagaacttggagatttgggatagatttctcaatctatattgtaaaaattgagaaagtttttcttgaagaggtatggttgaacaatgttttctttttctttttttttcttggttttatttttatttttatgttttttgagacagggtctggctatgtcatccaggctggagtgcagtggcacaatctcagttcagtgcaacctttgccttcaggctcaagcaatcctcccacctcagcctcctaagtagctgggactacatgtatgcaccaccacaccctggctaattttttgttgttgtttatagagatggggttttgacatgttgcctaggctggtctctaactcctgagctcaagtgatctgccctcctcagtctcccaaagtgttgggattacaggcgtgaaacactgagcctagcctgaacaaccatttgataaagagataatgggtgtgacccaaggatttaatcagccatctcagcagaagccaggaagagagatgggattattccagcagagacactgccaatttaaactaacgtaggcagagaaaacagaaaggaacaaaggaaggttgtcgactttttgaattctatagaacaggatcatagagctacctggctgtcaatgtgtactattctttaagaaaaggaaagactgacccaccaaaggcaacttacaagatcactagggctgactcttttgttttttcttgaggcagtctcactgtcacccaggctgtagggcaatggtgtgatctcagctcactgcaatctccacctcccaggttcaagggattctcttgccttagactcccaagtagctgggattacaggctctaaatctgtaccctcccgagtagcgctcctgccaccacttgcccagctaatttttgtatttttagtagagatggggtttcactatgttggccaggctagtttggaactcctgacctccagtgatccattctcattggcctcccaaagtgctgggattacaggcaggagccgccagggctgccactttgatgtcagactcagagagtacagatgggatagggtgggggtgggaacatgtagtcaaggctgactctacctgtttcaaagatgccctgcagaactgtgtgggagtctctcacagatggctgcctgggtgggaccccaccaaactgaaagaccgagacttcaggcagggcagatggagtaggccaactacagagccagaggtgacactgagacaccactgggcctggaaatcagggcatcaagccaaagagggtttttcttaagacctaacagaatttgccttgccaggttttggacttgattaggacacattacaccttccttctttcctatttctccattttctaatgggaatgtctattatgcctgtttcaccattgtaccttagaagcatgtaacatttctggtttcacacgttcaaagctggaaaggaattttgtctctggatgaatcacacattgagcctcacccgtaacctgatttagatgattttttagatgacactttgaactttagaattgatgctagaatgagttaagactttcagggggctgttgggatggaataattttttttttttttttgagacggagtctagctctgtcgcccaggctggagtgcagtggcaccatcttggctcactgcaagctctgcctcccgggtttatgccattctcatgtctcagcctccagagtagctgggactacaggcgcccgccaccacgcctggctaattttttttttattttagtagagatggggtttcaccgtgttagccagaatggtctcgatctcttgaccttctgatccgcctgccttggcttcccaaagtgctgggattacacgtgtgagccaccatgcccggctgggatggaataaatttatcttgtatgggagaaggacatacattttggcaggtcaaggacagaatgttatggactaaactgtgtcccccaaaattcatttattaaaaccctaaaccccagtgtgactgcatttggacatagagcctttagggggtacataaaactaaagatcacaggatagggccctaatcccattggggctggtgtccttacagaagatgagacacttagagctctctctccacgcaggcaccaaggaaacaccatacaaacacacagtgagatggcagccatctgttagccaggaacagattctcaccataaactatgttggcaccttgatcttaaacttccaggctccaaaactgtgagaaaatgaatttctgttccaagcctcttagatatggaaaaaaagattctgttgtttaagccatccagtctctggtattttgttatggcagcctgagtaggctaagacaatgaaggatgtggtaaaactttacgtcccaaccacataccaaagaggctggaatttagcatgctttcttctttcaactgtaggcaatgtgcacaagttctaaatcctaagacatgttggctcctttactctgcccaaactacaactcaaacaaacaactgtaatataataacatccaatgaagttctgacatttcttcaacatgagtacagtaattcaatgccagagaattcattttattttgaaatctacatgccatattccaatttctgttgaagatgcaatggttatatttattctttttaatatagatttatcagactgggcgcggtggctcatacctgtaatcctagcatttgagaggctgaggtgggcatatcacctgag

SEQ ID NO: 2139 - DNA, 8619 bp, Homo sapiens; identical to SEQ ID NO: 2138

SEQ ID NO: 2140 - DNA, 8619 bp, Homo sapiens; identical to SEQ ID NO: 2138

SEQ ID NO: 2141 - DNA, 3923 bp, Homo sapiens
gcagttagttttggggctggaaatttgagcagagagaatggcagagtcttttcaggagccagaaatgcatgtgaggaccaagaacttctaacagtagaggaactctggctggggtagttgagggggaggagaaatgaggatcaagggggcatacagtgcatgaaaacaaaaggtgaggcccaagatcagccaaagtgagtaaaccacggttaccatggctactcttcagtggagacggaaggaagccctgtatcctccccttccaaccacactacgctgttccactccccatctccatctcctgtaccccagacacactcaggcaagcacagcaccaccctggatgactctgcggaatgcctctcagagacacggaactagaaacctaggggaagagggacatcaaggcttttgcctcacaagctgactctggaacaaagagccaggctgaggggctggaagaagaaacttccagcagagccacccagatatgcttcccccaccctctagaccttccacaccaaccagtgtccagtcagtccacagagcatcctcctgggctgtggtgactgaagttgaagggaagaaaatataataataattttgggcaggtcgtctttctttactgtattggatggatatagaatcaataaatctataggtttatcccatttttctgaacaaatttagaggtcaaagatgaaccctcaaggggacagaatatgaccagcaggactattgatatcgtctgccctaggcactcctccttaccctcctctcccctatattttgggggcagtcatattcctcagcagtcagttgctctgcctccagtcctaactggcttctgaaaaacagttctggtccattcattccctgtctcgagacttccggagcttcctgacctgtgaatgaaatccacaggcccatcacaagatggctgcgctctccagtccccggcaccccaggctgctctgaacatgtgagagctcctccctcaaggcctgaattttcgcaggtcttcatcacactcagcccgccatcattttttcagattcagttccaatatgtcactctgtctgtagagccttccctgaatctcacagacaaatgcggcagttccctttgtgggggatattcatcatgtttttcctcattggcctatgtttttgcctcttcttgtagatgtccatctaggctgggagctcctagggggtaaacgcagcctctcactcacctggcacagagtcgatgctcatggaatgatacgtgatggggagagtgagtaagtgaatgaatgaatgaatgctattctggaaggaagagggagagagggagcagggaaaggtcagaagggggcccagagtcttcagcacacaatgtgggtgtatcactgtggccaggaacaattcgcttctctgcctgcattactttttgggaaatgggagagctgaggctcagtgtaggcaaactgggtccagtcagcagggaagccatgagctccacggtttaggggaggagtccggtgcttaaggaagctatcacgtggaagatctccctgccctcctcctattggtctgtattggtttttcttcttcaccagtggaggcttttcttctcccaggaagaatccagaatagttcagacaagcttcaggtccgccagaaccggggaaaacaacgtgtagggtttgttttaaagggcttttaaatggggtttgggagatccaggtagattagaatcttgactctgcactggctgtgcaagacagaaattcacctttcaaaacttctgttccccagtctatgcggtaagaagtttagattagctgatttctagggagattttgggcaggcatgattcagttccatgaagggctgtgggacaggactgcactaagaggtcctatagattggattcttcagttccctcccttccgctggagaatagaggaatctgccttcgctgcacactagatttacctggagaacaaatggaaagcaggccaggatcctgggtgaaatgtggcacatttgaggagacttcaacttcccttgccctccagtgtggtcttttccccacccccagacatgaaagggaagcaggtcacaaagcctttcggattataaaagaaacacttgcttctcacaaggggagcagcagacttactctgtactaaatgccaggataagcctctggctgggcctcgactgtgaccctccggcctctttctacagctctgcctggatggactggcctatctctgctggattcccgaagtgcattgtgtagagacagcaactcagaggtgggaccagctgccaggccctttctccattggttgagttcagcaggtaacctgaagctttgctgagaggtgcataaataaagagtgaaactagtaccacctccttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccgggcaggagtgcagtggctcaatcttgggctcactgcagcctcaacctcccagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggacactgtcatctctcaagtacccatcttggagggtacggaccccacatgaggatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtggtccccaggcaggtggctgggacactatttgcaatcagcaaggaaccctgctgcccttagactccccacagagcaagcagaacttgcagaatggggtaaaaacactctattaaagattttttaaacctatttatattgtaataaagtaaatgtaaataaaatttaagtgaaggcagattgcagatatttccgatgctatacaagatatatctcatagtatgggtgtagattctgcaaaggttaatgcagttaaacatatttgacacataaaaatgtcagatccaacattaatcattcaccaattgtaattgcctttctatgggtctcttctccccaagacatagcttaaaacaccaggctcggtagaaatctgggaggaaaaaagcaaataatacctctcagctgtcagggtctatgatacgctttgatagatttagcactgatttcattctctttacaattcagtgtgattgggtgtgcgtgtgtgtgtgtgtgtgtgtgtgtgtgtgtgtgtgtgttactccatgtttctcctttttaaggaaggagaaggtgtggaacaagagaaagttcctaagtctgaaggaagtccaacccagttatgaagggaatgccatccacaagccttttttataattggcccctgcctcaggtaaaggggtctcctttaaggagccagtctggctaaattggcagattctgaacaaagcctggccctgacaagtcttcagaaaaaccggttttcacctccagaatgtgccccag

SEQ ID NO: 2142 - DNA, 4139 bp, Homo sapiens
gcagttagttttggggctggaaatttgagcagagagaatggcagagtcttttcaggagccagaaatgcatgtgaggaccaagaacttctaacagtagaggaactctggctggggtagttgagggggaggagaaatgaggatcaagggggcatacagtgcatgaaaacaaaaggtgaggcccaagatcagccaaagtgagtaaaccacggttaccatggctactcttcagtggagacggaaggaagccctgtatcctccccttccaaccacactacgctgttccactccccatctccatctcctgtaccccagacacactcaggcaagcacagcaccaccctggatgactctgcggaatgcctctcagagacacggaactagaaacctaggggaagagggacatcaaggcttttgcctcacaagctgactctggaacaaagagccaggctgaggggctggaagaagaaacttccagcagagccacccagatatgcttcccccaccctctagaccttccacaccaaccagtgtccagtcagtccacagagcatcctcctgggctgtggtgactgaagttgaagggaagaaaatataataataattttgggcaggtcgtctttctttactgtattggatggatatagaatcaataaatctataggtttatcccatttttctgaacaaatttagaggtcaaagatgaaccctcaaggggacagaatatgaccagcaggactattgatatcgtctgccctaggcactcctccttaccctcctctcccctatattttgggggcagtcatattcctcagcagtcagttgctctgcctccagtcctaactggcttctgaaaaacagttctggtccattcattccctgtctcgagacttccggagcttcctgacctgtgaatgaaatccacaggcccatcacaagatggctgcgctctccagtccccggcaccccaggctgctctgaacatgtgagagctcctccctcaaggcctgaattttcgcaggtcttcatcacactcagcccgccatcattttttcagattcagttccaatatgtcactctgtctgtagagccttccctgaatctcacagacaaatgcggcagttccctttgtgggggatattcatcatgtttttcctcattggcctatgtttttgcctcttcttgtagatgtccatctaggctgggagctcctagggggtaaacgcagcctctcactcacctggcacagagtcgatgctcatggaatgatacgtgatggggagagtgagtaagtgaatgaatgaatgaatgctattctggaaggaagagggagagagggagcagggaaaggtcagaagggggcccagagtcttcagcacacaatgtgggtgtatcactgtggccaggaacaattcgcttctctgcctgcattactttttgggaaatgggagagctgaggctcagtgtaggcaaactgggtccagtcagcagggaagccatgagctccacggtttaggggaggagtccggtgcttaaggaagctatcacgtggaagatctccctgccctcctcctattggtctgtattggtttttcttcttcaccagtggaggcttttcttctcccaggaagaatccagaatagttcagacaagcttcaggtccgccagaaccggggaaaacaacgtgtagggtttgttttaaagggcttttaaatggggtttgggagatccaggtagattagaatcttgactctgcactggctgtgcaagacagaaattcacctttcaaaacttctgttccccagtctatgcggtaagaagtttagattagctgatttctagggagattttgggcaggcatgattcagttccatgaagggctgtgggacaggactgcactaagaggtcctatagattggattcttcagttccctcccttccgctggagaatagaggaatctgccttcgctgcacactagatttacctggagaacaaatggaaagcaggccaggatcctgggtgaaatgtggcacatttgaggagacttcaacttcccttgccctccagtgtggtcttttccccacccccagacatgaaagggaagcaggtcacaaagcctttcggattataaaagaaacacttgcttctcacaaggggagcagcagacttactctgtactaaatgccaggataagcctctggctgggcctcgactgtgaccctccggcctctttctacagctctgcctggatggactggcctatctctgctggattcccgaagtgcattgtgtagagacagcaactcaggtcaggctaaaagctcaagcaagcaagcgcgcacacacacgcgcgcacacacacacacacacacacaaacactcagcttccttaggacaagataaaatcttagcattcccctctccccgattaggtaggtctctgggaggactaaggcttcaggtgcaaggctcagataacctgcagtgtctctccaactctgggatgacaaagacctcacttcccttttctggtgttcacacaacaatgagaaagtacgggtagcctgcagaaagacctctccattcatggtcccccaggggtgtgggttctgagaggtgggaccagctgccaggccctttctccattggttgagttcagcaggtaacctgaagctttgctgagaggtgcataaataaagagtgaaactagtaccacctccttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccgggcaggagtgcagtggctcaatcttgggctcactgcagcctcaacctcccagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggacactgtcatctctcaagtacccatcttggagggtacggaccccacatgagggtgaggctctctgcacactccagaaaaggaccaaccacaccgagctcagttatggcacacacagtgggacctagacaaagggagagggtgaccgacatcccaactagggtccccaggcaggtggctgggacactatttgcaatcagcaaggaaccctgctgcccttagactccccacagagcaagcagaacttgcagaatggggtaaaaacactctattaaagattttttaaacctatttatattgtaataaagtaaatgtaaataaaatttaagtgaaggcagattgcagatatttccgatgctatacaagatatatctcatagtatgggtgtagattctgcaaaggttaatgcagttaaacatatttgacacataaaaatgtcagatccaacattaatcattcaccaattgtaattgcctttctatgggtctcttctccccaagacatagcttaaaacaccaggctcggtagaaatctgggaggaaaaaagcaaataatacctctcagctgtcagggtctatgatacgctttgatagatttagcactgatttcattctctttacaattcagtgtgattgggtgtgcgtgtgtgtgtgtgtgtgtgtgtgtgtgtgtgtgtgtgttactccatgtttctcctttttaaggaaggagaaggtgtggaacaagagaaagttcctaagtctgaaggaagtccaacccagttatgaagggaatgccatccacaagccttttttataattggcccctgcctcaggtaaaggggtctcctttaaggagccagtctggctaaattggcagattctgaacaaagcctggccctgacaagtcttcagaaaaaccggttttcacctccagaatgtgccccag

SEQ ID NO: 2143 - DNA, 356 bp, Homo sapiens
ggtgggcgtggaggtgtctggaactagcagaggtggtgagtggggcaggtatccacctaaccaggctgcaggggaggaggagggaagccgggaatggggtaggaagaaagctagaggtggcctgcaagctgggctggggcccccgccggcggccaccataaatactatgggagtttagccaatcccgagctccgctgtgtcttgtgctaaacattcctttctctccgtgcctctgtctcccctctgtcccccctcccaacctccctgtcccggccccctgctaatccgacttctcgccatcatcctcctggtgggtgtcaccatcgtgcccgttcttgtcttccttggagaggtgg

SEQ ID NO: 2144 - DNA, 356 bp, Homo sapiens; identical to SEQ ID NO: 2143

SEQ ID NO: 2145 - DNA, 1230 bp, Homo sapiens
ctgggagaggcaaaatggggtcacctggcctgggcccattcttttggagcccagagccaggagagcctaggtgcatcagacaacgaggtaccaatcactttgttcagactttggtcgctttacagtgtcatcatctgcaccctgaaatctaagggcctgaagccccaatcccaggggcagaacgttgtgcattttctttctcttgaagggctcttacaacctcaagtgattaaagaatcatctctgggccaggtgtgctggctcatggctgtattcccagcactttgggaggctgaggcaggctgatcacgaggtcaagagatcgtgaccatcctggccaacatggtgaaactccctctcaactaaaaatacaaaaattagctggtcatggtggtgcacgcctgtagtccgagctactcaagaggctgaggcaggagaatcgggccaggggcaaattccttttttttttttttttttgagacagagtctcgcttcgcccaggctggagtgcagtgacaggatctcggctcgctgcaagctccgcctcctgggttcacaccattctcctgcttcagcctgggactcagtagtgggactagcggcgcctgccaccacgcccggctaattttttttgtatttttagtagagacggggtttcaccgtgttagccacgatggtctcaatctcctgacctcgtgatccgcccgcctcagcctcccaaagtgctgggattacaggctcgagccaccgcgcccggccagccacgagcaaattcttatgcataggtgaggttaagccacagcagtggcttaagcacaactgtaacacagctttccccatttaaagtcacacttgattctaggtccagcttggtggcgggaggggcaggaagacagtctgtgaactgctttcctatatgaacacaatccactttttctgttaagaaagagtagaagcagcaaaaacccattggtactaactactaccatggctctactcaaatctgtgctccctaaaaagtcagttattaccgatagctcaaatactcaagtgcccaaccttctgcccattcccccccaactgttccttgagcagtatgaaaattcgggaaaatgaatggaaagaagcttctatacaccgcagcaggccataactgccaaatacagataatggaatccccactatcaatcaagaatcaatccacgttctcaccctcaaggattgttcccg

SEQ ID NO: 2146 - DNA, 1958 bp, Homo sapiens
agcctcccacagtggcctccgcacagtccccaggacgaccacagggagacctcgcagtccagcggcgtttctggaactggaccaagcaaaggggagaccgaggtgaacgctcgcgtgaagaggcgcttcgtacaaacggaagccacctcccaccaacgtgtgcattcatcagaggccacgcccacccttcgggggcacttgcgtttctccgcacagtcgcagagtgagcggcaagatgggatggcaccatagcaacctcggacacaacctagggactggagttgcgcgtttctacgtaagagccggagctgccgctcaagtccctgtggtggtggaactcccacatcgtggcagagccaagccagccagatggacagtgtttctctggctgtgtggcccagagcgggcagcccctaaggaggccaggagccccgcctcactctgccgtgcacgggaggacagtcagcaagggctcggctctcctcacaaatctgcgagtaccctgctgccagctttgtggctactgaaggatgagagagagtggagaagggggtcaatgtgcaggtgcagtgcctggactggtctggaagccctggccaggcccacacctggagcagccctctccagagatgcaggaacagggcttgcaaagaccttgggcgctgaggcttcgcaggggcactggtgtagaagccagagagccagggccccgggcagcccacctggggagcacacagagctgctggcagatcccagcaccccccagcttcctgactgaaaccgaggtggtgggagcgcccctgccctggctgcaatgaggagtcagtgagcactggcagtgcctgttctacagcgagggccccaccacaagcctctccaatgctgcagagccctgtcaggaggcctggggacaggcatccagcgtgtgagcaggaagccagagctgagccaggctggcttggcgtggacctggcggagcctcctgggtgccagccgccacatgcccatcccagcctctgccctcgggaagccagaagtcacaggagagacccttgtgggcggtggtctgtgctccgtccccactgcccactctggtccctcggctggcacagctggctctgtccgtctcccacccttctctccatgtcctgcctcctgctcagagctcatagcacagtctctccccacccttcccctgcaatactgcttctgcttggccacagctgactttatccctctcctagcccagggcactggccatgtgctcccctgcccactgtggcccagtgcccccaaatgtggggcaaaccgcacctctctggaccctctgcccacgaggggctcttcccgccagaccagttgcacaccacgaacagtgctggcacgtctgcctgttgggtaagtggctcggggacatctgcttggaatggggcatccgcgtggacaaatgagtgaggagcccaagcctgcactgggcaggggcagcaccgaggctggcacagggaggcccagttcatcccaaatgaggagggacccaggactgggcacagtctctgtctggggagtggttcccgccagccaggcggcctcctgtctgacctgacctggcccttgcttccagggacggctgacagtaagcttgtaattactgctgctcctcaagacgacatctgtccctaccacatggcttggggggcaggtgtggggcggccccgtacctgcctcaactccagccagcaacatggagggtggaggacgacggggcccatggccaggttggtgggctccagttcctcctcgggaaagtctgaagtccgctgttgtctggggcctacactgactgtcccacacccatatcaggtgagacccagagacccagagccaacaggccctgacccacgacccagcaatgcgctccagaccacaggcgctccgtgaggccagtggctgccacccag

SEQ ID NO: 2147 - DNA, 11120 bp, Homo sapiens
tcctctcttagtcactagctcttgggaaacccctttgaggccggtgttagattgatgaaagggtcaggggtaggcacacagggaatgatctacctatgcatataatgcacttgtgccttcagtacctggttaggagctagtcccacataaaccatttccagttggtaatgggattttatgagtgtgtcagatggcccagtacatgacggacagcttgggttgcaaatgacatgtaatacattagggataatcacttggcgtccagtggtcagtccagctcagaagtcactcccagcttctcctgctagcacagtcaatccagaatctctgcaatgtatatcaacaacatcagaccagtgtaaaatgatacctttccacccatttattaagcacccttagttaggaaaatcccaaaatcatgttggtttctaatcttgatcctcgctggtttgagcttgccattgtccttctttctgaagtgctgggatctaactgtccattctggagacagtcgagggtaatgcatgagaactggcttgctcttgcagtgagactgcaaaggatgcaaagaaatggcagtgtcgttacgaagtgtgtcagaagactggagaagagggtttccgctgacgaaggaggctctttgaggactgggtgattcagagaacttcaggttttccaaatcctctcatttgtctccatttggattctctgggtcttatcccttcctgatcaatgcttcagcaaggccatgattttaccagtgtagaaatgtggccagtcctgtggatcaaattttacctttggttttccctttttgttgttgttttttctttttgagacagaggctcgctctgtcacccaggctggagtgcagtggcacgatctcagctcactgcaacctccgcctcccgggtcaagcaattctcatgcctcagcctcccgagtagctgggactacaggcatgcgccaccatgcccggctaatttttgtatttttgtagagacgggctttcaccatgttggccaggctggtctcaaactcctgacctcaggtgatctgcctgcctctgcctaccaaagtgccagaattacaggcacgagccacggtgactggccgttctattttctcagttgtatggactcaagagggaagagggtatttcagaactgtcataggaagcccttggtttggtttaagtctcttccttcagctggtaacttcgggacttgagcttgccagtgtctttttttaagctgtgtggcatggcttaacaggactgcctggccggcgcatctgtaatcccagcacgttgggaggccgaggcgggcggatcacgatgtcagtggatcgagaccatcctggccaacatggtgaaaccccgtctctactaaaaatacaaaaattagccggcgtggtggcgtgcatctgtaatcccagctactcgggaggctgaggcaggagaatcactttaacccgggaggtggaggttgcagtgagccgagatcacgccactgtactccagcctggcgacagagtgagactctgtcacaaaaaaaacaggactgcctattgggcctcatatgcttgactgtttgatggcagaaacaactcattggctacaggctttgctttgaatggacccttcttccaggtgaccggtatgatgagaagtagagaggtaggggcaggtgtcagcgtctggatcttctctgggatcccaacagaagacattttcgtcctgctgtgctgaagacgggaccggaaggccattgctcagggagcgagcagatccagcctgtttggacgtggtgaggacccagccgtggggtttaaggccaagttagcctctcccttcactgattacaagagccattgttacaggtgctcacatgccaggagaaataagctggtgatttatgtggcacagcaccatcgatcgacctacaaaggaagcttcagtgcagccgtgttgctatacagacctctctcaccaaggcgtcatgaactgaagggctgggagaggcctcgtggaggaggaagagtttcgctcagctgcttgggtgtgggactgaatgtggttccagaactggtcgctgccttcacccgctgactctggtctcggcgatgacaagcccatggaacagacttacggcgtatgacctcatcggagacttgtacatggggccaacccccattttcccacaggaaacccacactctaattaagggctgaccctgaacttgaatctgagtcttctctttcttcaacagagagccatctctccagcccagctggcaaggagacaggtgatgttacaggaaaaaatacacagcttgtgcccttggaattaccagagttcaaagcctgttcagcatctacccaccatgtgacccgggtcgaattcttcagtttctctaagcccattttctcatctgtaagatggggaagtgtaatcagttctgaacccacatatacctcactgggcttgaacaggcctgagcaggcatgtggggctttactagctagccatcctttctgccgctctccctcattctccttcaagccccccaaagtccttggtggaggaggaagtggagacagaacgtttggtgttgggtgaggtacgtgaggaggctgatttcagaacctccaggaaacaaagctttagtgttccgagggcagtgcccgcctgtgcctcctcctcacagggggtagtaggagtggggtggggccgaggcatttcccagcacagctcaatcacatctcctgcgcctgcccttgtgacctgctcactggaaaggaagaaatgaccgagggagaagggagggcatttgaggggagaagaagaggatggagaaaaaaactggatcatctcgtgacatggaaagaaaggtctgagctctgacgatcccctcacgtgattataggcatgaggactcactcttcgaattgtttgaaaattgaatggactggctcacaccttctgaaatttcttggaagctctggagtaactattccactaaagaacagcgtgtttttggctgaaatctgtgactgtttgtttttgagttattttaatctctgtgtcaagcatgaaaacctcagcagcctgggatttataattagatcccactggcatgccctctcacctctcaaacatgccacagtgctttggctctctccttgtgcaaacctccctttgatatttttggatatcgataccaagtgtatctgcatattttaaccaactgatatgcatatcctgtgatctgaggcattcgctcaatgtggggcatcaggccagctgtgaacttcctttaaaatttattttgtgtcaaatgattccctaatgctatagctcccttgaactgctagatttatgaaaattctgcacaacacatagctcagagaaaaaaaaaaaagagtgttgcaagaccagatataggatatcatttgatttgtttaaaacactctgtccagggggttttgacttgctaatttaaaaataattctaaaattaggtacagttgacccttagtatccatgggggattggttccaggatgccctgtggataccagaatccaaggatgctcaagttcctgacataaatggcttagtgtttgcatataacctactcccctcttcctatatactttaaataatctctagattacttataatgcctaacacaacgcctgtgcatcacttcattcatgtggattcaatgtagtacttggtgtgaagaaaatttaagtcttgctttttggaactttgtggatttttttttctggaatgtttttgatctgcagttggttgaatccacaggtgcagaactatggacacagggggctgactatgtatatttatatccacttgcaaaattaagaataaaaataatgtgcatcagcaggtgcagattctgatgctcggtggacagtatgaagtcttccatttttaatgaagtctcaggcgatgctgctgttgcagtcctgtccaatagaatgttctgtgatggtggaaagattctctatcggctctatccaatacctaagccacacctttcacacatgggggagtgggatgggcaatggaagagcccaggcagggtagggagggggcagaaggaaggacagcagcacaggtaggcttactaagatccctaacatttatttagtgcctgtaatgggcaaggcagtgtgctgggtgctttacacctgttcagccacattcttacatcagcttgtgcagagcatttactcttcctggaacaatcctcggtgcagcgggtacaacaatgtaaaaagatccagtccttgctgctgggaaatttatagacacgttaactgaaactgtggagtaggatgaagtttctgagagaggagtctgcatttttaccctggcctttctatttcgtctgcaacattaagcaaggagcaaggaagagacatgattccagctttacctggggaaaatcaatctcacagcaatgagaagaaataaatgatgagttaaaattaatttctatatttttctaattattcaagtgactaatgtttggtgtgcagaaatttaagaagactgaggactagaatgaattataacgcaggagaaaacaataaccatgcatagtcagcaagaggcactgataccattttgagacgactggatgccctttcgtatgctaggaatatgcagcccgtgttctggaaagtggggagaaggtcaggcggctcctagcagcaaagctgcgttatcctcaatatcctgtaggggagggtttagggagttcggatatccctgcctttgacattcatcttggcctcagtttttctcttacctggaagcaagagaggagttgattgtgagttcagagtggaaatggtggccaatccagaccctgcactgccactgactctccgggaatgtcagcgccaggtgagagccaggattccagggccagacctgagcttgtccatagcctgggacttgaatggggggaaacttgggcacagtggcaggtggaaaatcaagtctgtgcttcaggggcatctaggaatgccctgtctatcttctcccctccccaaccccatttacccaggtgcctcctgttactttcaatactaatgccttctttttttttttttgagacagagtctcactctgttgctcaggctggagtgcagtgacgcaatctcggctcactgcaacctccgcctcccgggtccaagcgattctcatgcctcagcctcctgagtagttgggactacaggcatgcaccaccacgcccacctaattttttttgtattttcagtagagatggggttttgccatgttggccaggctggtctcgaactcctgacctcagtggtgggattacaggcatgagccaccacgcccaacctgatgccttctttttctgaccatttcctctccagcaatcccaccgtggccacaggaaaacctggcccaggagattccaatgttcttggcttcccctcctgtcacagcctcagtgattttgtgatttcatcttgcttctcagggcttgcttttatcaaaagggttggttagtcacaatggctgttaataggtgcaacaaggcatagaagacctgttaggggttgaacttttccccctacaactccaaaatattaatatattgcagtcctaatcttcaggacctccaagaatgtaaccttatttggaaatagggtcgttgcagatgtcattggttaatgatgaggtcgtactggatcagggtgggccccttatccaatatgactggcatccttgtagaaacaccacagtgtgaagagacagagattcacgcagagggaaaactatgtgaaaagatacacggagaagaccgtgtaaaaggtggaggatgaaggtaaggcagttgcaagccaaggaacgcctaagataaggaacgcctaagatagccaatgaccaccaggtctcagagaggcccgggacagattctccctcactgcccctagaagcaagcaaccccgctaaccccttgatttcggacctctggtctccagaagtggggcccagctgggataacctgactctagggccaccaaggtttgtcatcctgggcggcattcggggctggtgtgacccaccttatgcacaaaggccagaatagacctagcggcattgacaataggactggaatgccagctttgtctgtgaaggaagggcgcaagggaggacagctgtggtgggcaaaccctaaccatttccatccttgtttagcttttgttctgactacgacaggactacgtagtcgaactacgactcccaggaagccgttcggccttccccaccccctccccgcccaccccgctccgccccgtcccggcgcgggtccgcctggtatataagggccgaatggcccagccgactgcagggcgcgcaggcggcgcgggtgcgcggtgcggcgctggtatccagaggacgcggtcaccgcctctggcatttgtcgttctgcgcttctccgcaaggaccctctgttaggcaggcgcccaccgtaagcctcccgggccttgtgaacctgcaaacccaagtctgagagacgatccgccttcagcgctttccagcttggcagagaggctttcccggcggggatctttggttggcgctggcgatgcgcggggaagaaaggcgaggagcggcgtccaggctgggtgatgtcccagcacgagtaggcgggatgcgctcgcttggtcctccgggcgcccggtccctgcccgcgtcgcgcgcccacccctggggacgagaaggcggccgcctgaggacccccgcccgcgacctccgcgagtctggagcgcagaggacagggtctggctgctctttggccttggatggaaagtggggaattgggtggggggctgcggaccccttaacgtggattacttggtgtgtatcagctgggctcagaagacccacgacctcttctccatccgtggattgatttgttctgcttaacagctgggtcgccaagctggaggtatttttccctctccaccctggtcttctcctgtaacgtgtggccgccttttccagcacggcctcctgccttcctggtgcactttttggagaacgtggtggaatcagaggtttctggctgactcggtgggtgctttgaaccaggaaaggacaagaaagaggtgccacctcctgagtcctggttcctgcggctccgtcgaatctgcagtgaaggcctttgggaagcgtgggttatgtgggtccaggggtcccatcctcccgtggaggcccttgacctgaggatcactaactcacaccccaccgacttccggcccccaacaagggcagtgttcctcttgctccattctgctctgaagtcccccaaaccgcttcctggggctgcttagtgaaatacaaggctcatctctgaggacctctacagggctggatgggaaggactgatccacattcccaccaggaagtttagcagaacccccgcgtgccacctggaccccttggaaggacctggctcaggctggaccacctcttgagaggcaggagctctggatttgatcaagaattctttgctgagcatggtgcctcatgcctataatcccaacactttgggaggccagtgtgggaggatctcttgagcccaggagttcaagactagcctgggcaacacagagagaccccatctctaaaataataataataataaaataaaaaattagcagggcatggtggcatgtgcctgtagtcccagctacccaggaggctgaggcaagaggatggctggagcctgggatgttgaggctgcaatgaactgtgattaccccactgcactccagcctgggcaaaagagcgagagaccctgtctcaaataataataataataataatcttattttggagaataaagagacctctggatttgaggtgccatttgggtagaaagaaaagacgtttacaccgagaaatagtctgtgttgccctgaaggagcagagggatgcatcgctggaggtgacctacagttgaagaagactcattatgacagaccttgtccttcttccttgtggaaagtgtttcctctgctgctactgctcatgagactcttccccctccctgtcccagggaaccaaagggctttctaccacaccctttcttgccccccgcctcccatgtctgctgtgcctttgtactcagcaattcttgtttgctccattatcttccagccggatacagagtgaatagttaaccacacttaggtcaaataggatctaaatttttgttcctgctccgtgtaaagaggccagtgtttgtgtgttgcaagcagccttggaatagtaactcttctcatttgtttgggatctggccaccaagttccagaatgatacacggatcagtgcagaagttcatcaggctctcggaccttagggctgttggagaaggcttcagcagcagaactgatggtgaaggctcgtgttctccatcctcaactttctttgcttcgatcatacacaagaatacatttggaagggcaaaaaatgaacactgtcgttcattgcagccgtgttttgtgacacagatgcacagtctgctgtgaagaccttctctcaagtggcatttgggagtccatgccagatcatggtgcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattaaagtttttgtatgttgcagttgctgtgcttgtatgaccatttagtgaatttggtgtcttctaaatagaacagtggagtccttgtggacatctcagattcatcacaaaatgattgaggagaacctcttgaagatgtttagagctattgaaatttacagattgttgatgggttttcaccttttccttcctttcttgacacacagttacaggcattgtattccttggattcctacaggtgtcaaggaacagagatccacttacgttaccttcataaatcctggtttattcaaaagtcacagtaaggtagacaggaaatagtcccagccactgcctagctaagccttttcaaaaagcccaaggtcattcagcagatgcagaagcactagttggttttcaaagataacaagagcaataccatcatggtcgttttgatcctctgttcagcagcagggttcgctgcccctgactttagaattctgccatcgtgatgagctgaaggtcaccaacggtcccagtttgcccaggactaaagggtttcttgggatgaaggacattcagtgctaaacctgggacagtcctgggcaaactgggaaaactggtcaccctcctgggtgactcaacgaccatgcctctactttgttacttactattaactgactgatgctgttgactggtttagccaatctgcattcagagcttttgcgtctggttacttcgttggccttcaggcagccacagatggatgctattggatcaggcaccaatgctgaccaaatcaattgtttccaggatggtagggttgtatgaagaaccaactgagaccatgtccttctgagtgttgtggatggtgggcatggcaggccttcaaggtatcagggattcctctccaatacagccttacttacaaaggagaaactaactttctcatgaaaaacaaaacagttcattaagaaacaaaactaacacagccactgggaactgaggaagagagactgtaacatgtgtgcaagcacacacacacacacacacatgcatacacatgctgtctgtagaatcatgagccaggattccaaatctgcatctttgctagacagagatcaagaactaaaacctttgggatggtgttgtctgggaagcaaaggagttggctagaggacttcctgaaattcctttaaactctagaatcctttaaaatatcaagggtgtgtaaactggggctaagtatgtacattctctctaaaggctcctagataacctttgagttcaattcagtgtggagtggggcctcccagcttatacttacctttctagacactgacttttatctgggatgagggagcagaatttggaggtggtagtcagggcgggggtagggaggggagtgggtaagggatagttgcaccagcccaacttttttggtcttaagaacaacctgaacgcaaattacagggtcttttgtggactagaaaaagccaggttttcaggatcacgtggcgtcctgaagttgttgctgcttgtcagggcatctgacctccatcttctctgctgaaagacaggcatgagtgtttgcagtgccggaacaggggccttcagataatttcattcatctggcatggcaagaccacagggagggaattacatgctagggtagagatgaacttatggacgtatcatgcaccttggtgtttgcccctgtagtgattctcactaccttcgctaccattggagggatgctcacccacctccttgggtgccatttttcttttttaaaagatgaaggcatttcagatgatcccttcatttatgttctactttcattctttggtttcaaaagaagtcctgatcttatgtcaaaggcaacaatctcttctctcaatctctctctctctctcactctctctctctggctcactctgtcacccaggttggagtacagtggcatgatctcagctcactgcagcctcgacttcctgggctcaagaaatcctcctgtctctgccttccgagtagctgtgatcacagttgtatgccatcatgcccagtgaaatagaaaacaagatcatctgtatcaggaatgatggcagaagacgcttaaaattctggcattgccactgagaagaatgaaggatggagctgattagaaaattgtaggattgctgagcactgtgagaggtcctgtttggctggaactttacatgacagat

SEQ ID NO: 2148 - DNA, 3550 bp, Homo sapiens
gcagaggactggagagtacaaaaggaggaggctccccttcggagagcagagataagaggaggcagggagtgaaactgcctgaggaacagagaggagaggggaggagaggagaggagaggagaagagagcagaggagagatcagatctgtagctaggtcacatctggacaggacccaagtccaaggtaaatcgagaacaagtgatggaactaaagaatgaaggagaaatgggtggacagggcacaaattggggaatgacagcctattcagtgaggataggaaatgcacataaaggacagatgaagatgatttctctgtgtgtgattagaaggatagcaattacaaagataagagtgaaaggagagggaggaaaggggaaaagggaataagtaagaagacaaaataagcaatgagtgtctaagtaccgatctgaatgcttagaaaatcaccaggctgttaggctgagccaaaagaagagccacagccgtacccaagaggggaccatcggaaagacagaagcaggcaatttaagtagctagctactggggtaaaatgaaaaaaaagaaaaaatagaagatggaaaaggtgagaagcaaaagagggaaaacccaaaggagacactggcccagaaacctttttaactttctgtaagaatcttcaaggccccaaactaggccaagattctgactgacatttctgagctcaccagctgccgtttccttgagagaattctgacaggaaggcatagaaatgcgaaccaacactgccagctctggaaaataaataaataagtaaataactatccacatcctaaacacctcagtgggggccgaagcctgctggggaagaaagcccagcgaggaggagggacccgcctgcaacttttccccaggcttagacaaatgatgcttgagacacaccaagatacctgcacactagaggctgcagtcacctcagaagaaagatgccccctgctctggctggtcaaacggaaccaagtccgtcttcctgagaggtttggtccccttcaaccagctacagcagggctggcaatgcccagtccttggagaaacagaagagattcaactgcaactgaaattacctactaaaactttccttgagaaaacaattctggttttttcaccatattcttatgctcccaggaaggaagagaagaggagtcctggagtcaaaagtgagcaagattttaatgctcaacacacactgttctgtgcctttgcactcacagctgcagccacttacatgcttttgacagacacacagtcaagaaagagtttgaggatggagtttgtgccaaccctaagccagccaggggaagagcatgagacatagaagacagggctcctgctcactaggggctaacagtctaaggaaagaaattagacatgtatatatggtgtgatccaattgaattgcaagttatagcatggctagttccaaggcataattcttacctatcccaccaaatatgcctagcacattatgtatcatcaagtctctattgatctattcagcccaagatatctattcactaagcaatcatttctcagttccctgatctgtagaatagggataatagtacctgtcacaccaggcacagtggcttatgcctaaaatctcagcatttggggtggctaagacaggggattgcttgaggccaggagttccagatcagcctggtcaacatagcaagatgctgtttctaccaaaaaaaaattttttttgttttaattagctgaatgcggtagtgcacacctatagtcctagctacttgggaggctgaggcaggaagatcacttaagtccaggagatggaggctgtaatgagctaagttctcataatcgctaccttttactaagggagaattctgacctgtccttccagtttatcttttaagatttgtatcttttatggtgtgtgtctggaacttagacagtaataagtaaatatttgggtttaaaattctatagacatgtgtgttcacatgctgtattctgacacaaatggggtagcataagtgcctagagcccaccacagtgacctcagaggagaacacagagcttactagcacaaatctttgcattcaggaagacctggggttgaatgctgcccctctaatttattagctgtgatatatcctctccgcagctcaattaacattgcacaagccttagtttactcatctgtaaaatggggacaatgataccaacctcagttaccgtaaggcttaaaacagacagtgttaataaagagccaaatataagcccttaagaaatagtagctgttgttttactgctgtaaatggcaacagcacaaggacaatgctgtgtccacaggcacttgtatgtagaaggaaagagccaaattaaaaaaaaaataggagaagaactcaaaaaatacataaaggctcattgctcactgtagggttttgttttttgttgttgttgttttgtttttgtttttgtttattttttgagacagggtctcactctgttgcccagataggagtgcagtggcacgatttcagctcactgcaacctccgcctcccaggctcaagcgattctcctgcctcagcctcccaagcagctgagattacaggcacgcaccactaccacccgactaagttttatatttttagtagagacagggtttcaccatgttggccaggctggtcttgaactcctgacctcaagtgatccgcccgccttggcctcccaaagtgctgggattacaaatgtgagccaccgtgcccagcctatagggtatttttatattccaactattaattctactagcatgtagcatacatgcattcaccctagtacatatgactagcatataatatgctttacttttaaaaaatgctttatacatgagactgatcttaccatcttcaatatcctgtctggaaagccttcatttgtgagtgctgttgagatcacatgtcctcccaagtaggacatggagtgtgaaggccattgagtgggtgttccaaagggcagcacagaatggagtttagttgaaggtgctggggacacactacctgggctcaagtcccagctccccactctccagctgtgccacttgagcaagttgcttgacctctccaggcctgggtttcctcatctgtaaagtaggaatattgataataatatctacttcatagagtttcatgagaatacatgtaaaggcctgaaaccagtattgggtacataataatacattcttaagagtctttatttctgacaatgtacctgaaatgttcctgaaattaagttggtgttcaataaaaacatgttcactgaaagatcagcttctttgtttattttaagcacaaactatgggatcatgtaatttttggttcaactatttctacttatctctttcaatgcagcacactggttcaaagcagtagtaaggtgtgggggaaggatggcaacaagcttctctctgcttcccaggtctgtgatgaaatggaacttccctgcgaactaggggtatgcctctgggagtagaagcagggtgatct

SEQ ID NO: 2149 - DNA, 808 bp, Homo sapiens
cttaaaccaaggtaatctgccacgtgtcgcactctagttgcctttcccaatagaagtagggacccagaaaatgaggaccaacccccaatcaagtcctagaaagcctcaggtccacacaaaggtctgtaactaaagcagcctgtaattcctgcctcaaggctcacacacactgctaaacctacaccaagtttaagtcaaggaacctttttcccctgctgaaaggtccaggggattttttttttttttttttttaaaaagggccttgcttggttgctcaggctggagtacaatggggcaatcatgggtgattcctggcctcaagagatcctcctgcatagctcggactacacgtgtagtcctgcattaccaggactacctaaacatcaaaaagcttcatggaatgcaggtttttttggctccagactgctggtccagcctgctccccatcccttgaggcccaactcaccgaatcagggtgttgaccttggccacatcaatgtcatacagcttcttcacagcctgtttaatctggtgcttgttggctttaacatccacaatgaacacaagtgtgttgttgtcttctatcttcttcatggcagactcagtggtcagcggaaacttgatgatagcatagtggtcaagcttgtttctcctgggagcgctcttccgaggatatttgggctgtctccggagtcgcagtgtcttcggccgccggaaggtgggtgacgtgcggatcttcttctttttgtggctgtggacacctttcaacactgccttcttggcctttaaagccttcgctttggcttca

SEQ ID NO: 2150 - DNA, 808 bp, Homo sapiens; identical to SEQ ID NO: 2149

SEQ ID NO: 2151 - DNA, 808 bp, Homo sapiens; identical to SEQ ID NO: 2149

SEQ ID NO: 2152 - DNA, 808 bp, Homo sapiens; identical to SEQ ID NO: 2149

SEQ ID NO: 2153 - DNA, 2476 bp, Homo sapiens
tcagggggcgcctgcagggggtaggagccgctctcaaggatgtctgtctgtagccccatggtggggtatatgtttgtaaccccattgcaggatatctgggttggtgagtatcctaggcattgccaatgcctccttccttctgctgactggttctgtaccctccggtggggtgtctgtagccccactgagggatgttggcttgtagctccaccatggggtgtctgtgtctgtaacccaattcggggtgtctgtctcagtttgtctcctgggggtctcagttggctctttcttttatatttattttttgagacagagtctccctctgtcacccaggctggagtgcagtggcacaatcttggctcactgcaacctctgcctcctgagttgggatcaagtgattctgctgcctcagcctcctgagtagctggcactacaggtgtgcaccagcatgcccggctaatttttgcattttttgtagagatgggattttaccacactggccaggctggtctcgaacttctgtcctcaagtgatcctcctgccttggcctcttaaagtgctgggattacaggcgcgagccactgcgcccagcctcagttggctctttctaactagtagaaagagtcttggtttgggagacttctcctcaatcaggaagatttcgaggagatttctcagatggagaatagaaggacagtttggaagggacactcttggagttcttggttagggatctgatttggaaaacgctgtgttcatcttgtctttatgtgtgtttgtatatgtggaggggatctcagagggaattgctgatggacgttcagcaggcctaactcagagaaccctccttatttgtctggtcacattcggtgagccctgaaaaatgctcagcaggcctgtctcggggtgactatgtgctcttcgccttgcccagagaccccattgtgaattaccctttggaggtcatcccgccccagctggggtggatcaaagacaacagagaccaacgggagaaagtttgggctttgccaggctgatagtgggtgctgaatgaggtgattcatgtctgttttgttatgtgtatttcgctgggatggaaaatgttaattgggttccccaggcagcctgttgggcagcatcttgcaaattaagaatcttgtctgtggttccataacacagaaaggggtgattttctcttgtaaagtggtttgaaccccacagccatggcactagcgagcagggtcatcagagctgctccattcttctggaagctgcagagaaagggagcccggaaacctggtatgccggcaaaaagggtaagtggcagggaaaaaggggaggagagagaaaagacagactcagttggcctcatgctatcttcactgggtcttgttggaaagctaagtctcctctatcagagtaaagatttttcctttttaaaatttttggagctatcattttggccaaatggatgacttatggtgacctgggatgctattttgtgatattcagtgttttaaacctttgatatttgacaaacgttccaaaaccaaattataaattatgtctctttttaaccttttagatattaggttctttaaagtccaaaaatgacatttggcttatttggtataaaaatcatacagaaagcattgtcaaatatgacatggtgtttggctttctttgggctatatttgtgcaaatatgttattgacacatatttcaaaattatgtaaaacacctataattctaatatgacttagtataagttatcagtaataattataattattatgttaaatgactgtgtgccacagaggtaacaaatttccttgccaattgtgtctttaactgtggctgccctaaaatgttttgtcatccacaggcaattgttgtctcattttggtcctctttttttctttttttttttttttggagatggagtttcactcttgtactcttgtcgcccaggctggagtgcaatgacacgatcttggctgactgcaacctctgcctcccgggttcaagcaattctcctgcctcagcctcctgagcagatgggattacagtttataatcaggtataagtctcttggggaatctgacctcatacctcatctatgcagttcctgtacaaggttcctgacctgtggtctttagataaactctttcaaccaactgccaatcagaaaatctgtgaatctgcctgtgatctggaagcctctgcttcctggtgtgccacctttcccgtctgaactgatgtacagcttaaatgtattgattgatgccttatgccctatagcatgtataaaacctagctgtgccctgatcacctgggtcacacgttctccgggtctcctgaggactgtgtcacgggctgtggtcactcacgtttggctcgaaataaatctctccaatattttacagagtttgttctttttgttgacaatcttttaaaatgtctaatcaggagaaaa

SEQ ID NO: 2154 - DNA, 6385 bp, Homo sapiens
tcagggggcgcctgcagggggtaggagccgctctcaaggatgtctgtctgtagccccatggtggggtatatgtttgtaaccccattgcaggatatctgggttggtgagtatcctaggcattgccaatgcctccttccttctgctgactggttctgtaccctccggtggggtgtctgtagccccactgagggatgttggcttgtagctccaccatggggtgtctgtgtctgtaacccaattcggggtgtctgtctcagtttgtctcctgggggtctcagttggctctttcttttatatttattttttgagacagagtctccctctgtcacccaggctggagtgcagtggcacaatcttggctcactgcaacctctgcctcctgagttgggatcaagtgattctgctgcctcagcctcctgagtagctggcactacaggtgtgcaccagcatgcccggctaatttttgcattttttgtagagatgggattttaccacactggccaggctggtctcgaacttctgtcctcaagtgatcctcctgccttggcctcttaaagtgctgggattacaggcgcgagccactgcgcccagcctcagttggctctttctaactagtagaaagagtcttggtttgggagacttctcctcaatcaggaagatttcgaggagatttctcagatggagaatagaaggacagtttggaagggacactcttggagttcttggttagggatctgatttggaaaacgctgtgttcatcttgtctttatgtgtgtttgtatatgtggaggggatctcagagggaattgctgatggacgttcagcaggcctaactcagagaaccctccttatttgtctggtcacattcggtgagccctgaaaaatgctcagcaggcctgtctcggggtgactatgtgctcttcgccttgcccagagaccccattgtgaattaccctttggaggtcatcccgccccagctggggtggatcaaagacaacagagaccaacgggagaaagtttgggctttgccaggctgatagtgggtgctgaatgagtggtttgaaccccacagccatggcactagcgagcagggtcatcagagctgctccattcttctggaagctgcagagaaagggagcccggaaacctggtatgccggcaaaaaggatggagtttcactcttgtactcttgtcgcccaggctggagtgcaatgacacgatcttggctgactgcaacctctgcctcccgggttcaagcaattctcctgcctcagcctcctgagcagatgggattacagtttataatcaggtataagtctcttggggaatctgacctcatacctcatctatgcagttcctgtacaaggttcctgacctgtggtaagtaatgaatgtcacttagataaccccaagttacctttgggcctcaagaggagaggaatttacccaactcatagttatttgagggtacaaaccgatggctgggctcggcttttaaaaagtcatatgtgggattcctcatggaacagaattccatcaaagcccattaaaaagagcctaagtgaaaaataattattcttgctgcaaatgatcaggccaagtacgggaagactaaagttgattttgtaaacaaatccgttctatcatgatttgtttttaataaaaatggggactgaagagagaaaaattatatttcaaaagaaagctatagtacacctgttgttagctgttattgaggtttttttctgcagtttggattaattcctaaattctttgtgggttagaagtccccaaactcatgctttctaatcattgcttttaaaactgggaattgtactgctcatcctaggactcgttatttaccttatggtacactgttcagttaaatactgtactgaaagtatagatgagggtactaatgcttttgccatgcaaggtttggaagcccagtcagacctgcatgcgtcgcccagacagcagtaaattggttcactcctctcaccttggggttcactcctctcaccttggggttcactcccattcccactacgccctctgtcagcaggaagacgccagagcgatccgcagtcttttcccatcttcataggctaacctcaagattaaggtgttataaaacacaaagggagggattgaaactacctttgcaaaattatgactgagacagtgaaagaaatctaacttgatcgactccatcttgcttctaacctgcaagctgtccttgtccattcttggaccgaggctgaattaactttgggaggaacttagtttatagtttaaatcaaagacggtaacagccctttcccaaagcagacctccttcttgcctgaagactaaattgcctttgtagggctaacaataaccacgagataagaaatcatggtggaggagtcatgtagctggagggtacaagattctgaccctccctaaactgctcctaagattagtgcttgagctattttgccgaccctgcacttgatagatcagctgacaccacccagatggataaactggctcatctgacttgcggcccccacccaggatctgactcggtgaaagaagacagctttgactccctgtgatttcacccctgaccaatcagcgctcccagctcactggcttcccccgcacccaccaagttttccttaaaaattctgctcaccaaatgctcaggaacattgatttgggtaataacacaattccggtcgcttgcaaaattaaaaaaaaatctaaacagtacagcatgttctttatatattatctgaaagataattttcagaaaaaggtaaaacaatgacttgcaccaagatattaaaatacacaactcttaaagattttattttacacatatgatagaagggaactaggcagatgttagaaatagtttaaaggaaaagtgaaaacaatacaaatttatatggagtaaaggaattttgaaatgagttgcaaatggaaagaaaacttttttatttatttattttcaaattttttacaggagaaagaagccagtaaaaatcactactagacagggcagaagatagatagatagatagatagatagatagatagatagatcgatctatgtctatatatctccatcagttacctgcaatttgcaaagaattgtaaaatagttcaaagacaatgaacaacccagaagtatgtgttacagttttccattgaaacacattttttaaacatatctaataggtatgtcttaactagcgaattcacaccactcttcagtgagaggactatttattgatcatctgcctgtgtgttgcaggttgctgtctacctttttcaaatttgaagcaaagattttcattaaaagattttcactagaattaattaaaaatcaaagcccaaatcaaaacagaatacacagcaagctgtgctagtgacatggatgacaacttctcctggggattacaactctcagggtgacatccgtgtagatgattctgtaactgttaaaatgaaaaactcccaccctgtgggaacagagccgggtgagccctggcttccacacagtgccaccctgagaaggcgaggtctccccagcgtctgtctgcagtgcagccagggcggaggaatgaagtgtcacagcaggaagcagatggctgcatttgcagataatcaatctagagacttgcagccctgagtttcaggggaacttgtctaagtagcatcctgtcgctggaaggcatctaatgaactaagttactggtgttcttgcttgtcagatagccctggaacactgtctggattttataatcattttcttgagattgacaaagtctaaattcttgctgatcattgacgagtctaagttgtaaagaatgctacccatggatggaactttttgcttaaacttaagaaagggaggagaaataacagcagcggtgccccgtgaaggtttcccaaacatggaggagtcctggtataaaccatgccttggacccacagcggaaggaggagcacagcacagctgggatcacgaggactctgaagtctcctgggacgtgacaggagcaggctcagccactgtgcacagcgtgcgtccttgagcaggtcacctaaactgcctgggtctcacatccctgccattcatggtgttggggcttgccctgactttgtaccaagatcagagaggggcttatagtagggagaacccaggcagcgggaggaggcacttccaagcccccaagggtaggcgtggccttcccggcccccaagagtgcagggatgccagaggctgcagcggcagatttgggcgactgcgggtgtgcagggtgggggctcctgcctgcgccatggagctggaggcccctgtctgcagccccagttcgggcggcttccgcgagcgcagcagtgcctaggagcatgcagggctcctgcctgcccccacccacccaagagcaaagggaggctcagatctgcagccgcaacatgggcggctgcagccctgtccaggagggtggggctcctacccgcctggattaggaggtcaggtcagcatccccagtttgggcggcaccctggagtgccacagcacccaggagcgcacggctcctgcctaccctcagccctccaagagcacacagaggctcgtgtctaccgccccaactcgggcggctgcagccgcgcgggagagattggcggtgctgctgcctgctcctggctcccacccactccgtggggcacacagccccaactgtgaccccttgcagcctgaggcaggggctcctgatccttgctgggctcaggccagcgtccagggcaggggcaacattaccacgagctccccctgttgcccccgtactcaggggtggcccagggcagagtggatcgtgggcctcaggccccgccctcaggaatggcaggcttggtggtcaccccgacgccaggcggactccaaggatacggtctgggcagcccccacgcagagcctcctcccgcgacccaggaacccggcaccctctgtggggtgggcacagtgggtgcccagctggccaggtcccctgagtaggtgtcactatcccttcctgccccggatccccgaagtgcggcccagccctcatcaggcccctttctgtcggaggagctactgccccactgcacggctgccccgccggtgggtgaactggaccccgcctagctccatcccggcggcccccagggcagcgggtggagggagggggctgtccacctcctccctgcacacgccccgcagcagtctgcgtgcgggcaggggccaggccgcaccagatggcccactgctgccatcacaggcactaacaggaatcagccttctgcatccaggccttgtgttaatgtgtgaatgacaaagcaaaagaccccagtgtgtgaggcaggaatttggacatcagaaggaggaaaaacaggatgaagcttccggaaggaataaccatcccagctgtatcaccacacacacctagaaccctttagtcaggaggagggaggacggatccaacgtggaatatgtaggatttttccgttagcctgaatgtaccaccagatggaaggagggtcaagaacataagtctgtgccttgaggactaaactctgaccttttttctctcctgcccaaattcctacctaaggggcctggggaggtcaccctacaaaccacaaagcctcattggaggggtcttattaaccctgtgtaactcggctctttccaaccttactctggtgtaacctcacatgacagataaggaagaaaatccaaatattttaaccctaaatatgtttcttggccatatcttgaaatgtccctgcagagctgtctcatgtggggaaagtctatattctgtagaaaatcctgttccctttccaggcctttttcctcatccaggaaatactccactaagtttctggcaccttttaagtctgataagaaacatttaccatcgattctctgtaagtcttctacctggaggctgcatcagcgtaataagaaccttggtctccacaaccccttatcctacccagatatttcctttctattggttccaggtctttagataaactctttcaaccaactgccaatcagaaaatctgtgaatctgcctgtgatctggaagcctctgcttcctggtgtgccacctttcccgtctgaactgatgtacagcttaaatgtattgattgatgccttatgccctatagcatgtataaaacctagctgtgccctgatcacctgggtcacacgttctccgggtctcctgaggactgtgtcacgggctgtggtcactcacgtttggctcgaaataaatctctccaatattttacagagtttgttctttttgttgacaatcttttaaaatgtctaatcaggagaaaa

SEQ ID NO: 2155 - DNA, 5819 bp, Homo sapiens
tcagggggcgcctgcagggggtaggagccgctctcaaggatgtctgtctgtagccccatggtggggtatatgtttgtaaccccattgcaggatatctgggttggtgagtatcctaggcattgccaatgcctccttccttctgctgactggttctgtaccctccggtggggtgtctgtagccccactgagggatgttggcttgtagctccaccatggggtgtctgtgtctgtaacccaattcggggtgtctgtctcagtttgtctcctgggggtctcagttggctctttcttttatatttattttttgagacagagtctccctctgtcacccaggctggagtgcagtggcacaatcttggctcactgcaacctctgcctcctgagttgggatcaagtgattctgctgcctcagcctcctgagtagctggcactacaggtgtgcaccagcatgcccggctaatttttgcattttttgtagagatgggattttaccacactggccaggctggtctcgaacttctgtcctcaagtgatcctcctgccttggcctcttaaagtgctgggattacaggcgcgagccactgcgcccagcctcagttggctctttctaactagtagaaagagtcttggtttgggagacttctcctcaatcaggaagatttcgaggagatttctcagatggagaatagaaggacagtttggaagggacactcttggagttcttggttagggatctgatttggaaaacgctgtgttcatcttgtctttatgtgtgtttgtatatgtggaggggatctcagagggaattgctgatggacgttcagcaggcctaactcagagaaccctccttatttgtctggtcacattcggtgagccctgaaaaatgctcagcaggcctgtctcggggtgactatgtgctcttcgccttgcccagagaccccattgtgaattaccctttggaggtcatcccgccccagctggggtggatcaaagacaacagagaccaacgggagaaagtttgggctttgccaggctgatagtgggtgctgaatgaggtgattcatgtctgttttgttatgtgtatttcgctgggatggaaaatgttaattgggttccccaggcagcctgttgggcagcatcttgcaaattaagaatcttgtctgtggttccataacacagaaaggggtgattttctcttgtaaagtggtttgaaccccacagccatggcactagcgagcagggtcatcagagctgctccattcttctggaagctgcagagaaagggagcccggaaacctggtatgccggcaaaaagggctggagtgcaatgacacgatcttggctgactgcaacctctgcctcccgggttcaagcaattctcctgcctcagcctcctgagcagatgggattacagtttataatcaggtataagtctcttggggaatctgacctcatacctcatctatgcagttcctgtacaaggttcctgacctgtgcaggaagacgccagagcgatccgcagtcttttcccatcttcataggctaacctcaagattaaggtgttataaaacacaaagggagggattgaaactacctttgcaaaattatgactgagacagtgaaagaaatctaacttgatcgactccatcttgcttctaacctgcaagctgtccttgtccattcttggaccgaggctgaattaactttgggaggaacttagtttatagtttaaatcaaagacggtaacagccctttcccaaagcagacctccttcttgcctgaagactaaattgcctttgtagggctaacaataaccacgagataagaaatcatggtggaggagtcatgtagctggagggtacaagattctgaccctccctaaactgctcctaagattagtgcttgagctattttgccgaccctgcacttgatagatcagctgacaccacccagatggataaactggctcatctgacttgcggcccccacccaggatctgactcggtgaaagaagacagctttgactccctgtgatttcacccctgaccaatcagcgctcccagctcactggcttcccccgcacccaccaagttttccttaaaaattctgctcaccaaatgctcaggaacattgatttgggtaataacacaattccggtcgcttgcaaaattaaaaaaaaatctaaacagtacagcatgttctttatatattatctgaaagataattttcagaaaaaggtaaaacaatgacttgcaccaagatattaaaatacacaactcttaaagattttattttacacatatgatagaagggaactaggcagatgttagaaatagtttaaaggaaaagtgaaaacaatacaaatttatatggagtaaaggaattttgaaatgagttgcaaatggaaagaaaacttttttatttatttattttcaaattttttacaggagaaagaagccagtaaaaatcactactagacagggcagaagatagatagatagatagatagatagatagatagatagatcgatctatgtctatatatctccatcagttacctgcaatttgcaaagaattgtaaaatagttcaaagacaatgaacaacccagaagtatgtgttacagttttccattgaaacacattttttaaacatatctaataggtatgtcttaactagcgaattcacaccactcttcagtgagaggactatttattgatcatctgcctgtgtgttgcaggttgctgtctacctttttcaaatttgaagcaaagattttcattaaaagattttcactagaattaattaaaaatcaaagcccaaatcaaaacagaatacacagcaagctgtgctagtgacatggatgacaacttctcctggggattacaactctcagggtgacatccgtgtagatgattctgtaactgttaaaatgaaaaactcccaccctgtgggaacagagccgggtgagccctggcttccacacagtgccaccctgagaaggcgaggtctccccagcgtctgtctgcagtgcagccagggcggaggaatgaagtgtcacagcaggaagcagatggctgcatttgcagataatcaatctagagacttgcagccctgagtttcaggggaacttgtctaagtagcatcctgtcgctggaaggcatctaatgaactaagttactggtgttcttgcttgtcagatagccctggaacactgtctggattttataatcattttcttgagattgacaaagtctaaattcttgctgatcattgacgagtctaagttgtaaagaatgctacccatggatggaactttttgcttaaacttaagaaagggaggagaaataacagcagcggtgccccgtgaaggtttcccaaacatggaggagtcctggtataaaccatgccttggacccacagcggaaggaggagcacagcacagctgggatcacgaggactctgaagtctcctgggacgtgacaggagcaggctcagccactgtgcacagcgtgcgtccttgagcaggtcacctaaactgcctgggtctcacatccctgccattcatggtgttggggcttgccctgactttgtaccaagatcagagaggggcttatagtagggagaacccaggcagcgggaggaggcacttccaagcccccaagggtaggcgtggccttcccggcccccaagagtgcagggatgccagaggctgcagcggcagatttgggcgactgcgggtgtgcagggtgggggctcctgcctgcgccatggagctggaggcccctgtctgcagccccagttcgggcggcttccgcgagcgcagcagtgcctaggagcatgcagggctcctgcctgcccccacccacccaagagcaaagggaggctcagatctgcagccgcaacatgggcggctgcagccctgtccaggagggtggggctcctacccgcctggattaggaggtcaggtcagcatccccagtttgggcggcaccctggagtgccacagcacccaggagcgcacggctcctgcctaccctcagccctccaagagcacacagaggctcgtgtctaccgccccaactcgggcggctgcagccgcgcgggagagattggcggtgctgctgcctgctcctggctcccacccactccgtggggcacacagccccaactgtgaccccttgcagcctgaggcaggggctcctgatccttgctgggctcaggccagcgtccagggcaggggcaacattaccacgagctccccctgttgcccccgtactcaggggtggcccagggcagagtggatcgtgggcctcaggccccgccctcaggaatggcaggcttggtggtcaccccgacgccaggcggactccaaggatacggtctgggcagcccccacgcagagcctcctcccgcgacccaggaacccggcaccctctgtggggtgggcacagtgggtgcccagctggccaggtcccctgagtaggtgtcactatcccttcctgccccggatccccgaagtgcggcccagccctcatcaggcccctttctgtcggaggagctactgccccactgcacggctgccccgccggtgggtgaactggaccccgcctagctccatcccggcggcccccagggcagcgggtggagggagggggctgtccacctcctccctgcacacgccccgcagcagtctgcgtgcgggcaggggccaggccgcaccagatggcccactgctgccatcacaggcactaacaggaatcagccttctgcatccaggccttgtgttaatgtgtgaatgacaaagcaaaagaccccagtgtgtgaggcaggaatttggacatcagaaggaggaaaaacaggatgaagcttccggaaggaataaccatcccagctgtatcaccacacacacctagaaccctttagtcaggaggagggaggacggatccaacgtggaatatgtaggatttttccgttagcctgaatgtaccaccagatggaaggagggtcaagaacataagtctgtgccttgaggactaaactctgaccttttttctctcctgcccaaattcctacctaaggggcctggggaggtcaccctacaaaccacaaagcctcattggaggggtcttattaaccctgtgtaactcggctctttccaaccttactctggtgtaacctcacatgacagataaggaagaaaatccaaatattttaaccctaaatatgtttcttggccatatcttgaaatgtccctgcagagctgtctcatgtggggaaagtctatattctgtagaaaatcctgttccctttccaggcctttttcctcatccaggaaatactccactaagtttctggcaccttttaagtctgataagaaacatttaccatcgattctctgtaagtcttctacctggaggctgcatcagcgtaataagaaccttggtctccacaaccccttatcctacccagatatttcctttctattggttccaggtctttagataaactctttcaaccaactgccaatcagaaaatctgtgaatctgcctgtgatctggaagcctctgcttcctggtgtgccacctttcccgtctgaactgatgtacagcttaaatgtattgattgatgccttatgccctatagcatgtataaaacctagctgtgccctgatcacctgggtcacacgttctccgggtctcctgaggactgtgtcacgggctgtggtcactcacgtttggctcgaaataaatctctccaatattttacagagtttgttctttttgttgacaatcttttaaaatgtctaatcaggagaaaa

SEQ ID NO: 2156 - DNA, 7677 bp, Homo sapiens
tcagggggcgcctgcagggggtaggagccgctctcaaggatgtctgtctgtagccccatggtggggtatatgtttgtaaccccattgcaggatatctgggttggtgagtatcctaggcattgccaatgcctccttccttctgctgactggttctgtaccctccggtggggtgtctgtagccccactgagggatgttggcttgtagctccaccatggggtgtctgtgtctgtaacccaattcggggtgtctgtctcagtttgtctcctgggggtctcagttggctctttcttttatatttattttttgagacagagtctccctctgtcacccaggctggagtgcagtggcacaatcttggctcactgcaacctctgcctcctgagttgggatcaagtgattctgctgcctcagcctcctgagtagctggcactacaggtgtgcaccagcatgcccggctaatttttgcattttttgtagagatgggattttaccacactggccaggctggtctcgaacttctgtcctcaagtgatcctcctgccttggcctcttaaagtgctgggattacaggcgcgagccactgcgcccagcctcagttggctctttctaactagtagaaagagtcttggtttgggagacttctcctcaatcaggaagatttcgaggagatttctcagatggagaatagaaggacagtttggaagggacactcttggagttcttggttagggatctgatttggaaaacgctgtgttcatcttgtctttatgtgtgtttgtatatgtggaggggatctcagagggaattgctgatggacgttcagcaggcctaactcagagaaccctccttatttgtctggtcacattcggtgagccctgaaaaatgctcagcaggcctgtctcggggtgactatgtgctcttcgccttgcccagagaccccattgtgaattaccctttggaggtcatcccgccccagctggggtggatcaaagacaacagagaccaacgggagaaagtttgggctttgccaggctgatagtgggtgctgaatgaggtgattcatgtctgttttgttatgtgtatttcgctgggatggaaaatgttaattgggttccccaggcagcctgttgggcagcatcttgcaaattaagaatcttgtctgtggttccataacacagaaaggggtgattttctcttgtaaagtggtttgaaccccacagccatggcactagcgagcagggtcatcagagctgctccattcttctggaagctgcagagaaagggagcccggaaacctggtatgccggcaaaaagggtaagtggcagggaaaaaggggaggagagagaaaagacagactcagttggcctcatgctatcttcactgggtcttgttggaaagctaagtctcctctatcagagtaaagatttttcctttttaaaatttttggagctatcattttggccaaatggatgacttatggtgacctgggatgctattttgtgatattcagtgttttaaacctttgatatttgacaaacgttccaaaaccaaattataaattatgtctctttttaaccttttagatattaggttctttaaagtccaaaaatgacatttggcttatttggtataaaaatcatacagaaagcattgtcaaatatgacatggtgtttggctttctttgggctatatttgtgcaaatatgttattgacacatatttcaaaattatgtaaaacacctataattctaatatgacttagtataagttatcagtaataattataattattatgttaaatgactgtgtgccacagaggtaacaaatttccttgccaattgtgtctttaactgtggctgccctaaaatgttttgtcatccacaggcaattgttgtctcattttggtcctctttttttctttttttttttttttggagatggagtttcactcttgtactcttgtcgcccaggctggagtgcaatgacacgatcttggctgactgcaacctctgcctcccgggttcaagcaattctcctgcctcagcctcctgagcagatgggattacaggtgtgtgccaccatgctcggctaatttttgtattattagtagagacggggtttcaccatggtggctaggctggtctcgaactcctcacctcaggtgatccactcacctcggtcccccaaagtgctgggattacaggtgtgagccactgtgcctggccagtcctctttaaaggatggttttataatcagctataaaatttaacaggggctcttcagtgcagatttctgattaataacctggagattgtgacgttagaatagagaaaaaaactttcaaatagaagagtgaatagtgtttggttgtctttggactgtatctgtatagatatgttattagtatgtgtttcaaaattatgggaaacttctataattctgatataatttagtgttattaataattataatttttatacaaaattgttgtatgccacagaagtaaacaaaattctagtcaattgtagctttagtagtggctatcttaagacttctatcatacacagacatttcgtcttgctttggcagtttataatcaggtataagtctcttggggaatctgacctcatacctcatctatgcagttcctgtacaaggttcctgacctgtggtaagtaatgaatgtcacttagataaccccaagttacctttgggcctcaagaggagaggaatttacccaactcatagttatttgagggtacaaaccgatggctgggctcggcttttaaaaagtcatatgtgggattcctcatggaacagaattccatcaaagcccattaaaaagagcctaagtgaaaaataattattcttgctgcaaatgatcaggccaagtacgggaagactaaagttgattttgtaaacaaatccgttctatcatgatttgtttttaataaaaatggggactgaagagagaaaaattatatttcaaaagaaagctatagtacacctgttgttagctgttattgaggtttttttctgcagtttggattaattcctaaattctttgtgggttagaagtccccaaactcatgctttctaatcattgcttttaaaactgggaattgtactgctcatcctaggactcgttatttaccttatggtacactgttcagttaaatactgtactgaaagtatagatgagggtactaatgcttttgccatgcaaggtttggaagcccagtcagacctgcatgcgtcgcccagacagcagtaaattggttcactcctctcaccttggggttcactcctctcaccttggggttcactcccattcccactacgccctctgtcagcaggaagacgccagagcgatccgcagtcttttcccatcttcataggctaacctcaagattaaggtgttataaaacacaaagggagggattgaaactacctttgcaaaattatgactgagacagtgaaagaaatctaacttgatcgactccatcttgcttctaacctgcaagctgtccttgtccattcttggaccgaggctgaattaactttgggaggaacttagtttatagtttaaatcaaagacggtaacagccctttcccaaagcagacctccttcttgcctgaagactaaattgcctttgtagggctaacaataaccacgagataagaaatcatggtggaggagtcatgtagctggagggtacaagattctgaccctccctaaactgctcctaagattagtgcttgagctattttgccgaccctgcacttgatagatcagctgacaccacccagatggataaactggctcatctgacttgcggcccccacccaggatctgactcggtgaaagaagacagctttgactccctgtgatttcacccctgaccaatcagcgctcccagctcactggcttcccccgcacccaccaagttttccttaaaaattctgctcaccaaatgctcaggaacattgatttgggtaataacacaattccggtcgcttgcaaaattaaaaaaaaatctaaacagtacagcatgttctttatatattatctgaaagataattttcagaaaaaggtaaaacaatgacttgcaccaagatattaaaatacacaactcttaaagattttattttacacatatgatagaagggaactaggcagatgttagaaatagtttaaaggaaaagtgaaaacaatacaaatttatatggagtaaaggaattttgaaatgagttgcaaatggaaagaaaacttttttatttatttattttcaaattttttacaggagaaagaagccagtaaaaatcactactagacagggcagaagatagatagatagatagatagatagatagatagatagatcgatctatgtctatatatctccatcagttacctgcaatttgcaaagaattgtaaaatagttcaaagacaatgaacaacccagaagtatgtgttacagttttccattgaaacacattttttaaacatatctaataggtatgtcttaactagcgaattcacaccactcttcagtgagaggactatttattgatcatctgcctgtgtgttgcaggttgctgtctacctttttcaaatttgaagcaaagattttcattaaaagattttcactagaattaattaaaaatcaaagcccaaatcaaaacagaatacacagcaagctgtgctagtgacatggatgacaacttctcctggggattacaactctcagggtgacatccgtgtagatgattctgtaactgttaaaatgaaaaactcccaccctgtgggaacagagccgggtgagccctggcttccacacagtgccaccctgagaaggcgaggtctccccagcgtctgtctgcagtgcagccagggcggaggaatgaagtgtcacagcaggaagcagatggctgcatttgcagataatcaatctagagacttgcagccctgagtttcaggggaacttgtctaagtagcatcctgtcgctggaaggcatctaatgaactaagttactggtgttcttgcttgtcagatagccctggaacactgtctggattttataatcattttcttgagattgacaaagtctaaattcttgctgatcattgacgagtctaagttgtaaagaatgctacccatggatggaactttttgcttaaacttaagaaagggaggagaaataacagcagcggtgccccgtgaaggtttcccaaacatggaggagtcctggtataaaccatgccttggacccacagcggaaggaggagcacagcacagctgggatcacgaggactctgaagtctcctgggacgtgacaggagcaggctcagccactgtgcacagcgtgcgtccttgagcaggtcacctaaactgcctgggtctcacatccctgccattcatggtgttggggcttgccctgactttgtaccaagatcagagaggggcttatagtagggagaacccaggcagcgggaggaggcacttccaagcccccaagggtaggcgtggccttcccggcccccaagagtgcagggatgccagaggctgcagcggcagatttgggcgactgcgggtgtgcagggtgggggctcctgcctgcgccatggagctggaggcccctgtctgcagccccagttcgggcggcttccgcgagcgcagcagtgcctaggagcatgcagggctcctgcctgcccccacccacccaagagcaaagggaggctcagatctgcagccgcaacatgggcggctgcagccctgtccaggagggtggggctcctacccgcctggattaggaggtcaggtcagcatccccagtttgggcggcaccctggagtgccacagcacccaggagcgcacggctcctgcctaccctcagccctccaagagcacacagaggctcgtgtctaccgccccaactcgggcggctgcagccgcgcgggagagattggcggtgctgctgcctgctcctggctcccacccactccgtggggcacacagccccaactgtgaccccttgcagcctgaggcaggggctcctgatccttgctgggctcaggccagcgtccagggcaggggcaacattaccacgagctccccctgttgcccccgtactcaggggtggcccagggcagagtggatcgtgggcctcaggccccgccctcaggaatggcaggcttggtggtcaccccgacgccaggcggactccaaggatacggtctgggcagcccccacgcagagcctcctcccgcgacccaggaacccggcaccctctgtggggtgggcacagtgggtgcccagctggccaggtcccctgagtaggtgtcactatcccttcctgccccggatccccgaagtgcggcccagccctcatcaggcccctttctgtcggaggagctactgccccactgcacggctgccccgccggtgggtgaactggaccccgcctagctccatcccggcggcccccagggcagcgggtggagggagggggctgtccacctcctccctgcacacgccccgcagcagtctgcgtgcgggcaggggccaggccgcaccagatggcccactgctgccatcacaggcactaacaggaatcagccttctgcatccaggccttgtgttaatgtgtgaatgacaaagcaaaagaccccagtgtgtgaggcaggaatttggacatcagaaggaggaaaaacaggatgaagcttccggaaggaataaccatcccagctgtatcaccacacacacctagaaccctttagtcaggaggagggaggacggatccaacgtggaatatgtaggatttttccgttagcctgaatgtaccaccagatggaaggagggtcaagaacataagtctgtgccttgaggactaaactctgaccttttttctctcctgcccaaattcctacctaaggggcctggggaggtcaccctacaaaccacaaagcctcattggaggggtcttattaaccctgtgtaactcggctctttccaaccttactctggtgtaacctcacatgacagataaggaagaaaatccaaatattttaaccctaaatatgtttcttggccatatcttgaaatgtccctgcagagctgtctcatgtggggaaagtctatattctgtagaaaatcctgttccctttccaggcctttttcctcatccaggaaatactccactaagtttctggcaccttttaagtctgataagaaacatttaccatcgattctctgtaagtcttctacctggaggctgcatcagcgtaataagaaccttggtctccacaaccccttatcctacccagatatttcctttctattggttccaggtctttagataaactctttcaaccaactgccaatcagaaaatctgtgaatctgcctgtgatctggaagcctctgcttcctggtgtgccacctttcccgtctgaactgatgtacagcttaaatgtattgattgatgccttatgccctatagcatgtataaaacctagctgtgccctgatcacctgggtcacacgttctccgggtctcctgaggactgtgtcacgggctgtggtcactcacgtttggctcgaaataaatctctccaatattttacagagtttgttctttttgttgacaatcttttaaaatgtctaatcaggagaaaa

SEQ ID NO: 2157 - DNA, 10005 bp, Homo sapiens
tcagggggcgcctgcagggggtaggagccgctctcaaggatgtctgtctgtagccccatggtggggtatatgtttgtaaccccattgcaggatatctgggttggtgagtatcctaggcattgccaatgcctccttccttctgctgactggttctgtaccctccggtggggtgtctgtagccccactgagggatgttggcttgtagctccaccatggggtgtctgtgtctgtaacccaattcggggtgtctgtctcagtttgtctcctgggggtctcagttggctctttcttttatatttattttttgagacagagtctccctctgtcacccaggctggagtgcagtggcacaatcttggctcactgcaacctctgcctcctgagttgggatcaagtgattctgctgcctcagcctcctgagtagctggcactacaggtgtgcaccagcatgcccggctaatttttgcattttttgtagagatgggattttaccacactggccaggctggtctcgaacttctgtcctcaagtgatcctcctgccttggcctcttaaagtgctgggattacaggcgcgagccactgcgcccagcctcagttggctctttctaactagtagaaagagtcttggtttgggagacttctcctcaatcaggaagatttcgaggagatttctcagatggagaatagaaggacagtttggaagggacactcttggagttcttggttagggatctgatttggaaaacgctgtgttcatcttgtctttatgtgtgtttgtatatgtggaggggatctcagagggaattgctgatggacgttcagcaggcctaactcagagaaccctccttatttgtctggtcacattcggtgagccctgaaaaatgctcagcaggcctgtctcggggtgactatgtgctcttcgccttgcccagagaccccattgtgaattaccctttggaggtcatcccgccccagctggggtggatcaaagacaacagagaccaacgggagaaagtttgggctttgccaggctgatagtgggtgctgaatgaggtgattcatgtctgttttgttatgtgtatttcgctgggatggaaaatgttaattgggttccccaggcagcctgttgggcagcatcttgcaaattaagaatcttgtctgtggttccataacacagaaaggggtgattttctcttgtaaagtggtttgaaccccacagccatggcactagcgagcagggtcatcagagctgctccattcttctggaagctgcagagaaagggagcccggaaacctggtatgccggcaaaaagggctggagtgcaatgacacgatcttggctgactgcaacctctgcctcccgggttcaagcaattctcctgcctcagcctcctgagcagatgggattacaggtgtgtgccaccatgctcggctaatttttgtattattagtagagacggggtttcaccatggtggctaggctggtctcgaactcctcacctcaggtgatccactcacctcggtcccccaaagtgctgggattacaggtgtgagccactgtgcctggccagtcctctttaaaggatggttttataatcagctataaaatttaacaggggctcttcagtgcagatttctgattaataacctggagattgtgacgttagaatagagaaaaaaactttcaaatagaagagtgaatagtgtttggttgtctttggactgtatctgtatagatatgttattagtatgtgtttcaaaattatgggaaacttctataattctgatataatttagtgttattaataattataatttttatacaaaattgttgtatgccacagaagtaaacaaaattctagtcaattgtagctttagtagtggctatcttaagacttctatcatacacagacatttcgtcttgctttggcagtttataatcaggtataagtctcttggggaatctgacctcatacctcatctatgcagttcctgtacaaggttcctgacctgtgatgccctggatctgttcctgaaggattacagcatgaagaaaaataatgtgggtagccgggcttcatcttagcaacacgagcacctcattttggttttcagttggtcttttaatgaacaaatgtgttggaatgtttgggtctctggtttttatgccgatttctaccatcctgccctggggatgaggtggagctgggattaacaaaaaattcctattctccagccaggcgcagtggctcacgcctataatcccagcactttgggaggccaaggcgggtggatcacctgaggtcgggagtttgagaccagcctggccaacacggtgaaaccgatccctactaaaaatacaacaaaaagttagcggggtgtagtggcaggtgcctgtaatttcagctactttggagctgaggcaagagaatcacttgaacccgggagggggaggttgcagtgagccgagaccacgccattgcactggtcaataagaacgaaactctgtctcaaaaaaaaaaaaaatcctattctccatgggacccaaatccctttttacctccacctcctggatatgcagcaattaagtgattcacggaggtgcagtgaggcgaaggttccatgtagccacaggttggaagaaacaagtactgttggcatcaactttgtcagcttgaagcaggccttctagaacccataatgccaggacaagctttctagatggcagaagagcctagcctatttggtgtgaatgaaagacactcaggtgataccttctatctcttcaaggtaggtgcttagctgaaatagtgcaatgaagaaagagcactgagctggaagccataaggcctggccccaacactgataaccatgtgcgctttaacaaatcatttctctctgaaactcagacataaggcctggctccaacactaataaccatgcacgcttgaacaaatcatttctctctgaaactcagcttccccatctgtgaagcagggatggtgctacttttccaggtgtgatagattagattattgatcccaattcttccaaccccttagaaagggttgtacatccacccttgccatgtgacttgcagagtcctccccacaacctcagattctgtatccccactattgatattagccacggccgtgggacttgccttgctagtgggatgagggcagaagtatccatgcgccagctctgggtccctgcatgcttttgctaactctcttgtgtgtgggtgggtccttcaagaaaataagatgacccaagcagctgtgctccttcagccccagaataacatacgtgtgacagaccaggattcagcccacagcctggagccaagacaccatccgacccagatgaacctgcgtggatcacctgagccactagtgacccagagatcctgagagtgaaaaacatgcatggtcctatacaccactgagttttgggatgacttgttacttagcactattatgacaattgctgactaatataccaggctcctggaagatttgttgtgaggttctcataaaatgatgaatgtgaaattgcattgtaagctgcttttaaaaaagggtgccgtgtttgcatttctgcagcacaacatggagggtaaagggattgcagagtgagtctccacttccactcgtctctgttgttggagaggattaaaagagcaggagaggggctgcctgtgtcctgggaaattttcaggacagaagaagaggctggccctgtgcagtaggtgcagagcaggcacccggcctccagggccaccgatgactccagggcctggcaggagccaggatgtggctcctcgtggagggctatgccagccgtgtgtccgacccagagcacagaaccattgccccagcagggcttttcagtggaaccgagtgtccccacacgagctttgtctccggatgcacacgaggagattctgcagcacagtggatccgattaagccattacagctttccagagggaaaagaaaatttaggacgtgtagaaactaagtctttgcccacaatcaagtttccattcaaattatgaaaaggaagtgattgaatgagaatgagatgaccttccccttcccccacggatcttcctccctctggttccctctgctgctgacacgagcactgcacccaggcgacggccccgggcgcccaggctgactcccgcactcgggcgctgagctcatggccggttctgaagaactctggttctgctcatgccccacatcaaaacggccaagtcttcagatttgggatttcccaagccaaaagcattttcatagaattgcatttcaatatttacattatctttaaagaaagtccagctaaaaataaaaaataagtaaaaatgttaaaaataaaacaaccccagagagaagtggggtctacctgaatgcaatgcaagatgaagtggacatctggacgcccctcctccagggcttcgcatgctccccggggctcaggggctcgggtggggcagctcctcatggcgtggggtagggagggtgaccccaggttcttagtcagggcaggtgcaggcctgtgagacaccaggcgaaggaggcagagcaggccgtcctgtgtggagtggcttattctaattcaaactcccctgttttcttcctcttccttttgggggaactcatccctctgagacctcagacagacatgcaccaggctatgggtgggggtaatgcagggcaggcagggtggtgcaggagaagcattctgctcttttctgcagtaaggtaaatatcgtggccgtcatctgttccacctccttcctgctgtctggcttcgttagtgcagatcaagagcataggtcagtgccctggagggtgttcaggatgaccgtagcagaggtctccgtgccacaaatggaacccagccttgctaacttctccaggctcggtgcccagcacccccagggcacacagaaaccactgtggtgtgagtggtgctggagcagcagacacaggcgcgttgttgtcgggaggtgggggagcccccgccggcttgcgtgttttcttccttagcaactgcccctcagaagcaatacaggacttaccctaatgtcacctctgctgagtccacgccggggaatggctgagaaacaacttcatgccagaatcctgtcaatctaagtctctacaaaattctaggaaccaagaaattataaactgaaagctcttaatgagaagctctctgtgggcaatgatctgggctctgcagggggctccagcagctgccagagggaaataaacgtggaaaagaacaacctgaggctgctcggctgaaggccggagcatggggactgccctaaccctcactcacggtgcagggagcttcccaggaagtctcagctcacctgcagccttcgaaccaggagaggctccgtgaaagagcaggtgcgtggaccggctggaggagtcaagagaactgatgccttgaatgaatccagatgagcagccaccattgtcctaaaacacccttgttccctttggaaagggtgggccagttctgtgtaggttgggaaggtgactgggacccaggacgccccatggcaagccagcttctgcccaggaggtgctggcaccgggccgcaagatgggacatggcctgctggtgaggggtggtccctgagctgccactgcagcctcgacatgtctccacttggagataaacagcagcttaggcctggggggcatctctgcacccaagagctccgggtgcattgtctcactgctgtttgtccagtctcaagggctttgatttgttctgcccacacctgtgaccacagctgcccatgccaaactttcctgcgggatcgtcctaatagatccgcgggagctggtggctcctcttccaaagccccagactttcatgtggatcacctttcttctctgtccccaggatgctcgaggtctggcctcaaccctgtcatcattgtcaatccctgcggctcctccttccagggaggctgggcagaagagcaacaggagcaggtgctcaggggcaacacagaagacaggagcaggtgctcagggacaacaagtactcaggggacagaaggtgccaggaggtagtaggtgttcagggggcagcaggtgctcagggagcagcaggtgctcaaaggcagtacagcagacaggagcaggtcatttctaaataagtttaaaaactgaaacatgaattactaagcatgagtttaaagtttatatcctttgacatcgtgtttttacatagtatagagaagctaaatgtatttggttctattaataaacatgaaaattgtccgggtgcagtggctcacacctgtaatcccagcactttgagaggttgaggagggcagatagcttgagcccaggagtttgagaccatcccaggcaatgtagtgaaactttgtctctacaaaaaaatacaaaaattagccaggcgtggtggctccagttttgactgcaaggatggacccctgaaaacgcccaaggcttcagaggatgaccgctagagccagcagtttctctttccataatcaatcatgttatttgatagttatgagagttgattcaagattgagagatggaataggctgttattactcaggctcatttcctaaagtaaatcataatttatagatgtgggacacataggctttgagattccgatacaattagtgcaaacatttagaagataaattggcctccattccaaggtaaccaaatggatcccttttttaagaattgagaatactataaaacaaagatgcaaaaatacccaaaattgatcaataaggatcacgcagagatttattttttgaagacaatactaacatttcaaatgtaggaaatactattttatgctttaaacagggacatttagtctcgagttctagttttaatgccctaacctggtttatccataaagtggagagaggctagtgcataaattcatgtggtacagccaatcttattcattttttctcaagggacagttataaccagaatgaacaaagcctggaattcattaacagagcttacagggaaggtgagtggtttcgaagcatttttactaatcctttgataagtcaccctgatgtgagaggtggatttagcgacttgcttatgccaagtagcatatggcaaaagtaatgatatttcactactgcacgtatctgcaaagggagcactcactctggggcaagccaggcctgtgtcatgaagacactcgagcagccctgtggagaggcccaggcgtaagaaacagacgcctcttaccaacagtcagtgaggaactgaggtctcctgccatgagccatgtgagtgcgcgatcttggaggtgggttctctagcccctgtcaggcagtcagatgatgcagccccagtcacatgcaatcaagtctaggttcttgatattctagttacttaaagattgtcaagcaagaagtcatttcttccccggctatgctattcaaaggttcatgaatcttttggattttgtatattttagaaattccagaatttatcagtaggaaccagaaatagaatatccagcaggaacggcatgatgtataaaaaaatatagtcctttttgtacattcccctcttccattattctaactgtatctaccttcaaatcacacctaagatttcagggatagaccctttacctcgaagataatgaaacccatcagattataattttttttttgttatggacaattcccttccctaatatttctcaaactgaaggttgtaatctacttcaaagagtcgtccaaggaaggcatggtgatcgacgagtttcaaataactatcaaatacatttatttatcctaaaaacgttgacagtaatgatagaaatactcatttttaaaattcttgaattctgatacatagttctattttaaagtcctgaaataccagtatttttttattggtatactacaattataccactatttttggaaactaaggtctgaattattaacttcttttttttgagatgaggtgtcatctgttgttgttcaggctggagtgcagtggtgcaatcacggctccctgcagcctcagatccctgggctcaaagaaatcctgtgagcatggcactgtacccagctgattttttaatggtttgtagagacagggctttgctttgttgcccaggctggtctcaagctcctaacatcaagcaatcctcctaccttggcctcccaaactgctaggattacaggtgtgagtcaccatgcccagcctttatttatctcttaaaatgaaagtcattgactaaactattcaattttgtgccaaaaaaaagatgaactaatgtgcagtcttcaaaactgataggattattctggaaaattttgtacatacacacacaaaaaaagaagcattgatgacttttgttaaaaacaccaaataatatgtcattttaaatgtttatgaacgattaatttcttatttcaatataatgcttagttgattatttgtaataaaagtttatttttgtttatgtgctaatccattaggatgtgatatagtttggatatttgtccctacccacatctcatgctgagttgtaatccccaatgccagaggtggggcctggtgggagatgtttgggttctgggggtgggtccctcatggcttgatgctgtcttcttgagagtgagttctcatgagatctggttatttaaaagtgggtggcacctccctgcccactgtctctcacttgttcctgctcctgctcctgccatgtgatgtgcctgctccccctttgccttccgccatgattgaagcttcctgaggcctcccagaagtagaagccgccatgcttcctgtatagcctgtagaaccacaagccaattaaactttttttaaatgaattacccagtctcagctatttctttatagtaatgcaagaatggcataatacaggatgataatatgttgaaggtttatagattcaaaaaatgtattttagttaatttgaaaaataatgtaagaaacacatgataaatattcaattacgtttgtgaaatacactaaatccctacctgcttatttcctagctgggctgctataacacagtgccactcactgggtggcttttactgctcacagttctggagacgtggacatttacaatgaagactgattagggccagtttcctgattcacagatggggcctctcgctgtgtcctcacatggcagagggacaaacaggctccctctctctcttttatatgggcactgatcccatacatgagaggtccactctcaggaccaaatcacccccttgagaccccacctctcaacactatcaccataaggattagccttcagcatctgaatgtgtggggaggaagcacaaacatttagatcacagcgccctgtccctggtttcccaaagttcacatcttcctcacgtgacaagtacattcattccatcccaacagccctacaagtcttaactcgttccagcatcaactcaaaagtgtgaagtccagagtctcatttaaacatcgtctaaatcaaatacgtgtgtgatttaaggtaaaattcattgtgagacaaactgctttccagctgtgagcctgtaaaatcaaacatgttatgtgtttccaaattcaatggtaggtgttatggtttggacttgtgtccccacccaaatctcattcaattataatccccggtgttggaggtgaggcctggtgggaagtgattggatcatgggccggagttcttaagaatggtttggtaccatctcccttggtactgcatagtgcgtgagttctcataaaatccagttgtttaaaagtgtatagcacttgtccttctctctccctcctgctccagccatgtaagatgcctgcttcccctttgcttttcaccatgattgtaagtttcctgaggcctccccagaagctgagcagatgccagcatcatgcttcctatacaaccaatggaactatgag

SEQ ID NO: 2158 - DNA, 644 bp, Homo sapiens
ggcggctttcaacccgaacgcgtccctccttcaagatcaagaccctgaacgtagttcaacaagtagttggtgatgatagcgtgccctgactgggccaggatagcctctttagtaaaacagccacgaaagtcatgaaacagatgctcagctcctttcttcattttcactttaattcggtgatgcctctgtgtctgtctgacgacatctctcctggggtctgtgattctgctgatggtcttcagtgcctactgagaagggttcctggacatcatcaggtatgaaaacctcaaagctctcggtcctcaacgtgagaaccctgggccagcggcatcagcctcaccaggaaacctgttcttctgctcattcttgggccccaccccaggcctattcaaagaaagactccaggggcagggcctggcagcctgtgtttccaccagatctgtgttaaagctcaaatgaaccagcccacgtgatgctgaccaggaagcacaaggctgagagccagtgtccaaggcaacggtgcccatggggccagaggcagctcctgcctgtgcagctgtatttagggctgcgttcccctccctgtcctgccagttgacgtcagtgtggggttactcagctaaggccaccacggtatatccaca

SEQ ID NO: 2159 - DNA, 644 bp, Homo sapiens; identical to SEQ ID NO: 2158

SEQ ID NO: 2160 - DNA, 644 bp, Homo sapiens; identical to SEQ ID NO: 2158

SEQ ID NO: 2161 - DNA, 9018 bp, Homo sapiens
gacaggaggtagcttctgacctttgggagccagaagggccagtaaatggattctcttctcggaggtactgagacttatattgcatcccctggagggaaactgaggctcccaggttggataataaatcataacctattaaaggaaggggacactcagggatatataggaaagaatgagtaatacccttaaatccaatttcacaagtcaaaggaaaggcaaatcattttaccttctcctggccatctattcccatcaccatacagttggcattgcagaggtcccacaggttgggtcaggacagagtaggtggtcccagtatccaatagttattcaggtttcctgcctgctacattgagagtgacctgaggctttgcggtggtgatgccaacagaacgcttcaagactgcagctgggagagcacttgggctacatccagcagagagggtggccttttcatacaagagactagcatcaagaggagtgggttggggagattcatgctgtcatgacttcacaggatggaatgaacagtcccttttccagtgcccctctttcttataataagaacattggttgtccctcagtcctattgctgctggttgaggtctggtcaccccttgtctggagtgtttctcctgcctagggtcaccttgaggcagacctgtaattatggcagccaaaatttttgcccgatttttcattctctcatcctttttttcctcccctgcctggtccttattgttaaaaaccttaaaggcctccgctatccacgtcacctgaggtgtcttggggtaagcttccagtttctgaacctttctccaaatatcgggtggaacttgagttatgaaatgcatggtagttgtatgttcatttttataagaaactgtcaaactgttttccatagtggctgtaccattttaaattttcaccagctgtgtatgagtgatccagttactctgcatccttttcaggatttggtgttgtcactattttttattctagccattctcataggtatgtggtgatatctcattgtggcttaaatttgcattttataaaggataaggatggcctgggcgcagtggctcacgtctgtaatcccagcactttgggaggctgaggcgggtggatcacgaggtcaggagattgataccatggtgaaaccccatctctactaaaaatacaaaaaaaattagccaggcgcagtggcgggcgcctgtagtcccagctacacaggaggctgaggcaggagaatggcgtgaacccaggaggcggagcttgtagtgagctgagatcgcgccactgcactccagcctgggcgacagagtgagactctgtctcaaaaaaaaaaaaaaaaggataaggatgttgattattttttaatgtgcttatttgccactcacatctgcttgctgacaaaatgtctgtttatatgccttgtccatgttctcattgattttttttttttactgttgagttttaagagttctttgtatattttagataaaactctttgtcagattgtggcttgtaaatattttctcttagtctgtagcttgtcttttcatcctaataacagagtcaatagcaaagcaaaagtcttaatgttggtgaggtccagtttatcaattgttccttctatggattcagcttttggtgtcaattttaagaactttttacctagccctagatggtatctttttatgttttttagtctagagatgtcatctttttattcctgatattgataatttgtgccttcttactcatgatcaatctttctaaggatttataagttttattagttttttcaaataagcaaccttttatttttattttttgatgaattttctattagtttgaatttcttctttctgtggatatatttgctattctttttctaatttcttgaagtagatactcagttctctgtctttaagaatttttcccatgaatggattattttagaccacaagtttctcttaagcatatctttgtcactataccgcaagtaataataggtcatgtaaacagtataattcttttttggagaaacagtgtaattatttttggacactatgtcatgcaggttggagtgcagtggcatgaccatggctcactgcagccttaaccttctgggctcaggtgatcctcccacctccacctccatagcagctgggactacaggtgggcactaccacaccttgccagttgttaaaattttctgtagagacgggttctcactatgttgcccaggctgctaactcatgggctcaagcaaccttcccacctcaccctcccaaagtgctggaattactggcatgagtcactgtaccttgcctcagtataatttaatacaaatattttccaacttcctttgtgactgtcttctgagacttagaatatgcataaatttatttcttatcttccaaacctttggggatattttattttttgatatcggtgttttatttaattgcattatggtcaaaaacttgccacacgatttcaagtcattgacattgtggagatttgctttatccccagcatatggacaaaaatttgatgaacattccatgtacacttgaaaaaattgtgactttttagttgttcggtgcagtgccctgtatatgttagtgggccaaggttgttaatgatgttcaaatattgcatatttttattaatttgctggattgttctgtcacacactgaaagaagtatgttgaaatttaccatttcatcttttatttctgttaatgtttgctttatatattttgaggttatgttaacagatgcatacacatttagaattattgtatccacctgttggatttacccttttgcaattatgaaaagccctccattatagtaatgtttcctgtatcaacatcacttttgtctgacagtagaaactctgccagattctttcacttagtgtttgcctggtgttgactcagctccacaccaaccatccccactccacctctgtggctggccctagctccgcaaactcatttctgctgggccagctggtgctgtgctaaattctcccactaggggcaccagagaaagcacgcaaggctggggaagatggggaatgtgctcctttcagtttgcttccggtttctttcccaggcttccggtctacctgccactggggccacgtgtcctctggatgctgctggttcacctggcagtggcacttccccacctagctgctaaaactgggttgctggttcccgactctgcagaatcagcttgatctccccgctagagacctcaaaccactgctagggacacctcatctcgggggtctgggtttcaggccgtaggcccttccagctcagaccctggcagcagctgccatccctcttcagaggccagatcccagtgtggcagccgccctggggcacctggggagtgactcattttcatgaattccagcttattagttttattaattctcccctttgtaccccagactgagtggtggtggctgccttgtgtggttgctattttcctgatacgtgggctggcaaaccaaaacctgagaccacagccagctgcagtcctgtgttcctacaacctgtctttccagagacacatagaaggtgccatctatgaggaacaggccttcaccagacatcaaatctgttggcatcttgatctttgacttctccaccgccagaactagatcaagacatgaaacccatgttcaagatactttccagtgtgtcttcatgtgatcctctgagtccagccatcaggctaccagcagctcttggaaaccctgacatacttattcttagaagactgctttccggactcaaagtggaacctcaaattttcaattttctttgtttttaaagcctacacataggtgatgatatatacatgcatatatattttggagaatttataattctgaaaacaatgctggtcttatggaacccatccattcccctttccccgtgtgtgctccgagctgtggtggcacgtgaaaaggggtccttccagcagtggcccacagccctgggctgcttacttgctcacttcatttacaagagcaagaaatacacattcttgtgttgtttaagtcattatgatgtggggatttccattactcacacacctgatctagtagtaacacagtagcctattttagcaatatcatttattcaataatccattctttccccattagttttgagccttcatttattgtgtactaagttctggttatttttagtggttgtaatctccttctttcctactctcttaatcatgggattgccaatatctgctctgtgtttctgtgccatctatagcctctggccttggtactgcttcaaaactgatatttctaaccttactttgacttctccattcagtgaagttcccatagttcatcactcaactgctctctttccatcgtgaccttctgaactagctcacacccagatgtacttttgttatctgcctttccccctcataaacatgggctgctgctggggaaaatccactaccgaactcttgcaggtctctgcaaatgtttaatgccctgtcttagccatgacctccacaatgctgggctatcctatgttatgtcccctaagatatcccttctctcttacctttggggatagtcctaagcttccatcatggcactcaaagtccaaccttatttgtaccctcattctctgagcagacaccaccgtattctgtttcacagagaaaatgtgactgctggggataattctttcaacttcctggcctcttcctatacatgatctttctctgtattcttgcctattgctcttccatgttgatagaagtgtctgttctccttgtcagtgtctcggccttggatctgtcccctagactattctgcctgtgtaaggaccttccctgaccagctgggccaccatctcctgcttctccaatccctcactctagactgactcttaacctttggtcaacaatacttgagcttttacattcataatggagcatctgtgttgaaccttgttcttttctagacactaccctccgttctgtcttccatccatggtgacttttctagaaagagcatctatcacactggagacagcaaactccttgatccattctaattcctaaccctgcaataattttctatctcccttactcaagtaattgggagtgctcctagtgttaccagagacccagcagttcccaatttcgaatttttccgtattcacatttcttgacttgctatgattttacatcacagattacatccttcatttgaagagactctaatggaaggctgccatggaaactctctcatgtggctgacctcctacctcacttgctctttctgaatgaagttcccacttttgcctgccttaatgaaagtaatgctccccaaactcaagcccagggctgcgaattggaagcagctggggctactgtttctgggtgctggtgtgaatggcaggatgtgaacaccagcctgtgacgggcaaaaagatggacacacaggcagagcctgacaggtgctggtggtcctatctggtcctgagttgctgggaccctccttgcccactgcccctagaatggactttggcctcaggttcgaagtgttcagatgtgactgagatgagccttttccccatgcctcaggaatagcgaagaaactctatctggaaggttccccaggcttccccacccagcagcctctggtattagaccaggcagtggctggccaggatggtggggacagaagggagacaaaggtgagcagtgggtggggtcacatcctccctgacattgaatagacaacatggggaggaaggatgagtgatctttagaatgttcatggaaaatgcatattgggaaaaagaatgcatgaatttcaaattgttttgcaacaaaataaacttgtactaacttgtgaaaacacgtccgaacaggatctagtttgaggccctaagaagtataagacaacagtttgaacagagctcctatcagacacatgaattctgctaaaattgaaaccagaacaaacatgcaattgatggtgaagcttggctggaaacatggtgaaatcattgatgatttattgaaagtttatagggacaatgcctcaaagaaatcagcaatttaagtaagtggataactcattggaagaagagaagagatgatgttggagaggaagtccacagcagcaggccagccacatcagtctgtgaggaaacaattcatcttgtttgtgccctaatttaagaggactgattaatagcagcagaaacaatagccaacgctgtaggtatcccaaggtgttcagcttacacaattctgactgaaattaaagttgagtaaactgtccactcggtgggtgccaaaactttctcccagctcagctgcagataagagaaaagcgttctatggccattttaaacaagtggaatcaagatcctgaagcatttcttcatataattatagccggagatgaaatgtggcttaaccagtacactcctgaaggcaaagcacaagcaaagcaatgactacctagaggtgggcgtggtcccatcagagtaaaagcagacatgtcaagggcaaaggtcgtggcaaccgttttgtgaatgctcaaggcatcttgcttattgactttctggagggccaaagaacagtaacatcttattatgagagtgtatagagaaagtcagccaacgatttagcaggaaaacacccaggaaatcgtcaccccggaaagcttcaccagagagcccttctccaccatgacaatgctcctgctcattcctctcatcaaacaaggccagttttgtgagagtttcaatgggaaatcactaggcatacaccttccaggcctgatttggttacttctgttttataattttaaaaaatctttaaagggcacccacttttcttcagttaataacgtcacaaagactgaagtggcatggttaaattcccagggtgcccaattctttagggatgaactgaatggctggtaccattacttgcagaagcgtctcgaccttgatggagctcatgctgagaaataaaacattttttaatttttatcttttaattcaattttttcgtgaacttttgaagtccccttgtatttgtttttggtggaactttgagtctgatttctcagctccccatggatggctgcatcttaacagagaaatgaacgccatttaccctgatgctctctacttggcctaagtttcagatgttgaacacacacgtgtgggaatttatgaatctgtgcacctgtgccagctggtgggtgaagtctaagtttcttcaacacaattagttatcttctgcctcctggaatctggtaggaaaggttgaggaaaagcagccatccacagcgcctccaccactggaatgggggcagccctaacgtgtgccccactgccccccatgctgaggagtccttcactccagggatgtcttcaccccaatcattcagactcccccagtgttcctgcgtcacctgaaaggtcggaagcatctcagcacatactctccatgagtggtacttaggcctccctccccatcaatactgaagccctcagaggcagaggggagtcaaggaaaagagtggccatcagcaataaatgagttacaaggtttgatttcaaagagaaaaacttgtcaccaaaatcactactcaggagatctggacttcctctgaatgtgagttaaagaacccttgagggttaagagccaactgcacctgatccccactctcccatcccaagaccctgggaagtcaaaccaagaggtaatcaacagaaaacaagtttaatgcaacaggtgacaacggtctggagcgagtccatgctccggaaggctcagtctgtggcagtcccgtggctcaagacaggctgaggccggctgcaatggaggccagcagcaggaggatggccagccacagcccaccacagctctcacccatgctcccagcatattctttgaacactgatgagttgataggtggcccctctaaattgcagtagcgaattttacaacacttgaggtaaaagaagggcatgggctcttccaggagaaaccgcttctcctctggcttgggtctctccatcgctgcacaaccagcggagcactgcttcgcaaccatgaaaaaacgtggaaatatttctaataggaaataaagaccgagagaaggcaatcacgcaattccaatgcctgacaccgaggcccttctgtctgggtcaaagcctcacccctggcggccctgctcaaaggtgcacagtcaactggggcaccaagggggagtcgggaggacgagggccaggcctgtgtgttgaatgctgcttcagggaagggctggcttctgcgtggtatggcctgtccatatgcactgggaatgcgggtctaggggttgctgtttgggaacaaacaggtctcaacttctcaaacacagggttggctcaggcctttgtgaccacagacagacacatgactcccagccattctggccatcacccagggtgtggagctggcctcttggtgggcctggctcgactctgagctgggggtcttgtctcatgaccacacttcatcttatacatcactgtacaaatcattttgccatattaagttataaagtcgatgtgggccacactgagtctgaagcatcacctcagcaccccaccaacttcgtggataccgaagggctggagagtgactgctgggcggaatcagaattcacgagccctgaagatctccctgtgggcagaatgtgctgggtgtccagattccccttggggagggcttcatgtacccagaggttttcaggggaatcacagatgacagagcagtggtctccacaatttttaaggcatgcaccctcctttgagaacacacttgaaggctgtacaccttggttttgtgcatctcttgtaagagtgacatagacactgttctctgtggcgcatttaacactattaaagcttaatttttcatttaaaaatg

SEQ ID NO: 2162 - DNA, 6154 bp, Homo sapiens
tccagcaggcgcagcgagcggcggtggcgcgcgcacgaggccgccagcaccgtgtgcgcccgcaactccctcagcgccccgagcaccccgcagcgggtccaagtccgagggcagcacgcggcccgggaagcgctgctcagctagcaggtcacggacgcgcggctgcagcaggcgcgcgcgcagcacggcgcacggaaggcgcaccaggtaccagacgtccagcagcgcaaagacagcgagccccagggccagcaacgccaccagcagccccagcatagcggcggcggcgggcgcggggtcctgcggagtccgtggcgccggtgccggtgtccgcggcgctggttacggtgcccgccaggcctcctgggaactcacgagcgcagcgcgcccggagcgaaccacagcgcgagggcggccgagggggaggggcccggagccccgcccaccgtggcgcgaccttctcagcgccctacgtggtccgtcccgccgtccaggcccgcgccactttcgcgttccctggggcggggcgggcggcgcgctgagcgccacagcggcacctggcggccgtgcgcggcgctgcaggcgcgagggtgcacgcgcgccccggcgtctccgccttcccagcagcgcgagaccctcgccaggctctgaagacgcggcctggccctggccgttcggcccttcgtctgagcgcaaaggctccagcacctccgcggccgaagccgcgggacttttcgtggaaaatgggacccagcccgatcgccagcggcgctgcagcggactctgcgggaacctagcttctgctccaggacctccagggccaccccagctcgcagggcgttcgcagcggctcagggcgaatcacgctcatggtccccgtgcgcattttcagccccagccggtctttccagagacacatagaaggtgccatctatgaggaacaggccttcaccagacatcaaatctgttggcatcttgatctttgacttctccaccgccagaactagatcaagacatgaaacccatgttcaagatactttccagtgtgtcttcatgtgatcctctgagtccagccatcaggctaccagcagctcttggaaaccctgacatacttattcttagaagactgctttccggactcaaagtggaacctcaaattttcaattttctttgtttttaaagcctacacataggtgatgatatatacatgcatatatattttggagaatttataattctgaaaacaatgctggtcttatggaacccatccattcccctttccccgtgtgtgctccgagctgtggtggcacgtgaaaaggggtccttccagcagtggcccacagccctgggctgcttacttgctcacttcatttacaagagcaagaaatacacattcttgtgttgtttaagtcattatgatgtggggatttccattactcacacacctgatctagtagtaacacagtagcctattttagcaatatcatttattcaataatccattctttccccattagttttgagccttcatttattgtgtactaagttctggttatttttagtggttgtaatctccttctttcctactctcttaatcatgggattgccaatatctgctctgtgtttctgtgccatctatagcctctggccttggtactgcttcaaaactgatatttctaaccttactttgacttctccattcagtgaagttcccatagttcatcactcaactgctctctttccatcgtgaccttctgaactagctcacacccagatgtacttttgttatctgcctttccccctcataaacatgggctgctgctggggaaaatccactaccgaactcttgcaggtctctgcaaatgtttaatgccctgtcttagccatgacctccacaatgctgggctatcctatgttatgtcccctaagatatcccttctctcttacctttggggatagtcctaagcttccatcatggcactcaaagtccaaccttatttgtaccctcattctctgagcagacaccaccgtattctgtttcacagagaaaatgtgactgctggggataattctttcaacttcctggcctcttcctatacatgatctttctctgtattcttgcctattgctcttccatgttgatagaagtgtctgttctccttgtcagtgtctcggccttggatctgtcccctagactattctgcctgtgtaaggaccttccctgaccagctgggccaccatctcctgcttctccaatccctcactctagactgactcttaacctttggtcaacaatacttgagcttttacattcataatggagcatctgtgttgaaccttgttcttttctagacactaccctccgttctgtcttccatccatggtgacttttctagaaagagcatctatcacactggagacagcaaactccttgatccattctaattcctaaccctgcaataattttctatctcccttactcaagtaattgggagtgctcctagtgttaccagagacccagcagttcccaatttcgaatttttccgtattcacatttcttgacttgctatgattttacatcacagattacatccttcatttgaagagactctaatggaaggctgccatggaaactctctcatgtggctgacctcctacctcacttgctctttctgaatgaagttcccacttttgcctgccttaatgaaagtaatgctccccaaactcaagcccagggctgcgaattggaagcagctggggctactgtttctgggtgctggtgtgaatggcaggatgtgaacaccagcctgtgacgggcaaaaagatggacacacaggcagagcctgacaggtgctggtggtcctatctggtcctgagttgctgggaccctccttgcccactgcccctagaatggactttggcctcaggttcgaagtgttcagatgtgactgagatgagccttttccccatgcctcaggaatagcgaagaaactctatctggaaggttccccaggcttccccacccagcagcctctggtattagaccaggcagtggctggccaggatggtggggacagaagggagacaaaggatctagtttgaggccctaagaagtataagacaacagtttgaacagagctcctatcagacacatgaattctgctaaaattgaaaccagaacaaacatgcaattgatggtgaagcttggctggaaacatggtgaaatcattgatgatttattgaaagtttatagggacaatgcctcaaagaaatcagcaatttaagtaagtggataactcattggaagaagagaagagatgatgttggagaggaagtccacagcagcaggccagccacatcagtctgtgaggaaacaattcatcttgtttgtgccctaatttaagaggactgattaatagcagcagaaacaatagccaacgctgtaggtatcccaaggtgttcagcttacacaattctgactgaaattaaagttgagtaaactgtccactcggtgggtgccaaaactttctcccagctcagctgcagataagagaaaagcgttctatggccattttaaacaagtggaatcaagatcctgaagcatttcttcatataattatagccggagatgaaatgtggcttaaccagtacactcctgaaggcaaagcacaagcaaagcaatgactacctagaggtgggcgtggtcccatcagagtaaaagcagacatgtcaagggcaaaggtcgtggcaaccgttttgtgaatgctcaaggcatcttgcttattgactttctggagggccaaagaacagtaacatcttattatgagagtgtatagagaaagtcagccaacgatttagcaggaaaacacccaggaaatcgtcaccccggaaagcttcaccagagagcccttctccaccatgacaatgctcctgctcattcctctcatcaaacaaggccagttttgtgagagtttcaatgggaaatcactaggcatacaccttccaggcctgatttggttacttctgttttataattttaaaaaatctttaaagggcacccacttttcttcagttaataacgtcacaaagactgaagtggcatggttaaattcccagggtgcccaattctttagggatgaactgaatggctggtaccattacttgcagaagcgtctcgaccttgatggagctcatgctgagaaataaaacattttttaatttttatcttttaattcaattttttcgtgaacttttgaagtccccttgtatttgtttttggtggaactttgagtctgatttctcagctccccatggatggctgcatcttaacagagaaatgaacgccatttaccctgatgctctctacttggcctaagtttcagatgttgaacacacacgtgtgggaatttatgaatctgtgcacctgtgccagctggtgggtgaagtctaagtttcttcaacacaattagttatcttctgcctcctggaatctggtaggaaaggttgaggaaaagcagccatccacagcgcctccaccactggaatgggggcagccctaacgtgtgccccactgccccccatgctgaggagtccttcactccagggatgtcttcaccccaatcattcagactcccccagtgttcctgcgtcacctgaaaggtcggaagcatctcagcacatactctccatgagtggtacttaggcctccctccccatcaatactgaagccctcagaggcagaggggagtcaaggaaaagagtggccatcagcaataaatgagttacaaggtttgatttcaaagagaaaaacttgtcaccaaaatcactactcaggagatctggacttcctctgaatgtgagttaaagaacccttgagggttaagagccaactgcacctgatccccactctcccatcccaagaccctgggaagtcaaaccaagaggtaatcaacagaaaacaagtttaatgcaacaggtgacaacggtctggagcgagtccatgctccggaaggctcagtctgtggcagtcccgtggctcaagacaggctgaggccggctgcaatggaggccagcagcaggaggatggccagccacagcccaccacagctctcacccatgctcccagcatattctttgaacactgatgagttgataggtggcccctctaaattgcagtagcgaattttacaacacttgaggtaaaagaagggcatgggctcttccaggagaaaccgcttctcctctggcttgggtctctccatcgctgcacaaccagcggagcactgcttcgcaaccatgaaaaaacgtggaaatatttctaataggaaataaagaccgagagaaggcaatcacgcaattccaatgcctgacaccgaggcccttctgtctgggtcaaagcctcacccctggcggccctgctcaaaggtgcacagtcaactggggcaccaagggggagtcgggaggacgagggccaggcctgtgtgttgaatgctgcttcagggaagggctggcttctgcgtggtatggcctgtccatatgcactgggaatgcgggtctaggggttgctgtttgggaacaaacaggtctcaacttctcaaacacagggttggctcaggcctttgtgaccacagacagacacatgactcccagccattctggccatcacccagggtgtggagctggcctcttggtgggcctggctcgactctgagctgggggtcttgtctcatgaccacacttcatcttatacatcactgtacaaatcattttgccatattaagttataaagtcgatgtgggccacactgagtctgaagcatcacctcagcaccccaccaacttcgtggataccgaagggctggagagtgactgctgggcggaatcagaattcacgagccctgaagatctccctgtgggcagaatgtgctgggtgtccagattccccttggggagggcttcatgtacccagaggttttcaggggaatcacagatgacagagcagtggtctccacaatttttaaggcatgcaccctcctttgagaacacacttgaaggctgtacaccttggttttgtgcatctcttgtaagagtgacatagacactgttctctgtggcgcatttaacactattaaagcttaatttttcatttaaaaatg

SEQ ID NO: 2163 - DNA, 6154 bp, Homo sapiens; identical to SEQ ID NO: 2162

SEQ ID NO: 2164 - DNA, 6154 bp, Homo sapiens; identical to SEQ ID NO: 2162

SEQ ID NO: 2165 - DNA, 6154 bp, Homo sapiens; identical to SEQ ID NO: 2162

SEQ ID NO: 2166 - DNA, 1883 bp, Homo sapiens
gttcacatggaaggtgccttcaaagtccacaccattgaaggccgtgtatcctggggtgggggtgggataaaggtcaggggcagcaaagctactggcggcccatcatggggtaaagttgggaagggatgcctgctatgtatgtggccagcttgtgccactgccttctctctcgccactttgcccattctccctgtctgtttcctcccctaccctctgcccctataggattcctccatttggaagtgattgaactgcatatcccttacataccaactgccaagccagggtcactgttcatggtctgaacgatttccatgccctggggttgtatagtaaagaaaaagctgtgatgcaggtgtgctatccctcccaggccccccgtcccagtagccctgtctgatagcacctgcccagcccactgccccgagttacctggttgagcacaacccagtttgggtcaatctgagcatcaccctcaggatccaggacgacggtctgataggcccgaaaatccgtaagcgttacctctgcactttcaggacacacatccagggggtcgaccacagcatcattgtcaaagtcatcctcacacacatcaccaacgccattgcctgggcagagtgaggctgggtgctcaggaaggccctggccactgccattaggcaacaataccatctgttgggcctgcattcctgacatctttccccaccttgcccttcctcacttcccaacagggcttgctgcctccacctgggcaaaggcaacaccagtctaacgtgctctgggtccgcaggcttaccatctgagtccttctgattgggattgggtaccaggcggcagttatcgggaccaggaggcacataatctgggatgccatcattgtcatcatccccatcacactcatctccaagtccatcgttatcagagtccagctgggagctatttggcagctgtgggcagttgtccttggtgtcctgatgcccatccccatcgctaatcagaagaacaggttggtgaaagtcccgaactttgtctccccacccagaggacaactggccaggaaatctgcctgtttcttgtctcaccctctagtccacactctgcctaacactacgccctacctcacattcctattgacatctgctgcagatcacacccttgtgatggacaaactgctcagtacagtcccacccacccagcctccttgtcctgggcacgaggtttttgcctccctgatttggagtatttggcccttactagagagctgccagatgagggacatttccttcacctggagaaggatggggaggagtcagcacttgacatctgccaccctaccccagaatcagtgccacccttcgccagcccacccaaacctggtctcgtatatcatcccgcagctccaccaggatctggttgaagaggaactcagaggctcctcccggctcacctgcatcctcaaatacgccttctgtccagtcctaatctccagcccatcgacctccgctggaggaatgggggccagtgctggaaggcctgcatgttggtcacccagtttgcagtccacgtagagatgtagggcagggctgggtctggagggacctcggagtcgcaggagaactgtgtgtgtgcgcccatcagccaggcccgcttgctgtaggttcacggcgtggactttgccatcctcccgctggtatcgcaccagtactgcccaggaggggagatcagtatgggcgctatcccccaccccctgcctcccagctgagccttggatcaactctgctagataccacatctctagggcccctatccctaattctactatgtggctctcaacaccttgtatttaataggtacacaataaatgtttttgaaattgcttt

SEQ ID NO: 2167 - DNA, 2445 bp, Homo sapiens
cggcaatcaggtttctttattcatccaaatgggctgaaaagttgtgtcaaaacaaaaacctgcacatgggcgtttacagcagctttatgagtaactgctgaagcttggaagctgctaagatgtctttatgtgtaactgccaaagcttggaagctgctaagatgtctttacgcgtaactgccgaagcttggaagctaagatgtccttcaataggtacgtagataaacaagctgcagcacacgcccaggatggagtatcatccagcgcgaaaaagaaatgagccatcaagccacgaaaagacatggcgaagccttcagtgaatatgaaagaagccaatctcaaaggctacatactgtacgtgtacaccaaagcacatcctcatcagacacctcaatacaccaaagcacatcctcgtcaatacaccaaagcacatcctcatcagactcaatacaccaaagcacatcctcatcagactcaatacaccaaagcacatcctcatcagactcctcaatacaccaaagcacatcctcatcagactcctcaatacaccaaagcacatcctcatcagacacctcaatacaccaaagtacatcctcatcagacacctcagtacaccaaagcacatcctcatcagactcaatacaccaaagcacatcctcatcagactcaatacaccaaagcacatcctcatcagacacctcaatacaccaaagcacattctcatcagactcctcaatacaccaaagcacaccctcatcagacacctcaatacaccaaagcacatcctcatcagactgctcaaaaccagtggtactgaaaaatcttcaaagcagttggaggaaaaaaaccaagagaggactgaagatttcctgctggaggcagggcaagctggaagacagaagaccttgcacatctgaagaaaacgtcagcaggctgcggcgctccaatgaaaactcctctatgcccatccccaaacacccaggttgccgagtggctggccctggttctcacagctcctggcacaggctcaccagcaagacccctgactctcccacacccatcatgcaagtggtcctggtccttcaccaatagtccctgaggccaagccacagtcacctcccagctgggggccggccctccccatatcccatcaccatgcatgcccacatttccctcactgatgtggacaatatgcaacccaaccagcctgcaccgtccctgcagggcgctattaacaatgcagacctcagccgggcgcgatgtctcacgcctgtaatcccagcactttgggaggccgaggcgggagaacacaaggtcaagagatagagaccatcctgggcaataaggagaaaccccatctctacaaaaaatataaaaagtagctgggcatggtggcgggcgcccgtaatcccaggtggcgggcgcctgtaatcccagctactcgggaggctgaggcaggagaatcgcgtgaactcaggaggcggaggttgcagtgagccgagatcgcaccactgcactccagcctggcgacagtgtgagaccctgtctaaaaaaaaaaagcaaaacaaaacaaaaaaacaatgcagacctaaagtggcttccacaccaagaacaaaacttggcctcatgacctactgtccccaccccgcccaacctctgccctctgtgccctcagcttctcctggagacccaggcctctgtcctctgcatctgctgtcacgcctgccaggcctctcggcaaactttcagcaaaggaggcccattctccttcatgtttcagcttaaatatcacttctaggaggctgccccgaccacctctacccagacgtgggccctcctcacatcccgtcatcgtggccacaattcccttactgacgtgaacaatacgtagcccaccacgtcatgcccccggtgcaccccctcgcccgtgttgctcacgacttatcctggaccctccaagagacatgcaggcccccaagtgagatgacgaggacacctgccgccccagcccccacccgatccaccacaaggcaccccgggcttcaaatcaagtttaataaataaaacagcaaaggggggttcaaggcagttatcacttcacagtgtggtccttggtggggtgagggatggtcgagtccaactcggaaaggggctcgagcacaagaggccggacgacacccggggcagggcgcgccgccgcccacggaggaccccactccaacgtgtaaacagaaacagaaacgaacgagagggccagggaggagggggaccaggactccaagccatcttgctaggaagcttcccacagaaggaagacctgcagggctggggaaacaggctggagtctggcccctgcgtggccagcagggccggctcctccggaggctccctgccttggtaccgggggaggacagcaaaggggatgcgaggctggggtgggggccgg

SEQ ID NO: 2168 - DNA, 2445 bp, Homo sapiens; identical to SEQ ID NO: 2167

SEQ ID NO: 2169 - DNA, 920 bp, Homo sapiens
cgcgaacacgcagcagcgagaatctacaggggcgtggtttgcgcacgcgggaactgggatctcaaccccagggctaggtgcctcctcccgctgctttccgccagctgcggggtgtgagattaatccccgccgattagcgccaggtgtactaagcgctggatggttccctgaccagatgaaacatcagccgatgttctaatgccggtcccctgggcgctgtccccgagagggaaaacctgttttctgaccccggctctagtcggcctctggaggtctgcagctgggttattttacctttgaaacggacgacacctgccccgtgcaccccagcggctcctccacacggagagatggtgtcagtcaaaggccgtctagatgacgagtttatgaaattgttcctggcccgtgccgggcacgaccttgcagagagcccagaagatgaaaccccagccctgccaggagctcacctgctaattaggaggacaacgaatcacctcacctccctagactttgcttctcctttattcagtgagggattggactagctggtccttgaggacttttcagaaagtctggttctgggagatgaccaatgggatcatcttatgctatgagctttcctggaatgacaggtaatggagagtgaggagattttacctgatatggtcctgtttgcaccatcagccagcaacctttctgggaagcgtgcttattatgtaccaacataaaagcttgaatataagtgaattcacagctggagtcacctcagcagtggcatctggggtgccactgctggcatcaggggagttcccacaagggagtaccccaagccatcccaagatgggaccagttggaatcccaaagaaagaagcactagacgccagggtgatcagatcaaagcatttattatgagaacttag

SEQ ID NO: 2170 - DNA, 2450 bp, Homo sapiens
ccaatttcccattttcctctgcctctgacacctgcctctccttttctccgtgctcacgttctttcatgcttagtttcctcagactagaagggagagaaatgcacacacatgatccaccagcccgtgtgggattccctctgcccttctggcatctgaaggctgattcaaagatcccccctgcaaccttcccacaaatgaaccaactgattctcacaagcaaagggagaatggacacctcccattgagggacaaaaaaaaaatcacactctggcctgctggcaagtcacctgtcatttccagctcatcttcatagttccatagttagtcctattctttagtaaatataaagactattaaaagcttctatgaggtgcactatgtgtgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgctggaactgagaccatcagccatagagagatccttccagaatatggtgtcattaaccccgcagttcactactgcactttgccatgattcaggactggaactcttgtcatcgactttaaagatcctgaaaaggcaatctgaatgctgggcgcatctattgaattagaaatgatcggaatggctcctaagtcagggtgtcatgtcctgaaaataggtgacaactgcaaaccatccaccctggtgttgactgactttaacaaggttcagttcacagagattgagggcagaaaaaggaaatggcctcaaaagggtaagtttgctgtgttgccctcacaccacttgattcatggtcctgatcctaaggatctcacctgatacttggttttataggaaggatgtataaaattcccagaacgctaggaaacagggacgaaaacacttcaaagagaaagttaatgaacttgtttctgaccacagggcatccttcagcacatgctgtctggagtggcctcaaacaaggagtgtgtggtgaggtgctgacaatgcaatgggagcagggtcctgtccccacgctaaagaagctcacagtttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtggggttagatggaaaacaagtggattgagggtctgccaatgaaagcgacccatactgaagtccactggctctggttgagacccagaagagtcatgcatcagaatagaggtggacaggaaataccgtggcctttgtagggactgagcctgcaccgacgacctcaattgcagcctgtatggaggacccctgaccatcccccagaagtagactcccatctcttctgcagcaagataacatgctactaggcctcaattcattgctaaatattttttaacaagtatctcacatttaacaaaaaaagatcagtcatatgggcagcaaaatacaatgtaatatgaccaaaacatgaaagactgtgaaaatgaatctggaggtgacccaagcattgaattcaacaatccaggctgggtgcggtggctcacaccgggaggctgaggtaggcagatcacctgaggtcaggagttcaagactagcctggccaacatggtgaacccgtctctactaaaaatacaaaaattgggctgggcacggtggctcacgcctgtaatcccagcacattgggaggccgaggtgtgcggatcatgatgtcaggagttctagaccagcttggccaatatggtgaaaccccgcctctactaaaaatacaaaaattatctgggcatggtggcatatgcctgtagtcccagctactcaagaggctgagggataagaatcgtttgaacctgggaggcggaggttgcagtgagccaagatcatgccactgcactctagcctgggtgacagagtgagactctgtctcaaaaaaaaaaaaaaaaaaaaaaaaaaaaaaaaaaaaaaaaaaaaaattggccgaatgtggcggcacacacctgtaatccaagctactcgggaagctgaggcagaattgcttcaaactgggaggcagaggttgcagtgagccaagattg

SEQ ID NO: 2171 - DNA, 2450 bp, Homo sapiens; identical to SEQ ID NO: 2170

SEQ ID NO: 2172 - DNA, 8558 bp, Homo sapiens
aaaagaagtgtaaatggccggtccttgccttaagtgatgacattaccttgtgaaagtccttttcctggctcatcctggctcagaaagcacccccactgagcaccttgtgacccccactcctgcccgccagagaacaaaccccctttgactgtaattttcctttacctacccaaatcctataaaacggccccacccttatctcccttcgctgactctcttttcggactcagcccgcctgcacccaggtgaaataaacagccgtgttgctcacacaaatcctgtttggtggtctcttcacacagacgtgcatgaaatttggtgccgtgactcggattgggggacctcccttgggagatcaatcccctgtactcctgttctttgctccgtgagaaagatccacctacgacctcaggtcctcagaccgaccagcccaaggaacatctcaccaattttaaatcaggtaagcggcctcttcttactctcttctccaacctctctcactgtccctcaaccactttctcctttccactcttcaatctctcccttctcttaatttcaattcctttcattttctgggagagacaaagcagacacgttttatcggtggacccagaactccggcgccagtcacggactgggaaggcagccttagccttcccttggtgtttaatcattgcagggacacctctctgattatacacccacgtttcaagggtgtcagaccacgcagggacgcctgcctttgtccttcacccttagcggcaagtcccgcttttctggggaaggggcaagtaccccaaccccttctctccttgtctctaccccttctctgcttttctgggagaggggcaagtaccactcaaccccttctccttcacccttagtggcaagtcccgcttttctacggggcaagaacccccaatcccttatttccacaccccgacctcttatctctgtgtcccaatcccttatttccgtgccccgacctcgtatctctgcaccccaatcccttatttccgcgccccaacctcttaatatctctgcgccccaatcccttatttccgcaccccgacctcttatctctgtgtcccaatcccttatttccgtgccccgacctcgtatctctgcgccccaatcccttatttccgtgccccaacctcttaatatctctgcgccccaatcccttatttccgcaccctgacctcttatctctgtgtcccaatcccttatttccgcaccccgacctcttatctctgcacccaatcccttatttccgcaccccgacctcttatctctgtgtcccaatcccttattttcgtgccccgacctcgtatctctgcaccccaatcccttatttccgcgccccaacctcttaatatctctgcgccccaatcccttatttccgcaccccgacctcttatctctgcgccccaaccccttttcccacttttctggaaggtaagaacccccgaaccccttccctctgtttctctactctcttttctctaggcttgcttccttcactatgggcaactttccaccctccattcctccttctactcccttggcctgtgttctcaaaaacttaaaacctcttcaactcacacctgacctaaaacctaaatgccttattttctgcaatgccgcttgaccccagtacaaactcgacagtaattccaaatagccagaaaatggcactttgaatttttccatcctgcaaaatctaaataattcttgtcgtaaaataggcaaacggtctgaggtgcctgacgtccaggcattcttttacacatcagtcccttcctagtctctgtgcccagtgcaactcgtgccaaatcttccttctttccctcccgcctgtcccctcagtaccaaccccaagtgtcgctgagtctttctaatcttccttttctacagacccatctgacctctcccttcctccccagcctgcttgctcctcgccaggccgagctaggtgccaattcttcctcagcctccgctcctccaccctataatctttttatcacctcccctcctcacacctggtccggctttcagtttcgttccgtgactagccctccccctcctgcccagcaatttactcttaaaaaggtggctggagctaaaagcacagtcaaggttaatgctcctttttctttatcccaaatcggatagcgtttaggctctttttcatcgaatataaaaatccagcccagttcatgacttgtttggcagcaaccctgagacactttacagccctagaccctaaaaggtcaaaaggccgtcttattctcaaaatacattttattgcccaatctgctcccgacattaaataaaactccaaaaattaaattccggctctcaaaccccacaacaggatttaattaacctcgccttcaaggtgtaccataatagaaaaaagttgcaattccttgcctccactgtgagacaaaccccagccacatctccagcacataagaacttccaaatgcctgaactgcagcggccaggcgttcctccagaacctcctcccacaggagcttgctacacttgctggaaatctggccactgggccaaggaatgcccgcagcccgggattcctcctaagccgcgtcccgtctgtgtgggaccccactgaaaatcggactgttcaactcacctggcagccactcccagagcccctggaactctggcccaaggctctctgactgactccttcccagatcttctcggcttagcggctgaagactcacactgcctgattgcctcggaagccccctagaccatcacggatgccgagcttcgggtaactctcacagtggaaggtaagcccgtccccttcttaatcaatacgggggctacccactccacattaccttctttccaagggcctgtttcccttgcctccataactgttgtgggtattgacggccaggcttctaaacctcttaaaactccccaactctggtgccaacttggacaatactcttttaagcactcctttttagttatccccacctgcccagttcccttattaggctgagacactttaactaaattatctgcttccctgactattcctggactacagctatatctcattgccgcccttcttcccaatccaaagcctcctttgcgtcctcatcttgtatccccccccaccttaacccacaagtataagacacctctactccctccttggcgaccgatcatgcaccccttaccatctcattaaaacctaatcacccttaccccactcaacaccaatatcccatcccgcagcatgctttaaaaagattaaagcctgttatcacttgcctgctacagcatggccttttaaagcttataaactctccttacaattcccccattttacctgtcctaaaaccagacaagccttacaagttagttcaggatctgcgccttatcaaccaaattgttttgcctatccaccccgtggtgccaaacccatataactctcctatcctcaatacctgcctctacaacccattattctgttctggatctcaaacatgctttctttactattcctttgcacccttaatcccagcctctcttcgctttcacttggactgaccctgacacccatcaagctcagcaaattacctaggctgtactgctgcaaagcttcacagacagcccccattacttccatcaagcccaagtttcttcctcatctgttacctatctcggcataattctcataaaaacacacgtgctctccctgccaatcgtgtccgactgatctctcaaaccccaaccgcttctacaaaacaacaactcctttccttcctgggcatggttggatactttcgcctttggatacctggttttgccatcctaacaaaaccattatataaactcacaaaaggaaacctagctgaccccatagatcctaaatcctttccccactcctctttccattccttgaagacagctttagaaactgcccccactctagctctccctgactcatcccaacccttttcattacacacagccgaagtgcagggctgtgtggtcggaattcttacataaggaccaggattgcgtcctgtaggctttttgtccaaacaacttgaccttactgttttaggctggccatcatgtctccgtgcagccgctgctgctgccctaatactttgaggccctcaaaatcacaaactatgctcaactcactctctacagttctcataacttccaaaatctattttcttcctcatacctgacgcatatactttctgcttcccggctccttcagctgtactcactctttgttgagtctcccacaattaccgttgttcctgacccagacttcaatctggcctcccacattattcctgataccacacctgacccccatgactgtatctctctgatccacctgacattcaccccagttccccaaatttccttcttttctgttcctcaccctgatcacgcttgatttattgatggtgggtccaccaggcctaatcgccacacaccagcaaaggcaggttatgctatagtataagccactagcccgcctcttagaacctctcatttcctttccattgtggaaatctatcctcaaggaaataacttctcagtgttccatctgctattctactactcctcagggattattcaggacccctcccttccctacacatcaggctcgaggatttgccccacccaggactggcaaattagctttactcaacatgccccgagtcagataactaaaacacctcttagtctaggtagatactttcagtggataggtagaggcctttcctacagggtctgagaaggccactgcaggcatttcttcccttctgtcagacttaattcctcagtttagcctcccacctcaatacagtctgataacagacgagcctttattagtcaaatcagccaagcagtttttcaggctcttagtattcagtgaaacctttatatcccttacggtcctccgtcttcaagaaaagtaggactaaaggtcttttaaaaaaacacacctcaccaagctcagccaccaacttaaaaaggactggacaatacttttaccactttcccttctcagaattcaggcctgtcctcggactgctacagggtacagcccatttaagctcctatatagacgctcctttttattaggccccagtatcattccagacaccagaccaacttagactgtgcccccaaaaaacttgtcatccctactatcttctgtctagtcatactcctattcaccgttctcaactactcatacatgccctgctcttgtttacactgccggtttacactgtttctccaagccatcacagctgatatctcctggtgctatccccaaactgccactcttaactcttgaagtaaataaataatctttgctggcaggactatgctgaatctccttaggcactctctaatcagatatcctgagtcatcccaattcttagaccttttatacctgtttttctccttctgttattccatttcgtttctcaattcacccaaaaccgtatccaggccatcaccaatcattctatacgacaagtgtttcttctaacacccccacaatatcaccccttaccacaagacctcccttcagcttaatctctcccactctaggttcccacgccacccctaatcccgcttgaagcagccctgagaaacatcgcccattctctctctccataccacccccaaaaatttttgccgccccaacacttcaacactattttgttttatttttcttattaatataagaaggcaggaatgtcaggcctctgagcccaagccaagccatcgcatcccctgtgatctgcacctatacacccagatggcctgaagtaactaaagaatcacaaaagaagtgaatatgccctgccccaccttaactgatgacattccaccacaaaagaagtgtaaatggccggcccttgccttaagtgatgagattaccttgtgaaagtccttttcctagctcaaaaagcacccccactgagcaccttgtgaccccccactcctgcccgccagagaacaaaccccctttgactgtaattttcctttacctacccaaatcctataaaacggcccctcccttatctcccttcgctgactctcttttcggactcagcccgcctgcacccaggtgaaataaacagccgtgttgctcacacaaatcctgtttggtggtctcttcacacagacacgcatgaaacggatcactcacaacatagcccttgctggagatgtgttcacaatcctaaaaactccatgagaaagccaactaccattaggaaagtcaacagacacagctaacagaaaaattagcattctccaaaactcaaaaaaatagaattgagactataaaatatggttaaaatgattcataaaaagaataaaaactataataaaaaattatgaaaaagataaatttgagaaagaatcaaagacaacttcagaaacaaaaaaatgaagcctaaaaagttcaatggctggaataaacagataagacagggctgagaacagaatcagtgagataaatacgaaggagttaactgagaatatagtgtggagaaacctaaaatacatgaaacaggacaggttcaacacaggtataaaagaaaccccagaaggaaagaacagacagtggggatgagataatactcaacaaaataagaacatccaaaattttcttaatgaagaacacagagataagacctgaacaagaggaataaaaataaatccatatctaggcgtggtggtgtgcacctgtaatcccaactactcaggaggctgaggcaggagaatcgcttgaacctgggagacagaggttgcagtgagcggagattgcaccattgcactccagcctgggcaacaacagcgagactctgtctcaaaaaaataaataaaataaaataaaataataaaataaatccatacctaaacagaggtgaaaacaaacactgaagacaaaacaaggggaaaatgtgaatcatgcttgttatcaaataaataatccaaaaatgtatatatatgctgtatgcctaacatcaatttcatgcggagatgctgattttaatacacaggatggcagcgtgccctctagctcactcacattctgcgggaatgggtttaggtgcagctcaatttcagaaaacctcaatttagtccaaagtttgtcagtctaaacagactcaggaatctactactgccacacatccaggggcaacaaactgtttatgttgagccctgcatttgtactctcaatttccccagcatacacactattctactatgttacaactgccaatttttcttaatgcccaaattaattcaagtgttggcttttataacctaatttatccagcaataaaagcacctagaatgtattttgatgacaagaaccccatcttgtggcaaaatgtttcacagctgagtttggctgtgtactgtaatgccattcccactctgaagataaatctgcgttgagaagttatcattttatctgctttaccagacagaatttctaacccagcatttatcttgtgtctgcgacggcaccaaagtatgcagtaaatctgcggaacacagtaattctggggctttgtgagttattttcaagtgaaagctggtagtctttgtgcagcttactgcaggaatattttaagagaaaaacaaacactgactagggttagcttctgaaatattatctgtccattctaggaagagttcagatattgcacttcctataagatgaactcacttaactaaagcaatcaagacaaaacctccccaaatccacacgaattgacaccataattagcaccatacataataaagctaccccacacacagcacattcgtatttcatagcattcatgttatttttctaaaaggtggcttttaatcaatttctcggcccttcctattttaaaagacagtagaattacattctaaaatattcttcccattttttcttttactaggaatgtccagcatgggaaacatgacaaaatgctctctacgaatacaaaaacattagccggacatggtggtgtgtgcctgtagtcccagctacttgggaggcagagcccaggagaggtcaaggctgcagtgagctaagaccgtgccattgcactacagcctgggcaacagagtgagattctgtctttaaaaaaaaaaaaaaaaaaaaaggaatgtcttcctcaatgttttctactgttcctatttggttttcctgaagaaattttaaaaggccttattgttaataagctaaaaaatgtaatgaagcattgagcatgatatctggctcaaaaacattagttattattattgcttttattattgttgttattaatgacaattaaatactgaaagacccccaaaatagcttatcttccacaactggcaaagccttaaagaaaaatccagttcaaagaagtcaaattatatttttatcaaaagcaaaactgaaacaatacttttctcccctcaaaatctgtttttaaagcgttaaaaaggacagtatatcaatattaaaa

SEQ ID NO: 2173 - DNA, 8558 bp, Homo sapiens; identical to SEQ ID NO: 2172

SEQ ID NO: 2174 - DNA, 764 bp, Homo sapiens
atggaatgtgctaattagagcggtttggtgcaaatcagcccgtgcaggtgtggggaagccgcttctgttcttttcagcaccggtggcagcagcagctcaggagtctcttaggttgggcggggcttgaatcaatgatgaggctctattctgaaacaccttttggtgtgaagcgggcttctcttctttttgaagatgtgggcgtgcgtctgtgtgtttgatggcgggacacagagggttggagctggggaaacacttcaggatgaaaagtattgttcctgatgcgtctgtgagggtgttgccaaaggagattaacatatgactcagtggactggaaaggcagacccacccttaatctgtctgggcacaatctaatcagctaccagcattgccagaataaatgcaggcagaagaatatgaaaagaccagactggcttagcctcccaggctacatctttctcctgtgctggatgcttcctgccctcgaacatcagactccaagttcttcagctttgggacttggactggcttccttgctcctcagtttgcagatggcctattgtgggacctattactccttaataaattcccctttatatatacatctatcctattagttatgtccctctaaggaaccctgactaatacatcaactctgctagcttctggacttccaagaaccagaactgtaagaaaataaatgtctattgtttaagccaaccagtctctggcactttgttatggcacccaagtagactaatacagag

SEQ ID NO: 2175 - DNA, 3308 bp, Homo sapiens
gccctggccctgaaacagaacccgccctgcttgccacagagcccacgctgtgctctcccgcccatcctgccccaccccgccccgagaagcatggcctgccacaggcctgtagagactagggctggtgcggctctgctgaaaagcccccttctatatgtccagcagaccaggcctgggactcaggaaagcggaaacccagaactgatcagagggctttggttcatgcccaccacccagcaatggggctcctccaaattacctgggtccttttgggctatgggggtgcttggggaaggaaggggcagaaacaaggaggagcaggaggggcttccaggctggtcctgcccttcatcccagggacatctgctaatgtccttcgagttagtttttcctgcacataccatgcaacatacacactcagacacacataccatgcaacatacacactcagacacacataccatgcaacatacacactcagacacacataccatgcaacatacacactcagacacacataccatgcaacatacacactcagacacacataccatgcaatatacacacacagacacatgcgcgcacatgcacgaacactcatttgtgcattcaaactcatacatgcaagaacacatccacatgcacgcacacaaacagaaacatgcacgtgcatgcacaaacatacacaaacacacacaaatcacacacgtccacactatttagtagcctaatttctaaaattagcaaaacatttagggatacattcctgacctccgccttccaggcacatgaggaagctgaggtcctcccaccctcccgtgaggttagacgtggctgcacttggccaatgtgctgtgaacccacagtgagcgggtccctgcgagtgaagcttggtagaggagtgtgtggctccttcaccacctcccctgccacggggtcccgcaggccatattgagacaggctcctgtcagctggggccctgagggctcagaggagcagcacatcctgatggatacaggggcccagatggtggcttcggagataagagacaaacctgctaccttgctatccctgcaagcgaggggcacgccaggctgagggcggcatggcaaaggcggaggaggtgttcccccacagctctctcgggaaacgacacgtgcttcctgctaccagcaggcagactcggatggaggtggaggggacgagagtgtggcaggcaggcgaccaaaagtcaacgcagtttggtctctgatgaccccaaagtaaaaaccagtcccataggcaattgacctttgaccagttcagaagccttgcatcctccactggctggcaccatctcccaagcccaatctgcctgcaacagagtcccctgtcctcagcaggcacgtgtctggccctagcctgcaggaataggcctgcgcctggccttttaaataatcaaaggccagagccaggggccgttcctaaaggtctttcaggggcctcactatcagccaagcagcggggtcagacctgggctctcgcagctcccagataccctggtggatggggacagcctccgcgtggggtgggggaggcaggctcgcctgagatgttccggggcttagatggtaccagccaggagcctgggaagatattcatcagctcagggaatgtaatgtcaacacccgtgccttcgtttctgtacctaagttaacatttcaccctattttcttgagaattaaggctgtaaatgacatttactttgcttgtcatgaaatgcacagaagaacattcaactttattttcaggggttaatagaggtttttgcaaactatgctcgttatcataataaagggcaaaaagaatgaagaaaaggcataaatgcggcaccgagtaaatttcactgctctgcatttatttgcagatgttccctttctcccgctttgactgaattttttttcctagtggaaagaacatgggcttaggaggcccacctctgagctgtggctccagccccgaccctggctttctgttgcaagcatggagtgggccctttcaggtctctgagcgtgttcctacctgcggtgcgagggtcctagtgccccactctgtgagactcaggtgcggtcaaggctgcccccgcttggtgcttgtcgctccccgccttcactgagcctcaacacccaggcagagatcagtcagcaacaacacccacacgggacaggggcttttctgagcacaatcattcctcacaaatgtagtgcccccaccccacccccggagaagacagtccagaggaagcaaggatggggacgcagcatgggagcccacccaacccaggcccgtgtctggagcgaaagggcctcctccacatccatgtggcagagcaggccgggaggcaggcgggggctctgctggctgacagagaccgagaagccttgggactccctggagctctcggttggcccaagttagggctgccaacgccacagctttccactgcaagcaccggagccaggcacgtggccccaagtgcctgggcccactctcagcccctgcatctgtgcccgtcctgccggctccatcctgcctggcacacttcttgctgtggccaaggcctccccccaccactcacctgtgcctgcccgagacctggacccctccccaccctctcggagacaactccaggcgtgcagggacactcagcgtcatgcgtcggcctggggagcgggcagggacaccctgtgctggaggccccagggatctcccggctgctctgtggccaagctgatgtttgcggcatcccagcctgcctccaggtgttgctggaacagctcattcctccccttccctgagctgcatgttcccacaccgcgtggcaagcaaacatctagagggccctcagtgacagcatctacgccagaccctggtggggcagcctcatgtggcatctgcagggagcagtcgagggactgaggcaccaactatgctgctcagctgcatttgggcttgaggttccccagcccagggtggaggccccgagaggcacaaggcaggaaaggcgctgggtggggggcctggagggtcagggcggggaaggcgctgggtgggggcaggtctgtactgggatgtgtaccaccatccttcaagagtgaggcagcaactctcactgaagtcgctcagggcccatgcgtctccttcctctttcacaaggaaaaaggctttgctgagagctcggcgctggtgctacacggagcaggcccaggtgcagcaggaggggctcaccgtccttggccacgtccccgatgggcacactgtgcttctgt

SEQ ID NO: 2176 - DNA, 3308 bp, Homo sapiens; identical to SEQ ID NO: 2175

SEQ ID NO: 2177 - DNA, 915 bp, Homo sapiens
caagagttcaagatcagcctgggcaatgtaacgagacaccatttctacaaaaactaaattaaaaaaaaaaaaatgagcattttcagccaggtgcagtggctcatgtctgtaatcccagcactatgggaggccaaggcgggtgaatcacttgaggtcaggagttcgagaccagcttggccaacatagtgaaacccctactaaaaataaaaataaatagccaggtgtggtggcgggcgtctgtagtcccagctacttgggaggctgaggcatgagaattgcttgaaccctggaggcagaggttgcagtgagccgagatggcaccactgcactctagccttgagtgacagagcaagactctgtctcaaaaaaaaaaaaaaaaaaaaaaaaaagaaataaaaaaaagaaatgagcatttttgacctgtccaacctactaaatcagaaacttagcaccctatgctttaacaagtcatggctaagggctttaaaaaggtgattttaatgcatgcctaaggtggagaactaaggagaaggcttttgggtaaggtgaatctggagcgggggacccaaggcctaaggaggaggggagtgtgaggcaaaaggagccccttatctacaggttctcaagctcctcccatcaatcccccaacctggccctgtccctccctcgctcaaccttagtttcttcctggaattctcaggcctcctggttcccaaattctgatttccccactgacctgactccagatctccctaccccactgggtcttgtccccagcgtcactccaacccctcaccagcagtccccaggccatgccaacccccacacttttttttttttttgagacagagtctcactcttgtcacccaggctagagtgcagtgccgcaatgtctgctcactgcaacctccacct

SEQ ID NO: 2178 - DNA, 1896 bp, Homo sapiens
cgcgttttggggaaaggcagagcagcgggagcgcggcgcaagggcaaaatggatcgttggtacccggaagcccgttcaaactgtataagggtgatcagctatcacggagaaggctttagcaagtcggggccagtggcgcaatggataacgcgtctgactacggatcagaagattctaggttcgactcctggctggctcgcgatgtctgttttgccacacttgacccatgtactactgggtcttgtaaagatgtatattcacaatgtgaaagtattacaagaccttggaaaggtgtatggttagaatgtgaaagttaaatatctgaaattttgatgccgctttgctcacaatgtcatcctttatcctttaaacctggagttgtctgaggtggtttgcaaactgcaaagcgccctgttcccaatgatgcacctgagaagtctgtaaatggggtaaatttaggcaaacacacctggaaaagtggcattttggagtggggaatgctgtggccggaggttagcaaccggatgatgcaaaagcgtatttaaggcagcagttctggcctttccccgccacggagcagaagcccccatagtgatgtgagaagcggcgctgtcccagtttactaggatgggatgggctttggatctaaccagcagcgaagaaaacctgcggtgcggctgcgctcggtagtaggggtccacaaagcgtcagaatctgcagcagccccggcctttgcgagctccagctccgaagtcaacccggcccccaaattccactgggaaaccttaagacaccggtgtttttaccgtaagaagacctcagaagcccatggaaacaaggcgatgacggcgcttgagggtgaccagacctcctcaatcattccatcagccacccaggactcaacagcagaacctcagaggactcagctgaaagaggttttcactcgagcactaaccacagagaaatgggaagtgccatcctgctgtcatacgcagccgatggctgggtaggactaaatgcccttctgtggtgagatgaaccaagacggcagatgggggaataacatcagtgagagagagattacgaatggatccttgtattgcagatcaaactgggttgtctcttctcaaaccacccaggcagtttctgaatgtcccaagataggggtaggagaaaagaaaaaaaagacaaaacaggagacggtgggtaagaaaacctaaaaggcacaatgaggcaaaggcctaagatggaggctggctttgggatctgaaatccggccacaatcctccttgttttacctcaagtccaagaattgtcaaaaagaaaacccagaagggctattcattctaaattttaaaatcttttcttcctggcctaccaagtccttgtgttttctttctaggcgcccataaatacaaccccattacagttctatttggctaataatttacagaacatttaaaataccgggtaggtgaacatctcttcatggcttttgtgtaagggcctgaagcgaagagaaaaacaactgattggagattcctatctggcgccttctccagggaaactgacaaccagagaaatctgttgctaggatttctaggacatctggaaattccctttttgttctttctcaacaatataaaatggtatattcgcaaacctatctgaatcacctcaatctaggccactttgaaaatttcatttaaaaatgtaatcacagatttttaaactaattacccaatttgcaaacaaatcccagctacttctggtcttgaacatggagcaaaggtgtgtcagtaaggccaacattcttaggttgacagagacaggttaacacattggctggcttcatttacccccctgccactgtgtggccctccctcagctcctgcc

SEQ ID NO: 2179 - DNA, 1896 bp, Homo sapiens; identical to SEQ ID NO: 2178

SEQ ID NO: 2180 - DNA, 3134 bp, Homo sapiens
ctttgtccctggttcctaggagggaaactaaatccttggaatctcctgagtaatatgagtatctttgttattcatgagccccttggatcacacctgggcttatgctaagagagaactcacgatgggaggttggtcatcagaaagatcacataataaaaggattgggccttagagccagcccaacctcgacggagggtgggaggactagagattgcgttcaattcggtggcaaatgagtcaaccaattgtgcctatgtaatgaaaactctggacgccaaaatttggtggagcttcctggttggtgaacacatccatgtgccaggagggtgacacaacctgattcacagagagaagacacagaagctctgcatggaagacccgcccagaccccgccctacgtgtgtcttcattagtctggtcctcctgatttgtatcctttgtaacaagcctgtaatcaactttctcagttgtgtgtgtgagtacgcctggcttttcatcaaagagctttgccgtcttgatgcttccttttctgtgaacacagcaataaatagattctgcagaacaaatgaccaggagaaaggactttgtgctccttcacctcagaaacctgaactcagaatttccttgtagacacttttcaggcctttgtttgctggagactggagttccctgagaggattaagggtgtggtggggagtgtctaaaggagcccagtgccttgagggcagccaagaagacagaggccctggactggataccggctgaggtaggtggatccctgtggggtggagaccatccccagctccacagccccaggcatgtcaagggctatcatcaaggcctcagaggagaccagctgcctggggcacctcaggaagctataccctgacacctggactccagagtccacaaatatatctgtacccaaaccagtgggcaagcaaagaagcccttgcctttgggagacctcaggatgttggccatgagaacatcatggatgggcgcggtggctcgctcctgtaatcccagcactttgggaggccaaggcgggtggatcacctgaggttaggagttcgagaccagcctggccaacatggtaaaaccctgtctctactaaaaatacagaaattagccaggcacagtggcaggtgcctgtaatcccagctactcgggcggctgaggcaggagaatcgcttgaacctgggaggcagaggttgcagtgagccaagatcatatcactgtgctccagcttgggcaacaagacagaaactccatctcaaaaaaaaaaaaaagaaaagaaatcatggactccaaaaggcctgaagtggagagtcctgaagccatctcagaccatgaggccaccctaagggtagaaggaagcacactaagatgacaggaacagaagacaggagcctgggtccatcatgccagggagcctccacacctgccctggacgtttcatctcagacctcgtggataaagcagagaaataaatatctaccttgtttaagccacttattttcaattttttgtttcaagcaggcttttcatgaagttcccagtctgacagcattaattggtgggctagaatttgtggacggtttccatgtatgtattctgcaaaaccatccataagaaagagttgaacaagtcttgggactagctagagaagtgggcaaaaaaagagaggaagtggccgagtgcggtggctcacgcctgtaatcccagcactttgggatgctcaggcaggcagatcacgagatcaagagattgagaccatcctggccaacatggtgaaaccccgtctctactgaaaatacaaaaattagctgggcgtgatgccatgcgcctgtagtccgagctactcgggaggcggaggcaggagaatcacttgaaccctggaggcagaggttgcagtgtgtcaagatcatgccaccgctctccagcctagtaacagagtgagaattccgtctcaaaaaaaaaaaaaaaaaaaaagagagagaggaagtagcctctccactgcccctgccatgcctagaaggttccccagcataagaagagatcatttgcatctcaaacagcacaataggcagcctgctgggtggccggggaaactgtccaagacaggaccgtaccagaggccttttcttgtcctttgaatatttcaacttctgtgcaggaaggcttgggctttcccaggacaaaataatttttaacattttatttgtcttattaaatattaaataaatatatttgtaaaagatacagacatgaataacaatgatacaaagaatgacaaagtgaccttttaaatttgagaccaattccatctaaaacaatccaagccacctgtagctgttggtttgattgcaataaccaatactggaccatggttacttaacctatcaacccaagaagaaatctttcataactgtgatgatcacgaaggaaatataaacatggctaacctgtgtcatgaaaaatggaagctaattaaggtatctgaaatgagtgaggagactgaggatgttctgaaggaaatgcaggaaggagaattagcctaagtgcatccatgttgaacttatacataaatctttccttggttggcaagagtccagaatatgatatcacagtgtgtgaaggaggctgagaggaaacagactgtcccatgcattgctggcagcagtgcagatggcacagttctgtggagcagacctgcaatatctaccagaactatacatgcacaaaccctttgacccagagatcccccttctgggaatctatcttatagattcacctacacaaaggtaaacttgcttaggtataaggttattcattgtggcattatttataataacaacggatcagaaacagcccaacaacccagcaataggagactggcgaacacacagctctggtcgatccaccaatggaatactatagagctgtcaaaatgaaaaaggcaggaggaacagctttacgtggtgatagggaaggatacccagtatatttagttacgattttaaaaggaaggagcaagatgtatataacatgctttttttgtgtaataaaagaggaaataaaagtatgttatttatgtttgcataaagaaacgttgggagaataaataaggc

SEQ ID NO: 2181 - DNA, 1169 bp, Homo sapiens
tgatggaaaaatattacaggtacacatggaaaagacatgatcaccaagtgaaaacaatctaaccagaaagctttaacgtctgtcagttaagctgaagctgaaattctgggagcatgacatgctgcagggccaaaaggaatggataattagtattcctctccttcttcctcaccctctccttcaacagaatccacaccaacctcctcataatccttctcaagggcagccatatcttcacgggcctctgaaaactcgccttcctccatcccctcacccacgtaccagtgaacaaaggcacgcttggcatacatcaggtcaaacttgtggtccaggcgagcccaggcctcagcaatggctgtggtgttgctcagcatgcacacagctctctgtaccttggccaggtctccaccaggcaccacagtgggaggctggtagttgatgccaaccttgaagccagtggggcaccaatccacaaactggatgctgcgcttggttttgatggtggcaatggcagcattgacatctttgggaaccacgtcaccacggtacaacaggcagcaagccatgtatttaccatggcgagggtcacatttcaccatctggttggctggctcaaagcaagcattggtgatctctgctacagaaagctgttcatggtaggctttctcagcagagatgacaggggcatatgtggccagagggaagtggatgcgggggtagggcaccaggttggtctggaattctgtcaggtcaacattcagggctccatcaaatctcagggaagcagtgatggaggacacaatctggctaataaggcggttaaggttagtgtaggttgggcgctcgatatcgaggtttctacgacagatgtcatagatggcctcattgtctaccatgaaggcacaatcagagtgctccagggtggtgtgggtggtgaggatggagttgtagggctcaactacagctgtggaaacctggggtgctgggtaaatggagaactccagcttggacttcttgccataatcaactgagagacgttccatgagcagggaggtgaacccagaaccagttcccccaccaaagctgtggaaaaccaagaagccctggagacccgtgcactggtcggcctataacaaaagagaggaacagaggaaaggttaagtttttat

SEQ ID NO: 2182 - DNA, 5529 bp, Homo sapiens
ggggttgttctctggtgggcaggggcgggggtcacaaggtgctcagtgggggagcttctgagccaggagaaggaaattcacagggttaatcactcagttaaggtggggcaagaacaaatcaccatggtggaatgtcatcagttaaggcggggcagggccttttcagttcttttgtgattcttcagttacttcaggccatctgggcgtatacgtgcaagtcacaggggatgcgatggcttggcttgggctcagaggcctgacattcctgccttcttatattaataagaaaaataaaacaaaattgtgttgaagtgttggggcggtgaaaatttttggggggtggtatggagagagaatgggcgatgtttctcagggctgcttcaagcgggattaggggcggcgtgggaacctagagtgggagagattaagctgaagggaggtcttgtggtaaggggtgacattgagggggttgttagaagaaacatttgtcatacagaaagattggtgatggcctggatacggttttgtatgaactgaaaaactaaatggaataagagaaggagaaaaacaggtataaaaggactaagaattgggaggatctaggacatctaattagagaatgcctaaggaggttcagcatagtccttccagcgaagattatttatttacttcaagagttaagagtggcagtttggggatagcatgaggagatatcagccatgatggcttggagaaacagtgtaaactggcagtgtaaacaagagcagggcatgtatgagtagttgagaacggagaataggagtatgactagacggaaaatagtagggatgacaagtttttttgggggcacagtctaagttggtctggtgtctgggatgagactggggcctaataaaaaggagcttaaatggactgtaccttgtagcattctgaggacaggtctgacttctgagaagggaaagtggtaaaagtattgtccagttctttttaagttggtggctgagcttggtgaggtgtgtttttaaaagacctttagtccgttctacttttcttgaagacagaggactataagggatataaactgaaaaactgcttggctaatttgactaataaagcctggtctgttatcagactgtatagaggtgggaaggctaaactgaggaattatgtctgacagaagggaagaaatgactgcggtggccttctcagaccctgtaggaaaggcctctacctatctagtgaaaatgtctacttagactaagaggtattttagtttttgtgactcggggcatgtggagtaaagctaatttgccagtcctgggcgggggcaaatcctcgagcttgatgtgtagggaagggaggggcctgaatgatccttgaggagtagcagaatagcagatagaatagcagatggaacactgagaagttatttccttgaggatagatttctacaatggaaaggaaatgagaggttctaagagatgggctagtggcttgtaatatggggaaatggggtgaatgtcaggtggatcagagagatgcagtcatggggatcaggtgtggtatcaggaataatgtgggaggccagattgaagtctgggccaggaacaatggtaattgtgggacttaacaaagaatgagtacagctgaaggagccggggagcagaaagtatatgcgtcaggtatgaggaagaaaatagattttggaagttatgagaaatgtagagagtgagttgaacatagtttgtgatttttagggcctctaaaattattaaagcagcggcagctgctgcatgcagacatgagggctaggctaaaacagtaaggtcaagttgtttggacagaaaggctacagggtggggtcctggctcttgtgtaagaattctgaccgcactaaccatgcctaggaaggaaaggagttgttgttttgtaagggattgaggtttgggagattaatcagacaccatcagcagggagagcacctgtgtttttgtgaagaattatgccgaggtaggtaacggatggagaagaaatttgagctttggagggggatacccgatatcctttggagaataaatgctgaaggagcagaagtatgtcttgttgagaagattcaaaggaggggctacaaagaagaaggtcatcaatatattgaataaggtgagaagtggaggggtggaaagaaagtagatcatgagaaagagcttggctgaagtaatgagggctgtccctggaaccttgcggcagcacagcccaggtaagctgctgagcctaatgggtgtcagggtcagtctaagtgaaggcaaagagaggctgagatgaagagtgcaaaggaatagtaaagaaagcatgtttgagatccagaacagaataatgggtagtagagggaggtattgaggataggagagtatatgggtttggcaccacggggtggataggcaaaacaatttggttgataaggcacagattctgaactaagttgtaagccttgtctggttttaggacaggtaaaacgggggaattgtaaggagagtttataggctttaaaaggccatgctgtagcaggtgagtgataacaggctttaatcctttcaaagcatgctgtgggatgggatattggcattgagtcgggtaagcgtgattaggttttaatgagatggtaaggggtgcatgatcggtcgccaaggagggagtagaggtatcttatacttgtgggttaaggtgggggaatacaagaggaggacgcaaaggaggctttggattgggaagaagggcagcaatgagatgcagctgtagtccaggaatagtcagggaagcagataatttggttaaaatatctcggcctgataagggaactgggcaggtggagataactaaaaaagagtgcataaaagagtgttgttcaagttggcaccagagttggggagttttaagaggtttagaagcctggctgtcaatacccacaacagttatggaggcaagggaaacaggcccttgaaaagaaggtaatgtggagtgggtagcctccatattgattaagaaggggacagacttaccctccactgtgagagttacctaaagctcggtgtccatggtggtctacagggcttctgaggcgatcaggcagcgtcagtcttcagccactaagccaagaaggagtcagtcagagagccttgggccagagttccaggggcgctgggagtggctgccaggtgagttgaacagtccgatttccagtggggtcccgcacagatgggacatggcttaggaggaatccctgggctgcaggcattccttgccctggtggtcagatttctggcacttgcagcaagctcctgggggaggaggttctggaggaatgtctggccactgcggttcaggcatttggaagttgttgtgtgctggagatgtggctggggtttgtctcacagtggaggcaaggaattgcaacttccttttttttattattgtacaccttgaaggtgaggttaattaagtcctgttgtggggtttgagggccagattctaatttttggagttttatttaatgtcgggagcagattgggtaataaaatgtgtattgagaataagatggccttttgaccttttagggtctagggctgtaaagcatctcagggttgctgccgaacgagacatgaactgggctgggtttttatatttgatgaaaaagagcctaaacgcttctgatttgggataaagaaaaaggagcattaaccttgactatgcctttggctccagccacctttttaagagtaaattgctgggcaggtgggggagggctagtcacagaacgaaactgtaagccagaccaggtgtgaggaggggaggcgataaaaagattacagggtggaggagcggaggctgaggaagaattgggacctagcttggcctggcaaggaggggagaggtcagatgggtctgtagaaaaggaagattagaaagactcagtgacgcttggggttgggactgaggggacaggcgggagggaaagaaggaagattcagaatgagttgcactgggcacagagactaggaagggactgatgtgtaaaagaatgcctggatgtcaggcacctcagaccatttgcccattttatgacaagaattatttagatcttgtaggatggaaaaattgaaagtgccgttttccggctatttggaactactgtagagtttgtattggggtcaagaggcattgcagaagaaaatgagacacttagattttaggtcaggtgagagttgaagaggttttaagttcttaagaatacaggctaagggagaagaaggaggaatggaaggtggaagcttgcccatagtgaaggaggcaagcccagagaaaagagtagagacacggagaaggggtgggggtttcttgccctccagaaaagcagagaaagggttggggcacagaaataagggattggggcacagagataagaggtcagggtgtggaaataagggattgggggttcttgccccctagaaaagtgggaaggggggttggggcatggaaataagggattggggcacagagataagaggttggggtgtggaaataagggattgggtcacagaaataagaggtcggggtgtggaaataagggattgggggttcttgccccctagaaaagcgggacttgccactaagggtgaaggagaaggggttgaggggtactttcccctcccccagaaaagtgggacttgccactaagggtgaaggagaaggggttgaggggttcttgcccctgccccagaaaatcagagaaggggtagagacaagaagagaaggggttggggtacttgccccttccccagaaaagcagggaaggggtagagacacagagagaaggggttggggtacttgccccttccccagaaaagcagagaacgggtagagacacagagagaaggggttggggtactttccccttccccagaaaagcgggacttgccgctaagggtgaaggaccaaggcaggcatccctgcatggtctgacacccttgaaacgtgggtgaataatcagagaggtgtccctgcaatgattaaacagcaagggaaggctgccttcccagtccgtgaccagcgctggagttttgggtccacagataaaacgtgtctcctttgtctctaccagaaaatgaaaggaattgaaactaagagaagggagagattgaagtgtggcgccaagattgaaaggagaaagaggttgagggatagtgagggaggttggagaagagagtaaaaagaggcggcttactggatttaaaattggtgagatgtttcttgggctggttggtctgaggacctaaggtcgtaggtggatctttctcatggagcaaagagcaggaggacgggggattgatctcctaagggaggtcccccgatccgagccacggcatcaaagttcactcgagtccatgtgaagagacaccaaacaggctttgtgtgagcaacatggctgtttatttcacctgggggcaggcgggctgagtccgaaaagagagtcag

SEQ ID NO: 2183 - DNA, 531 bp, Homo sapiens
gtgaagcacaacatttcatctctttgattctagacactatcctcagaaattagatttgaaaaatgagcttcattttcgaagaacatattgaatttgttatctcgattatggagggcgacaagtcccacagtctgccatctgcaggatggagaaccagggggagaataattgactccattcaagtgttcgctcctgtttcaatcaactatggctgaagagtgaggagacatttggaataaatatggcttctgggggcccattcctatggatcagcagctggcttctggaggcccattcctgtgaatcgtcgatctcatagaagataatattgttagaaggcttacctcattgatgctgaacatcctaaaaagcttctgctgctttgagtcactgaaaaagaccaagaaacatgaatttaaaaaaaaatttcaaatgttataaaataaataatatgaactcattatacctacaatgaataatttaaattcttctttggtagtccaggaaaggcaaggcagggaggatcccttg

SEQ ID NO: 2184 - DNA, 12274 bp, Homo sapiens
ttccccccgccacctggggcccaggaatctccaggactctgactacagaaggcagtgccaaaactcaactgtgggcctctttgagaatcataaagtaaaaatattagagctaaatgttgattctggtctttggggacaatgactgcttcttttaaaaacaccgtttgtagcaaatctgttcattttatttccccaggaagcatttggcctaaaacaaaacacaacaccaagtcacaactattgccggcagctactgccactctgtgtgacccaggctggtcactgcccatctctgagcctcgggtctgtcattgccagaagaggagacacgtgcagccccacacacctcacatgggtaagaaaagccttcagggccagagtgggccccacacagcgagcgcgaagtcccctctcatggagcagccggggcagacgccaccaggaactcatgctcttccccgacaaccttggggccagggagccccaggaaccgcaatggcctctgaaacagataactacaggccgtgtctacctaacggaacaacagtccctaacgcccgccctttaggaaggaaagggtcatgttgggtggaaaccctgggtgaacatcctggggtgcctggaagatgggaatttccatcccaacgcctcacgtctgtgcttccaccgcgcaggcgggcggcaggggcagagccggccttggcctgtgcagcttctccagccctcgacaccagcttctgtccaaggctgcggaggggctgctgcatacacagccgactcaagaggccagtttccaggaggctccgatggctgctgcaccaggttcccaggcacgtgaggctgggtgtccccctcgtcccagaggctctgtggtgccggcttgcttacccaaggtcacaaggtgagtcagtggggcccccctggcattggccctggtctcaagccagtgagactagcaggaagaggcctgcagacttctcacttgcagagatgtttttaaaatatcttacttacggctgggcacggtggctcacgcctgtaatcccaacactttgggaggccgaggcaggcggatcacgaggtcaggagatcgagaccatcctggctaacatggtgaaaccccgtctctactaaaaatacaaaaaattagccaggcgtggtggcgggcgcctgtagtcccagctactcgggaggctgaggcaggagaatggcgtgaacccgggaggtggagcttgcagtgagctgagatagtgccactgcagtccagcctgggcgaaagagcgagactctgtctcaaaaacaaaaccaaaaaaaaaaaaaaacttacttacttggcagattttcaagttagcaacactaggtcagcctccaaaatccttcaaaaatctggaagtctggagcacaaacccatcggcatcagctggactccttagtgtgcctcgtggggtctacagctgtccctggctcctgcctcgcacctgtcaggagcttcccagcacccagccagacattggaggcctggcagcgcccaccctgctggaggtgccctttgctcctcgtgcccaggctaggggctggggtccacctggtagggcagtgaggaggcaggtgcggccacagcgtgtgctcggtcacggcagctttccccagcgctggatgctgttagcttccctcccacagggaaggtttatccaagaccaggtcgccgggtccaggaagccttcagtgacccccagggccgggctcaactctttccatcagttgtggtcctctcagcttgtttcctgacctgccagccctccttttgcaggttttaccaataaaatttaaaacaacagcagataagcacgtctacgcccatcatcccactcaccccgtgcgcttcccacggaggaggagtgttgttaccgcctacggttttcagataaggaaagtaaacctgagggtgagcccctgccaagggcacaagaccagtgaatgctgagccacttccacaccaggtaatgtggctgggagcatacacccgtcgccacgcgccccccaccatcccacgatgcagcgcacagcagaagggggtcctagccgcttcccgatgttgtgatgagaggcagagcgaagccggacgctgggcttctgctcttctttctggaacaagcacgttggagacgtgccacagctcaggctgaccctgcccccgtgatgtgcagtgaacgcaggcctttgcgcccggcgtcgtgcccgaggctgccagccctgcaggctccggagcatctcctgtcccgggcgatgccgcaaagccctgcggctctgctgtccctcggtggccccactgctgtcctttcctcacccccatctggtctgtgaaggacgaggcagaggacagctcatcccggccacaagctgggcttctcccggtggtttggggccaggcgtcgtctccaaagggaggcccagcaccagctcctttttctccaaatgaagaagtctcaaaaagccaggaaggctcagttccccagggagctcggtgtaagggaggggtcccaccagggaagggcattcagcgggcagagctctcaaggagcagctgggcacactggtggcccctgcagggccaggaggcaatggaatccatgggacaggggactggactatgtcctaaaggacaggagggaaccactggccccaggggcagagcaaggtaagaaacacaccaaccacaggccacaggtggcagcgcgggagggctccaagccgagcccacgcgtgcatttcccatctgcacaggtcagagagccctgacatgtcacctgcctggccactccgcagaagcgtgcagacatgggagggccccacctgccacccaggccaccagcccctcttaggagctccaagtcgcacctccatgccgcatgggctccaggctgactaggctgtcctcatcacattccacagcaaagtcacttcagcacctccagtctcagctcagcctcagacactgggccaacaactagggccacctgcagctagcggcaggacagagcggccgggcaaaggtaggcgtgggatgccaacagccctcggggctggcacaccaactcagtcacggccatgcggtggcccctggctcttccctctttcagccttgtctgtcacctttaaagagacaacttgaggacaccgggtcaccccctgtatcttccccttccctcctccctgctctaacagctcaactctcagcacaagcatccctctgatgccagaggctggggacttactggctttgcagccactgcttccaggtgtcagacctttcggagaccccactgtccctggccactgcccccagcctgttccagtgggcagccctgcaagcctcagttctaggtctctctcaactcagagacctcagtgacttagagttgtcattggccctcaaggtgactgacaccttcaggtcagataaggctaactgtgacagagattttgaaagtggcattcctcactgtggaaaacagcagggcggttcctcaaaatcacacacaaggccaggcttagcctaaccccagcactttcgggggctgaggcgggaggatcacttgagcccagaagttcatgaccagcctgaacaacatggcaagaccccgtctctacaaataatttaaaaattaggcgggtgtggtggtacatgcctgtagtcccagctacttgagaggctgaggtaggaggatcgcttgagcccaggaggtggaggctgcagtgagccatgattgtgccactgcactccagcctgggcgatagagcgaaacccttaaaaaaaaaaaattacacacagaacctaacctagcaattccacttttatttacttgacgagatccctcaacaccatcttcatagcggccttgttcacattcgccaagaggtggaggcaaccgaatgtccgtcacagctatgtagataaacacattatgccacacagatgacaagggattgttcagccatgaaaggaaggccgtgctgacgcatgccacaacacggatgatccctgacgacatgaggcaaagtgaaatacgccagtcagaaaaggacaaatcctgcaggacccacgcatttgaggtccctagcgccagacgggaagtagaatgggggtgccagggactggggaagggggagggggagtgagtgttgaatggggacagagtttcagtctgccaagatgacaaaattctggaggtggctggtggtgatggctgtacaacactgggagtggacttaatgcttccagacacttaaaaacggttaaaatggtaaattttatgttacacgtattgtaccacaataaaaatcaatatatttttaaataattttgaagttttataaagtgacatgtcttaccactctaccccagtggttcttaaagtggggtcccacggcggccgcatcagcagcacctaggaggttgttagaaatgcagattctaagccccacccctgactcagcagcttgggaggtgggggtgactcaggtaaaccaggcatcctgggtgtcccactgtgggctggagttggagaccacctctgcgtgccctgcccctcccagccactctcccatccgggctctccctccccctcccgccatccttaatggtcatccctggaagcccgcacagtggaggctcctgccccggcggggaaggtaagtccccacttcccatggttcccaaccatgcctcacagctccctggggttctttccatccatccaaatttccagacctcggcctcagaggtgacaatccagcagatctcaggggatccctgggaattctaggggatcctgcggcatggctggtgaacaatgaaacggatggttctaggcatggagtcagaagccttgggttgaaattccacgttcccacatcacccacagttgtttcctcgtttgtaaaagtggggagcacctgtctcagggattaggggacggggagatggtgagaggggcgcgtgtcaaagcacctgctcagggcctggcactggcgagcagacactgcgtgatcacagagcctgagccagcaacactcttgtacccagcacccagggcttttcaccagcttcctccctcaccccaagctggcttttgcctggccctgaatacaccagactcttaaaacacaaaacccttccttcctccacactctcctctacctgcacagccatcttgtgtccttccctccgcaggacatcctgaggcccacttgcccacacggcacctgccaggtgaggcagctgtcttcctcctagcctgttctcaccacaggggctggcgcacaccaggccccgaggctgtgctaactgaatgaatgagcgagagaatgaatgcacgcacaaggcagtgaccatcgatgtgtctggccttctgccacctcctgggtgtccaccatcatctcaaagggtgcagctctactcaggacaccccacctggctccaagaaggagcctgagtgttgacgtgtgtgcacaaggccttccatggttcacagagaacttcacatgctcatttgattcaaaaccacaagggccagcttgaaccccacttccccgccaaagccctcctgaccaccacctgcagaggagcactggccctcctaaagctcctcagtgtcagcccaatttctttggcaaccaatcaacagctccggctcctctgccaccactgcgacttgccctcagctgtcacctgtgtttgcgtctgtgttcctgtgctccagcagggcctgcatcctctaactcttggaatcctgcgcagaacccatcacaaaccggccttctagagacgccagaccccgctaatctgactctaggccactgcttgccaactcttacccactgtagccaaggtcctttaacctgttctctctgcccctcgctatcaaacatacacaccagcacacgggttgtccctaagcccccaggtgtcactgttaaccctgctcagctacatcccgtccccttcaggccccatcccccagccctggtacaaaatgtgaccacaaagctgccagatttggccacaatccaccctctcccatgaatcccacatgtagttgtacaacccccaggccaggtgtcaccatttgccatctgaaagtagaactcaacaggtctcatctttcgtcacatcactgtcgccagcccccacaccatctccttccacactcacagtcacagcccatgagtccaggccctgcctccacactaatctccagtgaatcaggtcaagcccttctgccactcctgcggtggcaccgatggcctcccagcctctgacccacattgcttaatgctctcacccagaatgggttagggcccaggctttggaatcacataggcctgcgttcattcctggctctatcacatgaatgccatggaatccctgacaaggcgcttagtttcttacagctgctgttcttcaactgtaagaataagaacccacccccgagggttgctaggaagatcccacaggacacatatgggaagagcctggcccagagcgggcagaggctaaatatgccaaagtgggacacgccagctctgtgcacatagctggatacatgctcagaagagcaccacccatctcagagctgcagaacagcctcagaggaagaaaaataaagtcccgggggataacgcaacgaggttctgccagggagatggcagcacgaccaaatactggtgcctcaccactccgggggggtgggtggtcacgggccagtgcaccccctgagtcctggttgcaatgcaggctctcaggcctcaccgtaacctcgcgctggtgcaacgggagaacgccctgaccgcagcctggccaggctcgctgtgcaccaagtcccagccccattctcttcctgtcctggctctgcctcctctaccagctgagtcagaatctgcattttcaccagctccccaggtgctctgtgtgcacattcgttcggaaagtattgttttagaagaggcctctccacttctagcctggtttcttccaaaaccacatagatgtttttgttccccaggtcttgtgttctgtgtattttccacagtgccgcagggaaggcagtgcagacagtgaagttaagagtacaggctctgaagtcaaactggtccgtccaaagccaactgccaagggctgtcgggaaaatgtcctgagatacgcacagatatgccaccaaggctctgcgcctccttagcagctaacgtagaggatgccaagggtgaatacgaggatctgtctaggagaagacacagcttgttcctaagaccttggaatcaggctgagctggattcagctctcttctgactgggacctgggacaaaatacttcagctttctaagcctcaatgtattcatttgtaaaatgggaaaattttacttataggaaaaaaagatcagaatttaaaaacagtatcttttctctaggtggtacaattaaaaacaactgtcttcatgcttttctgaatttccaaattttatatagtaaacgtacttaatttaggaggaaaatcccaaattaaaaaaaattcttaagttcaagagtataagatactaacggtttccatgtgaagggcatgagtctaccaacccatggcaacgtttctgtgggtgttttttaaaaatataattagtagttcagcttatttttgtttgatcttcataagccagtggacagggctgggtactctttttaacctttggtaacagaaaagaaaaatgaggcttagggaattcaagaaaattccccaaagtcacagagttcctaaatggcaatgattggttatgagatttatctccagggccctgtcttaacctgtggccagactgcaccttaaacttggatttatttttggttggagcagtttctaccagcagctccagagcagggcaagaagctggaggaacaacgtttgaggataaactttgtgaggttctggagtccagagtgatgcttctgagttgacaaaaacagggtttcaccatgttggccaggaaggtctttatgtcttgacctcgtgatccacccgcctcagcctcccaaagtgctgggattacaggcgtgagccaccccgcccggccgtgtctcatctttgaaatggggcaatagccctgtcatccgcagagcagctgcagagatgactcacaggcagcactcggcccagcgcctggcgtggctgtgactgctgccaccatcacgcctgtggcccgtcctctcaccatggcctgcagagaacgcataggagataacagtggcccacagaggagagcagccactgagggagaggcgggagagcgggcagccgcacctgctctggggagagtgctatggagcacacagaaggattgtcctgggagcaaggggccagaagagaaagctgccctaggttctgccccgccagccgggagcctcctgcctcgggaagcggagcgatgcccacccacacggcgggccctgtgttacccagttctcagtggcttcgcggagccttccaccacacagccacggcctcctgagaagacaccactgacccccacctcatgccaccccactgcctgctggggagacagacctcagtgcctgattcatgggcttctgagaaggttctgaagggaacatggagagcccctggtcctgtggctggcacagagtaagcaccagctgcacgccaggaagggtgctgcaggaccaggaaggagcagtgggtaggggctagctcgagagggggtacaagggtgcgactccctccaacctgcaaggggcacactcaactctcgaatcccttcactcaactaccactgcaccatcctgttattaaccagtctgataaatggatcttaagatattcaaacagcatcatgctcaaagtgagaacttcaactttaaacaaacgatggtgaacataagtaacaattttacattgacttttatttaataaaaccacctatttacaattcaaaaaagtcctactttgatacactttactaaataaaattaaaggttaactgtacaagcaattaaaacatgatatgtagcaagtgttatcaggagttttcagcaaactatttaaaatagtcaaaaactgagcagttaaaaagtaccttctgaagtgaatgccgtttctaaatgggatcccaatgcctggcgggagaggcagcctcactctactgtgcaggctggacaaaggtcccggccctgaagtcttagactgtgagagtcaacggcatgtgaagtggagtgtgcagacctctggaggagcagcacgtcaatgtctcatttccagtttacttaaaccacacacagaggcagcctctacacttgccaacagcctctgtgccgaggtgttaagggaccctggccggggactcagaacttagaactttctggcctctgaagaggacccaggaaactggcgagacctcatgtgacccctgaacaggtcatacaagccacttctgaactaagattgggaaggtgttccacactggcatgggatcctgttcagaagcggaatacatcgtagtgctatctggagagactgatgtgaaactgcttcaccaggaacacgcagggctgggcgctgaagacacagaagatccccaggggcaatctgaacacactgcacgaggccctttgccgcgccaccttctgtacgacttaaggaacatctttatgtacagtaagaaaatatatacatctttaaggaacggaacgcccgtaacatgaacaaaaataagtacatctgcgaggacaacagcgcacaggcctcaggcggcccctcccacaggcccagctcagaccagattacattcaacatcttgatgtcaggaaatggctacgtctggaggccaccgggacccccccgtgaagacaggacgcctcctccgagaggaggtgagtcagcatttaaaggccgaggcagaaagtggtctccacgatgctctgcagcctccctggagattcagctgagatgtaggggcagagtccgggaaacgtgacacatgatagtgctgggaaggagggcacggggcagccactggctcagcaacctgctcctgcacctcgaggagcattagcgggtatggcaggcataaaaagtccagagaacgaatgccagctcggctttccttccccagcccctagcccaaggctcctgttacaagctatacagacagagccaaacagccctcaacatcagaaatgagatcagcctgggggcaccccctggggtgggaagtgtggctgagaagggccgtggagtgcagagcaccccaaggcacacatgtacgcatgactaaccaagcccgtgaccgggtccgcagaatgctccccaggaccagcctgccagcggaccgccacgtgggccctgcttccagacactggcctgccctttagactgcgcagctgcaaaacggttcatttctgtgattttggataaccaaagtcctcacacaaagttctacaattagtcaaggaaaagacagaacaaaaaatttgccaacgaccctgggaaagtcagctaaaatggggaggctgatggtccagtatgagcatctgacgagattgtctaggctgttagacgtgtgttgctcgctcctccgtctgtacaacgggtcatgaagcacacgttctaaagtcaaatgtgtgagggactcactggcacttaggatgggtccagctgtgcagggctcaaaggcagagaggagccactgctggcacaaggggccacctcccccacatgtgctgttctgggctgctgccctggcctccactgaacaggcaggtgggagagggcccagccacacatctctttctctacccttttacttacagggggctgattccactctgtgttctctccgcttttaagcctatctctattgccacagggcttcctcgcaaatagctcctcctctcgaactttccacctccgcaggaccgatgccagggagcagtctcccagagcgcagtcccactggagcccacgtgtgcacctgcagcctctacactgtgactgtgtcaaggcaacatggcccagagctcacctgcaggctgggtcgatgcccaggtatccacaaacacacatcagtggccatcctcagagagcccctgttcctttaatgctatctttcgtaggtgagttttagaaacgtgacctccagctctggaaaaactatctcaataactcaatcagcgatccctttcttatcgaaaacatgtaaatatcagccaaagcatctcaagtctcccaaataacatctctcatgcatcctggctaagactgtaacatacttcccagtagttgacatagaaacattacaatttaattagcttttgctgaaataaaggagtgggggtgagccactgcccatcgttcaactgtgcagcagatgcagtggctggctgtggtccgcagcagctcatccttccactgagctgcttaaggctaagccttggtttaattctttaaaagtttttgtgtttgttttgtttaaggccaactccagtgttaggaatcaaacttaaagagcgtctgttcttctcggctggacggacttcccttctccatttcccggctgtctttctgcaatgcagtcagtacctagaagtcacagggaagacagctgaggttaagtgaccacgcacacagatcctgacagcagcgaagcagagacagcagtagcctcctaacagggtcccccggctccccacttccactgcctccaaccctccagggtcttccactcctacgtccttcgtggtctttccaacatggacacctgcccgtgccctctctggcctggtgagctagctgcactccttccagccggccacagaatccacgtcaaagcacagctgggggcctcactggggtcctgcagtggccacccaggaagcccaggcctgaacgctaggatgctaataagccctgtgcccatcccgctgcactcctgccaccctgttcctcctccaccaggaagcctgccacctgagaaggcctcaaggcactggttcctcttgcctgccttcctgagctcacccagagcctgctccctcctctgttctcacagttcttggtcaacatccttctttttcttctttttgagatggagtctcgctctgtcacccaggctggagtggagtggcgccatctcggctcactgtaatctctgacccccgggttcaagagattcttctgcctcagcctcctgagtagctgggaatacagaggtg

SEQ ID NO: 2185 - DNA, 12274 bp, Homo sapiens; identical to SEQ ID NO: 2184

SEQ ID NO: 2186 - DNA, 12274 bp, Homo sapiens; identical to SEQ ID NO: 2184

SEQ ID NO: 2187 - DNA, 12274 bp, Homo sapiens; identical to SEQ ID NO: 2184

SEQ ID NO: 2188 - DNA, 1647 bp, Homo sapiens
gtgaagcacaacatttcatctctttgattctagacactatcctcagaaattagatttgaaaaatgagcttcattttcgaagaacatattgaatttgttatctcgattatggagggcgacaagtcccacagtctgccatctgcaggatggagaaccagtctttatagggggagaataattgactccattcaagtgttcgctcctgtttcaatcaactatggctgaagagtgaggagacatttggaataaatatggcttctgggggcccattcctatggatcagcagctggcttctggaggcccattcctgtgaatcgtcgatctcatagaagataatattgttagaaggcttacctcattgatgctgaacatcctaaaaagcttctgctgctttgagtcactgaaaaagaccaagaaacatgaatttaaaaaaaaatttcaaatgttataaaataaataatatgaactcattatacctacaatgaataatttaaattcttctttggtagtccagcataggtttagaaactatgaaaaccctagaagaaaacctaggcaatgccattcaggacataggcacggacaaagatttcatgacgaagacgccaaaaacaactgcaacaaaagcaaaaattgacagatgggatctcattaaactaaagagcttccatacagcaaaagaagctaccatgagagtgaacagacaacctatagaaagggagaaaaattttgcaatctgttcatctgacaaaggtctaatatccagcatctacaaggaacttaaataaatttacaagaaaaaaacaaacccattagaaaatgggcaaaggacatgaaaagatacttctcaaaagacatacatgtggccaacaatcatacaaaaaaaacctcaacatcactgatgattagaaaaatgctaatcaaaaccacaacgagataccatctcatacctgtcagaatggctattaataaaaagttaaaaaacaacagatgctggtgaggttgttgagaaaaaggaatactgttatactgttggtgggaatgtaaattagttcaaccattgtgggagacagtgtggcatttcctcaaagacctagaggcagaaataccatttgactcagcaatcacgttactggatatatacccaaaggaatataaatcattctattataaagatacatgcatgcgcatgttcactgcagcattattcacaatagcaaagacatggaatcaacccaaatgcccatcaataacacactagataaagaaaatgtggtatatatacaccatggaatactattcagccataaaaaggaatgaaatcaagtcctttgcaggaacatgaatgaagctgaaggccatcatcttcagcaaactaacacaggaacagaaaataaaataccacatattctcacttacaactgggagctgaatgatgagaacatatggacacatataggggcacaacacacactggggcctgttggagggtgctggggggaggaggcagagcatcaggaagaatagctaatggattctgggcttaatacctaagtgatgagatgatctgtgcagcaaactaccatagtacatgtttacctatgtaacaaacctgtacgtcctgcacatgtacccctgaacattaaaa

SEQ ID NO: 2189 - DNA, 7257 bp, Homo sapiens
ctcatgattttgtagagtatacaagaagaatggcaccagcatctgcttctggtgagggcctccggctccttccactcatggtggaaggcaaaggggagctgttgtttgcagagatcacaaagtgagagaggaagcaatagagagggggacatacgaggctcttttcaacaaccagttctcttgggaactaacagagtgagaacttattcattctctccactccagagcattaatctattcagagggatctgcctccatgacccaagcacctcccattcaaccctaattctgacactggggatcacatttcaacatgagatttgaaggggacaaacattcaaactatagcacttgggattccaggctactggacagtttctgagataataatacaattatcttttttctctacttttacccctagcccctcaagttgcccagattaaaaaaatattctggagctgccataccatgttgattaccacccataatttgatttagagaacctaggctcacttaaaatgaccacctttggttaataataaaaatactagataaaattcactgaacatttatcatgctctaggaacattatgtacatattattacttaatcctccccttgtgagacagttgaatcttgtgagaaattattacagagaggagacagaggctcagacacatgctcaagatcacgtatacagtaaatgaagaacctgggatgtaatcgtcctctaatttaagagaatgaattttaattcctgcatactacctcttgttaccttccttttcctacttcttgttatcttatctctttcttttattttttgcccaaaattaaaacagaggaattacttctattgagttaaaagaagtgttacagattatcatgagatctagaatctaaatccttttattaatcttttttagattaattttattgaatataaattacatgaaataatatatcacattttaagcataacagtcaagctgtttttgaaaaatgtatatgtagcaggatgagccacagacaaaacctctcagacaccaagttgtagaaggaagggctttattcagctgggagcatcggcacactactgccttaaaatccaagctccccaagtgcacaatttctgtcccttttaagggctcacaacactaaagatttcacatgaaagggttgtgattgatttgagcaagcaggaggtatgtgacaggggctgcatgcaccagtggtcagagagaaacagaacagggcagggagtttcacagtgttcttctatacaatgtctggaatctatgaataacatcagtttctaagttatgagttgatttttaactactgggtttaggccaggcaggcccagacctggtttcgggcctggcgtcaggctgcctgtctttggttttacttccttgttgttttttcttaaaacaggtactgagtataaaacaatataaaacagtacgagagggtctctctcttccctcatttacatctgtgtaaccactatcctaatcaacatatagaatattttatcaccttttaagttcctatgtgacttactgttgtcaatgtccttcttccattcccaatacctggaaactactgatctgatttttgtcaccatcgatcagatttgcttttttctaaaatttcgtatgtatacaattatatggtaggtattcttttgtgtctagcttatttctttcagaataatgctttaaaatttatccatattggtgaaagaatcagtactttatttcttttggttgctaagtactattcagttttatgacttgtgatattatgaagtatatattcaatctttgaccccttttcctgacatacgactcctaaaatacttagaaactctgaagcgatgtcttatctttgttaatgattgactgaacggatggctggcagcccctgggtaacttcaggatgggggatgggagagacaaaggcatgattagagagttgggactttcagctccatccccaatatctgggaaggggagagagtctgaaggttgactaccaatggccaatgatttaatcaattatgcctgtttaatgaatcttccataaaaacctaaaaggactaggttcagagagcttccagatagctgaacacatggaggttccttgagagcggtgtgccccaagacagtgaggacgctctgcacccctttcccccataccttgccctttgcatctcttcatccttatgctttgtaatatatgtatgcctttataataaactagtaaatgtaagtaagtgtttctctgagttctatgagatgttctagcaaattaattattaattgaactcaaatggggggtcatgggaatctcaatctggaaagaaaaataaaatctgaaaaccacaaagttattatgccaaggggaaaattaaggttggaaacggagtcacacaaaacactgccttccttctgttcccaaacaggcatatcctcgactggcaaaataaacctctaatcaatagagatctgcctcagtcactttttggtttacatgttggtgaccacgaagggactctgagtggagtctggctcttggcctccagcaggtctcctattggggccctggtaccggctggagctctttattactcttacagattggatgatttgctatgtaagttctgggaacttctccctccagagatccctgatctcccccaaattttcaattgggatctgaggtttattctgctgtaaaactccttttctggtagtttctgcttccatgatggcagacagcagtcttcagcttgggtccatctccaggtaaggagctggtttcatattgggatttggtagctgaagggcaaggtttattgtcagttggctataacttacccttatgctgagagatcgcaattatatgtgaattctgtgatcactttttctggtttttcttttcagttttggtccaccttctgttagactttaccaactcctggccccctctaatgttgaatgaaactctgcagctggagaaagtcaattttcacttctaaaaaccctggctgggtaagaaaggtcaacaatttgactacctgagaagtttcatttacacaacgagacccttttcccatcctttctttcggtgcaattaatttaaagattttagggatctcttattctaaactattaacaaagagatcacatttaaaaaggacatataatagtgtcatggccagccttaaaaattctcttgactaaattaagagtgaaaaatctgacctaaaccagttctggtaggtaaaattcctgcagaggcttgggtttgctttctggtcaaggaaaaacaaaggccactccacctgtggcctaatagttaaaattctgcactttcacatccacagggtgagtctgattactggtcagggatccagcccctctcggtttaatatttgtgtgacttttttgttgggtatcaatttattattgatctttatgattgatctttcccacttccatagctttttgtttcctgtcttttttcatctgttgggggcacatgaggctttggggcctttgtgtgcatatggtcagctgagaaggtaagactctaaacacatggcctgacagaaatatgggttataccccatttattggtaatgaaactttccttcgctgagcgatctttggggtgattctggatcttgttaaaaaatgcttgccaactctttggagacagcttgtgtacccacggttatataataaccttgattaaggcacctgggggtatatcttttggtaaagaagttcaaaagtcagaaatatcaactgtttgtctcagctaaaatctgataataagagatttgacaggatttatttaaagggctccatagtcaaaagttgacttaattaaaactgatatttaggctatgtatgtatttacttactgctttaaggcctctgttctctctctctctgtaaacatttctcaggcaactgaatttcttcttaaaccgctgctaggaatgtgcactccctctgtctctctctttctatcgccctttccttcctcttgccaccctcagtaccacataagaagacaaaaacaaacaaacaaacaacaacaacaaaaaattctaacagcctgggattccttaagaaaaaacagaaaatgtgccacagacccatttatgggagaaactgctatttttttcctcagggaatcccaagagttgaaaatggacagtgtcttctcagatctaaaactcttctctcctttgcattgcactaccagaaatttttgcttctggagttactagaaatttctttttattgtgaaaagcttgcctttggtgtgtataatggctaaggaatgggctgatcgcagagtgggctgattggcaatgggttgcccaccagcctcaggggaaatgtatttgcagtgaaatgtacagtgaaaacatggcgtgtcctaatccccatggtgtttacctcttttgggggacccaagatttagtgtgagttatgctttgaattcaatggtccagataaaaaagagactaaattaaaagcacctatctaaatgaaattggtcaccttataaaagcccgtgataaatttatataattttgtgttacttggcatccatgttttcaatcttcctctaacacaaccaaatttaaagagcttaaattccctgtctctgtctgtattttgagatgcaaatcctttatcttgtttcacctgagagttatcacttcagaaatgcaaatttagggtcgcctaacagttgcctagagcaataaaataggtaattgaaactgtgaataaaaacaactacttaaatttggtaaataaaaaatcatatagttctacaagatctgcttctgtctgtgtgtctgtgtgtctagtgtctatatatttatatgtgttatgtgtatgtgatgtttcacaaccaaaatatgtgaaagagttctaattaattggcttaaaaagtaaacacttaaatattttatgagaaaaatagaaaccttaactcaaacacctttaagttcatgtgactttagtaatctttaacaaataaagacaatttaaaaattattggtgaaataaaataaaatagaaacctcttccaaatttaatttagacactttgtctgtctattggcctattgttcagatattatctctgctagatgttttaagatcataaaatgtgtttttatgacaatttttgacacttaacttgtctataaactatgtttttggatttgggcctttaggagattgtgaagcctagctccagggattgtcctttgtcttggactctgtatctggtgcttaattagaattacttacttcctcagtttttcactaagaataagagttactaagaagtaacattacagtttatgtatataattatactagctatggccgggcacagtggctcacacctgtaatcccattactttgggaggctgaggcggccggatcaccttaggtcaggagttcaagaccagcctggccaacatggtgaaaccccatctctactaaaaatacaaaaaattagccaagtttggtagtgtgtgcctgtaatcccagctgcttgggaggctgaggcacgagaattgcttgaacccaggaggcgggggttgcagtgagctgagattgcatcactgcattccagcctgggcgacaagaacgaaactccatctcaaaaacaaaacaagacaaaacaaaacaacaaactactagctataagagaaacagttatatatgcaaagtgtataaagttgttttgtgtttttgataaaaagcttctaagaaggcatgggaatctggtttctgttaaagagaaagtaatttttcccagcatggagatctttttaaattaattttttaaaattaagtttttaaaaagttaattttaaagttttctgagtaaaaaaaatgatggataaaactcaatgaatatagaaagttgaaaaattaaatttttgttctagggtagactgataggacaagactaaagatttaagcaagttgtagaatgtttgtggaagactgatcttgtggaaggaattctgtgtgtgattattttgtttgttttttctttctttttctttttctttttttcttttttttttttttttgggacagggtctcactctgtcacccaggctggagtgcagtggcgtgatctcggctcactgcaaactccaccacccaggttcaagtgagtctcatgcctcaatctctcaagtagctgggattacaggtgtgtgtcaccacacctggctaatttttatatttttagtagagttaggctttcgccatgttggccaagctggtcttgaactcctggcctcaagtgatccacccgcctcagccttccaaagtgctgggattatagacgtgagccaccacacctggccattctcaattcttatcaacatatgactcaattaaaacttgttgagtgtttcctacatgcagtgttgtgctgggttgatatgaaaggaacaattgaggaaggatcttgaccattgggcaaactggtaagataactcagggtcccttgggcaaagctggaaatcaatcagaataaacctcaatgagaagagaaggcaaggcaaatataaaattgaagtacttctaaatgccatttccccaaaacagatatttaaaaccttggaaaaaataatgctagtgacctttccagataggtaacaagattaacaatctaaatacctaccgtgtacaatcctcacgtccaagaaagaaccagacaatttttttttttttttttttttgctgtcctattgtcaagctgtgggtacctaggagaagaaagagaggttacttttcactttcagataggaatgcagagatccaaaaggagtttatatgtatagcttcagtcaaataggaattcactccagtttttgaaactgaaatctatgtaattttctctgaatctaagttatctatcatataataccaacaaagcaattaaataattatcaagaaaacaatgccaaattagatatggtcttaaggccatggcttgctttttgtgttatgtgttgaagcaaatgaatttccttcaggtttctcttttatcatggatgaaccttctggtaagttccccatactcctgtggtgggcatctgtgctaggggagcatctgcggctcagctttaggtttgagtacaggtcttggaggcctgggtatcactgtgtctctgtgccgcagaagtagg

SEQ ID NO: 2190 - DNA, 7257 bp, Homo sapiens; identical to SEQ ID NO: 2189

SEQ ID NO: 2191 - DNA, 6805 bp, Homo sapiens
ctcatgattttgtagagtatacaagaagaatggcaccagcatctgcttctggtgagggcctccggctccttccactcatggtggaaggcaaaggggagctgttgtttgcagagatcacaaagtgagagaggaagcaatagagagggggacatacgaggctcttttcaacaaccagttctcttgggaactaacagagtgagaacttattcattctctccactccagagcattaatctattcagagggatctgcctccatgacccaagcacctcccattcaaccctaattctgacactggggatcacatttcaacatgagatttgaaggggacaaacattcaaactatagcacttgggattccaggctactggacagtttctgagataataatacaattatcttttttctctacttttacccctagcccctcaagttgcccagattaaaaaaatattctggagctgccataccatgttgattaccacccataatttgatttagagaacctaggctcacttaaaatgaccacctttggttaataataaaaatactagataaaattcactgaacatttatcatgctctaggaacattatgtacatattattacttaatcctccccttgtgagacagttgaatcttgtgagaaattattacagagaggagacagaggctcagacacatgctcaagatcacgtatacagtaaatgaagaacctgggatgtaatcgtcctctaatttaagagaatgaattttaattcctgcatactacctcttgttaccttccttttcctacttcttgttatcttatctctttcttttattttttgcccaaaattaaaacagaggaattacttctattgagttaaaagaagtgttacagattatcatgagatctagaatctaaatccttttattaatcttttttagattaattttattgaatataaattacatgaaataatatatcacattttaagcataacagtcaagctgtttttgaaaaatgtatatgtagcaggatgagccacagacaaaacctctcagacaccaagttgtagaaggaagggctttattcagctgggagcatcggcacactactgccttaaaatccaagctccccaagtgcacaatttctgtcccttttaagggctcacaacactaaagatttcacatgaaagggttgtgattgatttgagcaagcaggaggtatgtgacaggggctgcatgcaccagtggtcagagagaaacagaacagggcagggagtttcacagtgttcttctatacaatgtctggaatctatgaataacatcagtttctaagttatgagttgatttttaactactgggtttaggccaggcaggcccagacctggtttcgggcctggcgtcaggctgcctgtctttggttttacttccttgttgttttttcttaaaacaggtactgagtataaaacaatataaaacagtacgagagggtctctctcttccctcatttacatctgtgtaaccactatcctaatcaacatatagaatattttatcaccttttaagttcctatgtgacttactgttgtcaatgtccttcttccattcccaatacctggaaactactgatctgatttttgtcaccatcgatcagatttgcttttttctaaaatttcgtatgtatacaattatatggtaggtattcttttgtgtctagcttatttctttcagaataatgctttaaaatttatccatattggtgaaagaatcagtactttatttcttttggttgctaagtactattcagttttatgacttgtgatattatgaagtatatattcaatctttgaccccttttcctgacatacgactcctaaaatacttagaaactctgaagcgatgtcttatctttgttaatgattgactgaacggatggctggcagcccctgggtaacttcaggatgggggatgggagagacaaaggcatgattagagagttgggactttcagctccatccccaatatctgggaaggggagagagtctgaaggttgactaccaatggccaatgatttaatcaattatgcctgtttaatgaatcttccataaaaacctaaaaggactaggttcagagagcttccagatagctgaacacatggaggttccttgagagcggtgtgccccaagacagtgaggacgctctgcacccctttcccccataccttgccctttgcatctcttcatccttatgctttgtaatatatgtatgcctttataataaactagtaaatgtaagtaagtgtttctctgagttctatgagatgttctagcaaattaattattaattgaactcaaatggggggtcatgggaatctcaatctggaaagaaaaataaaatctgaaaaccacaaagttattatgccaaggggaaaattaaggttggaaacggagtcacacaaaacactgccttccttctgttcccaaacaggcatatcctcgactggcaaaataaacctctaatcaatagagatctgcctcagtcactttttggtttacatgttggtgaccacgaagggactctgagtggagtctggctcttggcctccagcaggtctcctattggggccctggtaccggctggagctctttattactcttacagattggatgatttgctatgtaagttctgggaacttctccctccagagatccctgatctcccccaaattttcaattgggatctgaggtttattctgctgtaaaactccttttctggtagtttctgcttccatgatggcagacagcagtcttcagcttgggtccatctccaggtaaggagctggtttcatattgggatttggtagctgaagggcaaggtttattgtcagttggctataacttacccttatgctgagagatcgcaattatatgtgaattctgtgatcactttttctggtttttcttttcagttttggtccaccttctgttagactttaccaactcctggccccctctaatgttgaatgaaactctgcagctggagaaagtcaattttcacttctaaaaaccctggctggctttttgtttcctgtcttttttcatctgttgggggcacatgaggctttggggcctttgtgtgcatatggtcagctgagaaggtaagactctaaacacatggcctgacagaaatatgggttataccccatttattggtaatgaaactttccttcgctgagcgatctttggggtgattctggatcttgttaaaaaatgcttgccaactctttggagacagcttgtgtacccacggttatataataaccttgattaaggcacctgggggtatatcttttggtaaagaagttcaaaagtcagaaatatcaactgtttgtctcagctaaaatctgataataagagatttgacaggatttatttaaagggctccatagtcaaaagttgacttaattaaaactgatatttaggctatgtatgtatttacttactgctttaaggcctctgttctctctctctctgtaaacatttctcaggcaactgaatttcttcttaaaccgctgctaggaatgtgcactccctctgtctctctctttctatcgccctttccttcctcttgccaccctcagtaccacataagaagacaaaaacaaacaaacaaacaacaacaacaaaaaattctaacagcctgggattccttaagaaaaaacagaaaatgtgccacagacccatttatgggagaaactgctatttttttcctcagggaatcccaagagttgaaaatggacagtgtcttctcagatctaaaactcttctctcctttgcattgcactaccagaaatttttgcttctggagttactagaaatttctttttattgtgaaaagcttgcctttggtgtgtataatggctaaggaatgggctgatcgcagagtgggctgattggcaatgggttgcccaccagcctcaggggaaatgtatttgcagtgaaatgtacagtgaaaacatggcgtgtcctaatccccatggtgtttacctcttttgggggacccaagatttagtgtgagttatgctttgaattcaatggtccagataaaaaagagactaaattaaaagcacctatctaaatgaaattggtcaccttataaaagcccgtgataaatttatataattttgtgttacttggcatccatgttttcaatcttcctctaacacaaccaaatttaaagagcttaaattccctgtctctgtctgtattttgagatgcaaatcctttatcttgtttcacctgagagttatcacttcagaaatgcaaatttagggtcgcctaacagttgcctagagcaataaaataggtaattgaaactgtgaataaaaacaactacttaaatttggtaaataaaaaatcatatagttctacaagatctgcttctgtctgtgtgtctgtgtgtctagtgtctatatatttatatgtgttatgtgtatgtgatgtttcacaaccaaaatatgtgaaagagttctaattaattggcttaaaaagtaaacacttaaatattttatgagaaaaatagaaaccttaactcaaacacctttaagttcatgtgactttagtaatctttaacaaataaagacaatttaaaaattattggtgaaataaaataaaatagaaacctcttccaaatttaatttagacactttgtctgtctattggcctattgttcagatattatctctgctagatgttttaagatcataaaatgtgtttttatgacaatttttgacacttaacttgtctataaactatgtttttggatttgggcctttaggagattgtgaagcctagctccagggattgtcctttgtcttggactctgtatctggtgcttaattagaattacttacttcctcagtttttcactaagaataagagttactaagaagtaacattacagtttatgtatataattatactagctatggccgggcacagtggctcacacctgtaatcccattactttgggaggctgaggcggccggatcaccttaggtcaggagttcaagaccagcctggccaacatggtgaaaccccatctctactaaaaatacaaaaaattagccaagtttggtagtgtgtgcctgtaatcccagctgcttgggaggctgaggcacgagaattgcttgaacccaggaggcgggggttgcagtgagctgagattgcatcactgcattccagcctgggcgacaagaacgaaactccatctcaaaaacaaaacaagacaaaacaaaacaacaaactactagctataagagaaacagttatatatgcaaagtgtataaagttgttttgtgtttttgataaaaagcttctaagaaggcatgggaatctggtttctgttaaagagaaagtaatttttcccagcatggagatctttttaaattaattttttaaaattaagtttttaaaaagttaattttaaagttttctgagtaaaaaaaatgatggataaaactcaatgaatatagaaagttgaaaaattaaatttttgttctagggtagactgataggacaagactaaagatttaagcaagttgtagaatgtttgtggaagactgatcttgtggaaggaattctgtgtgtgattattttgtttgttttttctttctttttctttttctttttttcttttttttttttttttgggacagggtctcactctgtcacccaggctggagtgcagtggcgtgatctcggctcactgcaaactccaccacccaggttcaagtgagtctcatgcctcaatctctcaagtagctgggattacaggtgtgtgtcaccacacctggctaatttttatatttttagtagagttaggctttcgccatgttggccaagctggtcttgaactcctggcctcaagtgatccacccgcctcagccttccaaagtgctgggattatagacgtgagccaccacacctggccattctcaattcttatcaacatatgactcaattaaaacttgttgagtgtttcctacatgcagtgttgtgctgggttgatatgaaaggaacaattgaggaaggatcttgaccattgggcaaactggtaagataactcagggtcccttgggcaaagctggaaatcaatcagaataaacctcaatgagaagagaaggcaaggcaaatataaaattgaagtacttctaaatgccatttccccaaaacagatatttaaaaccttggaaaaaataatgctagtgacctttccagataggtaacaagattaacaatctaaatacctaccgtgtacaatcctcacgtccaagaaagaaccagacaatttttttttttttttttttttgctgtcctattgtcaagctgtgggtacctaggagaagaaagagaggttacttttcactttcagataggaatgcagagatccaaaaggagtttatatgtatagcttcagtcaaataggaattcactccagtttttgaaactgaaatctatgtaattttctctgaatctaagttatctatcatataataccaacaaagcaattaaataattatcaagaaaacaatgccaaattagatatggtcttaaggccatggcttgctttttgtgttatgtgttgaagcaaatgaatttccttcaggtttctcttttatcatggatgaaccttctggtaagttccccatactcctgtggtgggcatctgtgctaggggagcatctgcggctcagctttaggtttgagtacaggtcttggaggcctgggtatcactgtgtctctgtgccgcagaagtagg

SEQ ID NO: 2192 - DNA, 2039 bp, Homo sapiens
cagcagaccggggaggcgcctggagcctgcagtaactcaagatggccgactgatcgccagagagtatttgaggacatggttacagttacgttcccaggggaacaacctttggcctcttaagacatctacttgctttcagttttgaaagaactcaggcagccatggggtatttttcagaattcccggcggtgaagggtcagagccatgggcattagggagaaagctgaaggcacagcggagtgccaaagtctcccgtgatgtatcctgtgtccacatcccaacaaccccatcggcaggactctttcctggtttgcccacaaggaggaaagtgaggaaagtgaggcgtcagagagatgaagcaacttgtttgaaggcggccacacagctggccctgaggatatccagaccctagaggaccaatgacaggcagacaggcccaagatgggaaacccagaagcactctgagatgtcctagacgctgagatgtcctgcctgagacctccaggattaactgaaggccagcagctagtgctcctgagcccagtcataagtgacagtctatgagggcaaactgatccccacttcttttcactccttaagcttctactgaagcctccagcagactcttgggccccaaagctgctgcgtcccctagaaacacctaaaaggatgctcctggctgcaaagcgccctgagcctataaccacaggaactgctccatcagtatccagtgtgcctgcttattgcctggttacctgcccggcttgtccttgtgcagatgcagtggatgccagaacaccctacagctggagagaggcggggaaaccctcaggtgcttgtgcctacgagcactgccccagcctggcagcaccagggatgggagaggaaggaaagccccaggaatgcctgtggggtgtgacagcagcccctgagtgaagagctgtgcccaaccccagctaagccctcaggacccaggacaaggggccttcttctacataggagagtggcctcatcagcatcccacatagagggaggcagacaggccctgcaaaccttcctctaaacttcacgcatctcctcggaagtccctataataatgacaagtaggtttattgagcactaatgggctgggtgcttggctaagtggtttatgtcagcatctcatttaattctccgaagaaccttgtatgctagtattatggggagcctgtctagtgggtcagaaaatatgaccgacaataaaaatttgaagacaataacaacaataataacattaacaaaggaaacaatgcttcccagagatctaaggaagggaaattaatgtctgatgaagggatgattaaagtgacgatggagaaagggatttcacaggaaatacgaagatacgaaagtaattcttcagagaagatctccaccaagaacactcaacccacattcaggcagaatatgcaaggaggcaaactgttgtggactacgcgatctccacatggaagatgtcacatcaaaaaataaaaataggccgggcgcggtggctcacgcctgtatttccagcactttatgaagccgaggcgagtggatcacctgaggtcaggagtttgagaccagcctggctaacatggtgaaaccccatctctgttaaaaacacaaaattagccaggtgtggtggcacatgtctgcaatcccagctactcgggaggctgagacaggagaattgcttgaacccaggaggcagaggctgcagtaagccgagatcgtgccactgcactccagcctgggtaagacagagcgagactctgtcaataataataataataataataataataataataaataaacaaacaaaaactctggttcctggcggcttctcttgaaatatcagaatggtaccacggcaccctccttctgatgtgggaacagttggttggagccaagaagctacagctttttagactgagtgtgcatgctctggtcaacacagtccccaccaccccctaatgcctttcacttggcccttcctctcatctccactaactgcc

SEQ ID NO: 2193 - DNA, 3058 bp, Homo sapiens
gtatatggaacactccttgcatcaaagctggcacgtgtgaagaggcgggaagggactcttccataactgagacaccattacctcagagaaaaattaaacagattatcaccaaaaacgggggtggggggaggacatacctaccagtggtcaagtgccaaggcatccctgctcttctagagctggttatcctcaggaagagattactacacgccctcagggcagaagctgacccccctccccgaggtggacttgcaggcaagagcaacacttttaaggcaggtcacactggtggtttctccctaccctggttaagacccccactacctctactcccatctcctctcccttccccatagcaaagcatagtctgcattttctagtcccctcaagtcaaggcaggccaggggctccaagggcaggcccacctctttcttctaagattttttgtgtgtgtgtgacggagtctcactctgtcgcccaggctggagtgcagtggcgcgatcttggctcactgcaacctctgccttccgggttcaagcaattctcctgcctcagcctaccaagtagctggcatgcgccaccatggcgggccaatttttttttttgtatttttatttattattatttagttttaattttttaattataattttttttttttttttgatacagagtctcgctctgtcgccaggctggagtacagtggtgtgatctcagctcaccgaaagctccgcctcccgggttcaagcaattctcctgtctcagcctcccaagtagctgggactacaggtgcccgccacaatgcccggctaatttttatatttttagtagagacagggtttcaccatgttggccaggctggtctcaaactcgtgacctcaggtgttccacccaccttggcctcccaaagtgctggaattacagacataaggcaccacacccagaccaaatctcctaaattcttaaatataataaaccaaccaacagaaccataattttaccaaggatctcatggctttctcataccttttctggaatgaagttgagactatttccctctagccttttttttttttccccgagacagagtcttgctctgtcacccaggctggagtgcagtggcttcatctcggctcactgcaacctctgcctcccgggttcaagcaattctcctgcctcagcctcccaagtagctgggattacaggcacgtgccaccacgcccagctaatttttatatttttaataaagatggggtttcaccatgttggccaagctggtctcaaactcctgacctcgtgatccgcccgccttggcctcccaaagtgctgggattacaggcatgagccaccgcgaccggcccctctagccttttaaaaactagaatttgatcaccataaaatctgtactttgcttaacctattttcctgaactccattcttacacctattacctgaactaggcctaccactaagcacaggtactgatagctcattgccagacaacagaaagcaagcaggttgcagggctgctccacctgctgtcagctgtgggaatttcacaaccacatcagaaaccagaatttctcagtcttttaaaagcctggccctttgatgccatgacaatacatactaccaaatccaggccttctattgatctgtattcttttttttttttgaggtggagtctcgctctgtcgcccaggctggagtgcagtggtgccatctcggctgactgcaagctctgcctcccgggttcacgccattctcctgcctcagcctcctgagtagctgggactacaggtgcctgccaccacgcccggctaatttttttgtatttgttttttagtagagatggggtttcactgtgttagccaggatgttctcgatctccttgccttggcctcccaaagtgctgggattacaggagtgagccactgtgcctggccttttttttttttttttttttttttagacagtctcgctctgtcgtgcccaggctggagtgcagtggcgcgatctcagcttactgcaacctctgccttctgggttgaagctattcccctgcctcagcctccagagtagctgggattacaggcacctaccaccaggcctggctaattttttgtatattttagtagaggtggggtttcaccatgttggtcaggctggtctcaaactcctgactgcaggtgatccgccccctcggcctcccaaagtgctgggattacaggcatgagccaccacgcctggcctgtttaagacagggtcttgctctgtcacccaggctggagtgcagtggtgtgatcacagctttctgcagcacctacccccaggcccaagcaatcctcctagctcagcctcccaagtagctgggattacaggtgtgcagcaccacgcccagctaatttttattttttatttttgtaggaagagatctccctgttgtccaggctggtcatgaactcccagggctcaagcagttctccagtctcagcctcctgaagtgctgggattataggcatgagccaccacgccaggcccctaactcattttaaatggctgtgtaatgtggatgatgacagcacctacctcaaggggctgctgtgaggactaaatggggcagaaaaattctgcctgacctttcccatcttcctgatgatgttaacaaacgacagccactgagggcacaggagggggctctacacaggccaagagctacaggctacagtctgagcacagaaaaccctccagctccagcatccagggccacagctggacacaagtacagaacctggcagccctgcagcccagacaatgcccagggtgtgatttagggtgcagagctgcaactcagatcctgtgccatggcagtatcacaggaaggacttgacggagaggtgaaggctccagacgccaggatatttattccctgtgccaatacagcattcacacctgacctccaggtcctgcagcagtctctcccttgctggggacaacacaggaagagacaaaacctgaggaaggaaaaagggaacctgcaaccagccatggacctcat

SEQ ID NO: 2194 - DNA, 1319 bp, Homo sapiens
gtacgacccgtcgtcgccctcgcccaccacatcgatgtccacgtcctcggccgtcagcaccgtctggccggacatgtcgctggcgctgccgccgccggagagggtcatccctcctcgggatccagcgggaggcggggccacgtgaccgtgcgtgacgtcagggccgcggccgagccggccaaactcaagttggttcagggaattgtcaacaaagggacgagagacgcgcaactccgctccgcactgtgcgccagcatccccggggcacggagggcgctgcggcccgcccggagacccccccacccaggctggatccgggccctggggcccagggagcggctttaaagagtaagagcagcgcacccggctccctcctgctaattagatttcagattcccctctggcctcagtgctcattccggggaagacacctgctgagatgtctttttccccctcccccaaccaaaccactcaggtcctacctgctctttcccggcttgatgcgggcgtgttttcctgtatgtattttttcgtgcggccacaaaaagcatcagctggggttcccgaaggtcagaaaatggctattgattaatctactagaatagttgccgagagaaataaaaacgacgtaaaatagcagggaacctataaataaagaagccataactggctacttggagttgttaaacgacttagcatatgaaaaaatcggaaatgaggcgctggggaaggagctgggattggcagcggcctgggtaagtcgagtggatccgggaagaggcctggtgtcttcaggtgtggacaaatcctccaagatttaacttccaagaaaaccggcggcggagcgggtggaggaggcgaggatgtgtggccaatgcacgcggagtgcaaggccgcctagttgggagccgcaagagcctgcctggtgtggcaggcacacggaacccaatccctgtctgtccgctgcggcctgggaggggagcgccggcctcaccagaggaaggagcacgaggggaggagttccgagaggaaataattagtgaaatatttgcagaagatgctgggatgtggatttaattccggatggacagtggtgcttctgattccctcagtctgtttccccacccacgatctcctctttccttggcctagacacaccaaaaataattcaataaaataaaaataaaaatttaaaaatctgtaaacttgcttcattacaggcattgagacacacagattgactttcatccccattagacagtttcccaggatataacactactcatctgaggctgggagcagggtagggggtggtgaca

SEQ ID NO: 2195 - DNA, 750 bp, Homo sapiens
gtacgaatccagcgggaggcggggccacgtgaccgtgcgtgacgtcagggccgcggccgagccggccaaactcaagttggttcagggaattgtcaacaaagggacgagagacgcgcaactccgctccgcactgtgcgccagcatccccggggcacggagggcgctgcggcccgcccggagacccccccacccaggctggatccgggccctggggcccagggagcgggtgtggacaaatcctccaagatttaacttccaagaaaaccggcggcggagcgggtggaggaggcgaggatgtgtggccaatgcacgcggagtgcaaggccgcctagttgggagccgcaagagcctgcctggtgtggcaggcacacggaacccaatccctgtctgtccgctgcggcctgggaggggagcgccggcctcaccagaggaaggagcacgaggggaggagttccgagaggaaataattagtgaaatatttgcagaagatgctgggatgtggatttaattccggatggacagtggtgcttctgattccctcagtctgtttccccacccacgatctcctctttccttggcctagacacaccaaaaataattcaataaaataaaaataaaaatttaaaaatctgtaaacttgcttcattacaggcattgagacacacagattgactttcatccccattagacagtttcccaggatataacactactcatctgaggctgggagcagggtagggggtggtgaca

SEQ ID NO: 2196 - DNA, 750 bp, Homo sapiens; identical to SEQ ID NO: 2195

SEQ ID NO: 2197 - DNA, 750 bp, Homo sapiens; identical to SEQ ID NO: 2195

SEQ ID NO: 2198 - DNA, 1508 bp, Homo sapiens
cccgtcgtcgccctcgcccaccacatcgatgtccacgtcctcggccgtcagcaccgtctggccggacatgtcgctggcgctgccgccgccggagagggtcatccctcctcgggatccagcgggaggcggggccacgtgaccgtgcgtgacgtcagggccgcggccgagccggccaaactcaagttggttcagggaattgtcaacaaagggacgagagacgcgcaactccgctccgcactgtgcgccagcatccccggggcacggagggcgctgcggcccgcccggagacccccccacccaggctggatccgggccctggggcccagggagcgggtgggtgtgagtgtgggtgggtgtgagcgagtcagggcgtgggcctgggagcgtccgcgggactgtgcgactgtcgctgccctgccttccccgccccctctcccttccgcccttctcccccccactttgtcacactccttagacagggactgggcgacctagaacgaggttcccatatcgtgttttaaaaagcaaaacttagtctctgttttgctttttgtttcattgtttttagctttaaagagtaagagcagcgcacccggctccctcctgctaattagatttcagattcccctctggcctcagtgctcattccggggaagacacctgctgagatgtctttttccccctcccccaaccaaaccactcaggtcctacctgctctttcccggcttgatgcgggcgtgttttcctgtatgtattttttcgtgcggccacaaaaagcatcagctggggttcccgaaggtcagaaaatggctattgattaatctactagaatagttgccgagagaaataaaaacgacgtaaaatagcagggaacctataaataaagaagccataactggctacttggagttgttaaacgacttagcatatgaaaaaatcggaaatgaggcgctggggaaggagctgggattggcagcggcctgggtgtggacaaatcctccaagatttaacttccaagaaaaccggcggcggagcgggtggaggaggcgaggatgtgtggccaatgcacgcggagtgcaaggccgcctagttgggagccgcaagagcctgcctggtgtggcaggcacacggaacccaatccctgtctgtccgctgcggcctgggaggggagcgccggcctcaccagaggaaggagcacgaggggaggagttccgagaggaaataattagtgaaatatttgcagaagatgctgggatgtggatttaattccggatggacagtggtgcttctgattccctcagtctgtttccccacccacgatctcctctttccttggcctagacacaccaaaaataattcaataaaataaaaataaaaatttaaaaatctgtaaacttgcttcattacaggcattgagacacacagattgactttcatccccattagacagtttcccaggatataacactactcatctgaggctgggagcagggtagggggtggtgaca

SEQ ID NO: 2199 - DNA, 1508 bp, Homo sapiens; identical to SEQ ID NO: 2198

SEQ ID NO: 2200 - DNA, 1508 bp, Homo sapiens; identical to SEQ ID NO: 2198

SEQ ID NO: 2201 - DNA, 1024 bp, Homo sapiens
atccagcgggaggcggggccacgtgaccgtgcgtgacgtcagggccgcggccgagccggccaaactcaagttggttcagggaattgtcaacaaagggacgagagacgcgcaactccgctccgcactgtgcgccagcatccccggggcacggagggcgctgcggcccgcccggagacccccccacccaggctggatccgggccctggggcccagggagcgggtcctacctgctctttcccggcttgatgcgggcgtgttttcctgtatgtattttttcgtgcggccacaaaaagcatcagctggggttcccgaaggtcagaaaatggctattgattaatctactagaatagttgccgagagaaataaaaacgacgtaaaatagcagggaacctataaataaagaagccataactggctacttggagttgttaaacgacttagcatatgaaaaaatcggaaatgaggcgctggggaaggagctgggattggcagcggcctgggtgtggacaaatcctccaagatttaacttccaagaaaaccggcggcggagcgggtggaggaggcgaggatgtgtggccaatgcacgcggagtgcaaggccgcctagttgggagccgcaagagcctgcctggtgtggcaggcacacggaacccaatccctgtctgtccgctgcggcctgggaggggagcgccggcctcaccagaggaaggagcacgaggggaggagttccgagaggaaataattagtgaaatatttgcagaagatgctgggatgtggatttaattccggatggacagtggtgcttctgattccctcagtctgtttccccacccacgatctcctctttccttggcctagacacaccaaaaataattcaataaaataaaaataaaaatttaaaaatctgtaaacttgcttcattacaggcattgagacacacagattgactttcatccccattagacagtttcccaggatataacactactcatctgaggctgggagcagggtagggggtggtgaca

SEQ ID NO: 2202 - DNA, 2368 bp, Homo sapiens
tgtttcgatagttttattggaacacgatggtaacacaaacatggatttggggtcccaccacagatgttcctcctccaggcagcatgcaccccacttctgcagccagcagaggctccaggaggcctgcagaaggtggaggcagcccagagacagacgtggaggcgtcttctgcagtggcgggtggtgcgtgggcccctcgggccagagctctgaccagctgagtctgtgaacagccagactggtttgttttcacttgaggtcatgtggccgtgactgagagacctgcctgcctcagactcctgggaaaacttccaaggagggggattctggggattccagaaggaattcagccaagagactaagcacctctggggggatcaccagggcaaatcatgcctttaggtttattggcagatacactgctgaaagcatctgttttggccactctctgcactctcttttctctgatcattcatccaacacatatttattaagctcctaccatgtgacaaactctcctctaggggttagacagacaacggtcaccagaaacagacaggacccacagcctggtgaggaggagagacagacaacgttcaaggaatcacgcaaacagccatgccagtgccttccaaggagagctctgaggggtgtggcagggggcctggtttggtgtggagggtcaaggaagacttcctcaaggaagtgacatttcagggcactaaaatgagcaggaggagcctttcctcacggaaacagctttgagcatggaatgggcagagtgagttaatcaaactaaaaggaaaagaacagcagggccagagtgaagtgacggaggaggcctggcgcagggggaggctggagagggcccagcagggtcccagcacacagggcctgagggctgggctgaagatggttttatctacctgtgtggcatgacctgggttgcatctggcatggcccactctggctgtcaggtagggggtggactgggtgggggcgagagtgctgagaagaggtgttccaactgtcctgatggagacaatggtggtcggatggagtgacacagagtagatggggagaagccagcagacagtggagccagggctccatgaggactgaggcaaacggaggtggcaaggtggaccctcagcctgtgaagcccgggcaggctttggtctgagaaagggacctggggagcagagcaggtgcagggagaaggcaggcacgcagctgcaggcacgcagctgcagacacgctgagggagagcgcctctgaaactcccaggtggaggtgttgcggaggcggcagtgggtctcaagctcccggaaggagccaagcctgcagttataaatctgtgagtgatttcataaccaaacctcgtgccttgtaactggagttgtgggtgcagacgaggtcacaggaggagagatgctgagtgagaagagaggactctggactgagactgaggaacagccacatctgatggcaggtagaggacaatgagttgcaaaagggacagaaaagggagattgagtgtcaggggccagccaggagatgccactgagaagccctgggggtagaagtccctccacagccccctctctctggggctggcactaccctatctctttgagtctctttatggatcctgtaaataggaacagggggcctaccctcttggacaggggaatcaaaagctgcttagagtggtcaggagacgtgcccaaggtcatacggccaccagagagtgctgggggccaactcccccattcacaaccattacagtccctcaagatccatccctccctccatgatgcctggctgcagacactctctccagcaagtccaccgcataccacttcttgatgacaagcaccagagagggtcatactgtagcaggaagggacccccagagcctgggggtctaagccttgctaggaggaaggtggctgagtcaaggaaatatttgccttctctcctgagaggtggtgtagtgcagtgtcagtagtgtgggcttgaggcctggcttttcacccgttctctcattcattcacccattcaacacatatttttgtgtgcctcctatgtgctaggcacactttctaggtgctgagtggccttgggcaggtcccttacttctctgagcctcagtttccatctctgtaaagtcggggtgtgattcttgctctaaactcatgttgctataagggttacgagagctcatgccagggaagcacctggtacacagtaggtgctcatgaaaagctatttccttcctttctctgtcttttcctttcctttccttcatcctgcagaacccatgagggagtgagagaccagagagatggcgacccgaactggggtg

SEQ ID NO: 2203 - DNA, 2368 bp, Homo sapiens; identical to SEQ ID NO: 2202

SEQ ID NO: 2204 - DNA, 2368 bp, Homo sapiens; identical to SEQ ID NO: 2202

SEQ ID NO: 2205 - DNA, 2368 bp, Homo sapiens; identical to SEQ ID NO: 2202

SEQ ID NO: 2206 - DNA, 465 bp, Homo sapiens
tgtaaatctcatacaaaggtagaaagtgcaattcaacccaacacgctggttatggtatatgtgctgtcaatgtacatggtagcaacttgaatcaaaccagagctgctaccacatgtaagcaacctcttatgctgccctgtagtgatgtcaatgttctcagtttactaaattatcaatgtggaagaacgcatttttgagctccagaccttctaaacattttaaacaggctatcgaagaggatgtaacagaaccctatttcagaaacctaaggatcagggaggaaggaacactgaccggtttttctgggatgtttctgtgggggcaacagggatgaacaaaagaaatgttagcatgtcagagcatatgacaagtgaggggagacagagtagattctaaccaaaggaaggcggtgagggttaaatgaaggtaattcagttagtttttaggttggctggggcaagctgc

SEQ ID NO: 2207 - DNA, 2112 bp, Homo sapiens
gctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccgggcaggagtgcagtggctcaatcttgggctcactgcagcctcaacctcccagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggacactgtcatctctcaagtacccatcttggagggtacggaccccacatgaggaaaggaccaaccacaccgagctcagttatggcacacacagtgggacctagacaaagggagagggtgaccgacatcccaactaggtaaacacagaggaggttccacatggacttatctgggtggctgttttgaaaacgagaaacagtcaagagtccctggccccacagacccacctccccaactcagcactgtctgtctgtgcagcaggtgcaaggacgtgttgaactagctctctgcagcctccttggaggatgtgatcctatgggaggggtaggagtattcaggtccttgacatctcccaaatgtgtgattccgggatgccaaaggcctttggccagatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctactgaaaagcctctctgcctctatgttttataccatcggatgccaactcccggccttctaagccacctcccctttaggctaaaactgagacatgaacttgaaaaattgacactggcttcctctctctttagggtccccaggcaggtggctgggacactatttgcaatcagcaaggaaccctgctgcccttagactccccacagagcaagcagaacttgcagaatggggtaaaaacactctattaaagattttttaaacctatttatattgtaataaagtaaatgtaaataaaatttaagtgaaggcagattgcagatatttccgatgctatacaagatatatctcatagtatgggtgtagattctgcaaaggttaatgcagttaaacatatttgacacataaaaatgtcagatccaacattaatcattcaccaattgtaattgcctttctatgggtctcttctccccaagacatagcttaaaacaccaggctcggtagaaatctgggaggaaaaaagcaaataatacctctcagctgtcagggtctatgatacgctttgatagatttagcactgatttcattctctttacaattcagtgtgattgggtgtgcgtgtgtgtgtgtgtgtgtgtgtgtgtgtgtgtgtgtgttactccatgtttctcctttttaaggaaggagaaggtgtggaacaagagaaagttcctaagtctgaaggaagtccaacccagttatgaagggaatgccatccacaagccttttttataattggcccctgcctcaggtaaaggggtctcctttaaggagccagtctggctaaattggcagattctgaacaaagcctggccctgacaagtcttcagaaaaaccggttttcacctccagaatgtgccccag

SEQ ID NO: 2208 - DNA, 2112 bp, Homo sapiens; identical to SEQ ID NO: 2207

SEQ ID NO: 2209 - DNA, 1994 bp, Homo sapiens
gttcacacaacaatgagaaagtacgggtagcctgcagaaagacctctccattcatggtcccccaggggtgtgggttctgagaggtgggaccagctgccaggccctttctccattggttgagttcagcaggtaacctgaagctttgctgagaggtgcataaataaagagtgaaactagtaccacctccttgaaatgggctgagtccctcttgctcacccttgacttggaaaaaccagtttctcttttattgtctgttactaatctctattctaaaaattcagctcaattctcaaccatactccaaactctctcttttccagctacctttactccctctccttcaattccactttcctctgcttactttttttttttttctgacagggtctcactttgtcgcccgggcaggagtgcagtggctcaatcttgggctcactgcagcctcaacctcccagaggcggggtttcaccatgttgcccagactggtcttgaactcctgagcttaagcaatccacctgcctcggcctcccaaagtgttgggatcacaggcgtgagccaccgcatccggcctcatgttctttttcattaaagagagaaatcaactattcaggaccggcccccacctttcctcaggagtcatttctgttccgcacaggcctgctgaactgggtgctttatataggacactgtcatctctcaagtacccatcttggagggtacggaccccacatgagggtgaggctctctgcacactccagaatttcagtggagtgaagttcaggaggcatggagctgacaaccatgaggcctcggcagccaccgccaccaccgccgccgccaccaccgtagcagcagcagcagcagcagcagcagcagcagcagcagcaagagtaactctgacttaggaatagagacagccagagagaaatgtgatcaatgaaggagacatctggagtgtgcgtgcttcttcagagggacgggtgatgggcagattggaaaaagcaccgcagatgggaaccttaatctttcttttctaaaattgatgctatgaaaatttgcgttttctgtaacttgtaaaaactaaaagttgcttgtctactgaaaagcctctctgcctctatgttttataccatcggatgccaactcccggccttctaagccacctcccctttaggctaaaactgagacatgaacttgaaaaattgacactggcttcctctctctttagggtccccaggcaggtggctgggacactatttgcaatcagcaaggaaccctgctgcccttagactccccacagagcaagcagaacttgcagaatggggtaaaaacactctattaaagattttttaaacctatttatattgtaataaagtaaatgtaaataaaatttaagtgaaggcagattgcagatatttccgatgctatacaagatatatctcatagtatgggtgtagattctgcaaaggttaatgcagttaaacatatttgacacataaaaatgtcagatccaacattaatcattcaccaattgtaattgcctttctatgggtctcttctccccaagacatagcttaaaacaccaggctcggtagaaatctgggaggaaaaaagcaaataatacctctcagctgtcagggtctatgatacgctttgatagatttagcactgatttcattctctttacaattcagtgtgattgggtgtgcgtgtgtgtgtgtgtgtgtgtgtgtgtgtgtgtgtgtgttactccatgtttctcctttttaaggaaggagaaggtgtggaacaagagaaagttcctaagtctgaaggaagtccaacccagttatgaagggaatgccatccacaagccttttttataattggcccctgcctcaggtaaaggggtctcctttaaggagccagtctggctaaattggcagattctgaacaaagcctggccctgacaagtcttcagaaaaaccggttttcacctccagaatgtgccccag

SEQ ID NO: 2210 - DNA, 1994 bp, Homo sapiens; identical to SEQ ID NO: 2209

SEQ ID NO: 2211 - DNA, 2672 bp, Homo sapiens
acagggaatgcattctttctgaaagtatcaagacggcgccaggcagctcagtgttcgcagacagctgtggcgcgacgcaacttaaggaggttctagtgtcatccgcgccgggggggaggagcctggcgctggcgagtaggggacaggatccccggcacaaggaaactgcaacccaaacccgctccaggacttctccccccgccccgcgcacccccgcccctcctcccgcccctccactgaccggaaaggggcgccgcagagggcggccgccggcggaggggcggcgggcagggtgggcgaggcccgcggggcttgggggcggacgggagggaacgcgcgctctggccctttaaatgtggccgcggctcctgccaattcattcgggtcgggtggacgattccgtcccggtgcagccagcctgccccattcatgaagttcatttcgatgggcagaattttctttttcagacttttaaaaaataggcacgcatggatcattattaggatctaatgcagggtgtttgggagagcgcatcgatgtggggaaacgtgcgcgttaaattgatcagaaaaacaaaatgtttcatgtcaaggtattttgagatttgcctctcgggccgacttcctaagagggtgagtcatcggataaaggggagatgcctttgactggagcgtccgcgtcaattttgttgtcattgtcacctctttcccgagccttctgcgctctcaagcccccagagtgaacacgcttcagctgttgcagctgccctttccagacctaatatttgtaatcaatgtgtgcttttgacttgagtggcaacagtgagggatgagaaggggggaggggaggaagagactggctctaactcattccccgagtacgctcagtgtagacggacagaaagaactcggtcttcactctagggacccaacttttcctttcgccccgcccggagccctacttactccggctcccggcgtttctcccacagtcaaggaaaccagccctcggtctgcaccgaccccaaccccggcctctggtcgggactccacggcgaccttccccggctcgcgggtctccaggccacgctctgcgcaatgggcaccccggggcggagggcacgcggctccgaggcgccccagcgagaggggcggggcgagcgggggcggggcctggagggaccaatcagcgggcgaggctgtggccgagccgcgattggtccgccccgcgggttccaacctgcaccgcccgctcggtcctttgagccactgcatcccctagcggcgcccgggtggctgcagccgctggcccgaaaatgctgctcgggcgagcaggggtcaggcgggaaaagaagactccaaatccactctctgctcgcccccagggcaatgctgccaggagagggagtgggttcccccgcaggctatcccaccgatggggctgagagcttaatttggggttttatttgaattggagacattgttccctcttcgctcctctaccccataaaattccctacaaatgcaaaaattcgagatagaagaagccgtccctgaaagtaagttctgaaggattcctttcatgcggtgaaggaacaacaacaatattcaacttcaccttggtgtgtgagggtcgtcgtgttttaaaacactatccctgtagaaagattagtgaaatgtattggaagaagtagtggaaacgtgaatcttcctggtctcgcgtttggatcttctttggagtcctcaccttcttaaatctgatgtttgtttgaaatcagggctgaatttccatatataggacagaaagaaagaaccccaattttttaaagaaagctccccccccccccgccacgtttctcctgagcccacttggtctcccgttattaggcggcccagttaagaggcatcgattttcctttcattctctgaccactcgtctctcctgggccagccaggctgcccgcatcttctcctgctcacagcgctctctaaaccttttaattatttagttgctgtctaacattcaccggaaacctctccataaacaaggagaaacgaatgcacacgcatttttgctaagaagcccgggattaagatttaaggatacaagctgaaagaaaaaatgaaaaatgcttctccgcgcgtcaatcgaggggtggatgcgccacgcagcgtgagcccagctcacagccacgcgtaagaccaaaagctgccatgggttctgcgcgcggagacctcagagccgaagagagaagtccccgcgtcagaaacgctgcggatgccaggtcttgaaaatgctgacttctgaggctaagaattatttcaaagacaaaaagaaaagactggtgaggaggccttccggtgcaagggcgcctatccgctaattttggatggggaagtagggattattcgtttaaattcaatcgcgagcaccaagtcggactggccggggatggagaagggcaacccccacctttagaaaaataaaagatctcgaaggcccttcttggtctgggtggtttgaggctggcagagaggggtggggggcctggggctggatgtcccgggtaatggagccagccggtagggggtatttagcatttaattcccagccggcccgccccagttcccggactgacagtgggtaattgggagagaggacgttgctctttt

SEQ ID NO: 2212 - DNA, 2672 bp, Homo sapiens; identical to SEQ ID NO: 2211

SEQ ID NO: 2213 - DNA, 2672 bp, Homo sapiens; identical to SEQ ID NO: 2211

SEQ ID NO: 2214 - DNA, 960 bp, Homo sapiens
cttggtattttcagcagtttcatagtgattctcaaacatccttcaagtcttataaagtgcgattaagccccatcttttccaaagtgtatgtatgattctaagaactttacatttatccatgttaaatgtcaggcctctgggcccaagcctacatgcatacatccagatggcctgaagtaactgaagaatgacaaaagaagtgaaaatggccggttcctgccttaactgatgacgttaccttgtgaaattccttctcctggctcagaagctcccccactgagcaccttgtgaccccccacccctgcccgccagagaacaaccccctttgactgtaattttccactacctacccaaatcctataaaacgtccccacccctatctcccttcactgactctctttttggactcagcccgcctgcacccaggtgattaaaaagctttcttgctcacacaaagcctgtttggtggtctcttcgcatggacacacgtgatatttggtgctgtgactcagatcaggggacctcccttgggaaatcaatcccctgtccccctgctctttgctccatgagaaagatccacccatgacctctggtcctcagaccaacaagcccaaggaacatctcaccgattttaaattggaagacaggaatgtcaggcctctgggcccaggcctgcacgtatacatctagatgacctgaagtaactgaagaaagacaaaagaagtgaaaatggccggttcctgccttaactgatgacgttaccttgtgaaattccttctcctggctcagaagctcccccactgagcaccttgtgaccccccaccgctgcccgccagagaacaaccccctttgactgtaattttccactacctacccaaatcctataaaacgtccccaccccatctcccttcactgactctcttttcggactcagcctgcctgcacccaggtgattaaaaa

SEQ ID NO: 2215 - DNA, 5928 bp, Homo sapiens
ggagcgcgggcgcggcgggggcgggcggccaggctagtcgggcgggtgcgcggggcgctcggggcccggggccagagctggagccggagccgggcgggcgccatggaggggctgcggcgggggctgtcgcgctggaagcgctaccacatcaaggtgcacctggcggacgaggcgctgctgctaccgctgaccgtgcggccgcgggacacgctcagcgacctgcgcgcccagctggtgggccagggcgtgagctcctggaagcgcgccttctactacaacgcgcggcggctggacgaccaccagacggtgcgcgacgcgcgcctgcaggacggctcggtgctgctgctcgtcagcgaccccagcgaggcgcagcggctcacacccgcaatcccagcactttgggaggctgaggcaagcagatcacttgagtccaggagttcaagaccagcctggccaacatggtgaaaccccatctctactaaaactacaaaaattagccgggcatgatggcgcatgcctgtaatcccagctactggggaggctgaggcaagagaatcgcttgagtctgggaggcggaggttgcagtgagctgagatcgtgccattacactctagtctgggtgacagggtgaaactccgtctctaaagaaataaataataaaattttatttcacgccatccctgctttctctctttccccatcacttgtcagcagccgacttctctacgttttacttatttttttcacctgtctcctgcagtagactgtaaactctgtgagggtactgccgtccatcttgttccctgctggattgccagttcagtgcctggcacatagtaggtgcttaataaatgttagtgagatgtattgtctcactaacataatcgtgagcagaggcaaggattgggctgctcagaatatttttctggagctctagcggtgcctggatgcaggggagggaatttctgggtcagaggtgagccctggcaggggcaggaagaggcaccagccagacagtgggcagaatagggaagccttgaacgccaaggcaagggctatgttttttctgcaacctgtgtctttctgtctccctctttcaggtagtctgggttggaggaggcagagccatgaccaaggggacctgggtactggctgaaggaataggctggggtagagggcacttttggaaggcacttctcctgcctcccgggagcctagatctcactccagggtctgggctcccaggtggaccatgaaaccctggcctgaccagctgatgcacactgcttcagacactcctgctggagccccagtccctgacaaggacctaggacatttttgctcctgcccagcctatcgggagggagccttgagcctttcagctctgctgtgtgactttgaggttgttgctcccctcttggggccctgggtgccctgtcttcagtggaaagcactgtgccaccttggaaagctcccatgggcagccagagggcatcgcaagaagagaagcacagaaggggcaggagagacactcagaggcacttccgctcttgcccaggacattttcccagccacacctttgcccaagccgtgccccctgcctggagcacttttcaacctcttctctgcagctccaatacacctgggattgcagtctcctccaggaagtcttctcagattccctccttcccagccagagagcacctagccttctttggggcccccacaggccctttgtgcagtgaacagccctggctgggggtgcagccagtcgtgtccgaactctccaatgactaagcggggagatgcggacatcctagctccttctcaggcctccaactgtgccccatttccacccccaaatacctccccaggaggcacctgtgcccaccccctgggctgtttcccccttccccttaaatccggatgcctcgtcttgcatagggtcttggggcagcggggaaggggttctgaagaactctggccaagaggacgaggatctgggggtggggaactgggcctagctgtgggaggtcatcgcggggcattgcagggagtgcgttgtgggaattccgggtggagaccctcagggcagtgtgccgggcctccgttgcacctctgacctgcagccacgtcatcgttgcgcagcccctggggagggtctttggggagggggtgccgaggctacgcatgtcctcgagggccgtgtacactctccaggcaccatgggcggaggcgccagaggctgggaagaaataatgttttagttaagagtcctgttggctgcaggactcagagcatggacaggtggatagtaaatcaccaccacggggacagccgtgcccagactgtgcgtttgcttagctcggggacagcacttggcccggggtctcctgctcgcctcccttcagagcatctgccaaacttcgggcatctaccctgcaattcccgcttggctgagaggagggggagaaggaggggaagagagaggagccccacttcactccggcaggcagacctgctggagctgctttgcagaatgacttgggtcttgctggcccctgggtgtgcctggaggggggtcttcctatccccctccacctctccccttggtgcctaacccaggactttgtccccagagacccactgtgtgccccctggagctcctcctagagcagagtctgctgctgtctgttctgcagagggtagcctgaggcccaaggaggttgtcagggacacacagcagggggaggcagcccagatccctgctcatgcgtggtttgggcctctgctaacagctgggccacatgcgtgtatctagagcctgggtcccctctgtcctcatttccctgtgcatattcagggacatgcctcgtcagggtttggcaagaaaatggggcatttaataatctccccagtttcattccttggtccttactccatgccaggacttgtgcacatctttttggagccctgtctcacttgattgacagccggccaggcgcggtggctcacgcctgtaatcccagcactttgggaggacgaggcaggcggatcatgaggtcaggagatggagaccatcctggctaacacggtgaaaccccgtctctactaaaagtacaaaaaaaatagccgggcctggtggcgggcgcctgtagtcccagctacttggtaggctgaggcaggagaatggcgggaacccgggaggcagaggttgcagtgagctgagatcacgccactgcactccagcctgggcgacagagcgagactccgtctcaaaaaaaaaaaaaaaaaagattgacagcctcactgctcaggggccaggataacagcccattttacagatggcttttggcttgcccaaggtcaccaccctctgaactgaggcgtccccaacccatgccgggagctggtggaggaagtggggaagggtttcccgcttctccactgggggtggaggtgggagaaagcattttcagggtgttttgacatttaacaaacagtatgcaaatcacatgcaaatcgcatgcaaatcaccacccatttcttaagcctcgacagcgctggcatgttctgaaataataatgttggacctgtcccttgatgatgacctgggtcgggaggtgcacggccttttccttcctccgtcttcccttcccttcccttcccttcccatctgttctcccttccttcgcccccttcctttcctctccctccctatcttccatttttctcttcttccttcacatcatttgtccaagacctccctggcctgagataaacataagttgcaaaagtggcttcctgcagcccattttccaggttgggaaactgaggcatgggcctaaggtcccacagccacaccgaggaaagcagcccccactgaatgtcaccatgcaccaaagtgcatggtcctcgtgacacaaagaggggagatgacagtggctggagttgtcagagctgctttgaggaagctccaggcctgataggcttgacagggccaaggggaactattgtggaatgtcttggccttgaatgacaggctgctgattttggatctggagaaagctcacactgactcttcctgctcccccagtctgtttttctcctgctactccatccatgtatccctgagtttgggccacagtccctccacttggtttgcatgtcccaccttctttgtttggcaagctcctattcatccttcaaagccctagcttcaatacctgctacttcatgcagccattgcttatccttcaaggagagcctacttccctcaaggaccctgctgcttccagtctcaccttctgactcactcgggatccactgaactgggaggtctgtgtctcctcccagcagagtcatcactacctttggggccgcaggatcacccagcttggaactagatacagaaatgctgttttgagagtgtactgaataaaagattacatgtttgaaaacaagattgagtttaagcttcctaacttggccttggagctctcttgggcttcattctaccccatctatggttttgggctgagctctacttctaccttcctctcactcccctccaggcctttgcacatgctgttactccaggtgacgctgttactccaggtgacactgttactccagttgaccccaggccagccccctcccatatctgggctgtgaaactcagggaatcctgctcgctccccgccagggcctctcagactctgggctccaccctgagcaagtctgggctatgaggagtttcgggtgagacttggcagctgccgtctcgctaaggcccgcggcgttctggggaggggccacctcccgtcttggccgcccacctagtttgtgctccaagaaggtccaagggaattctcctagggggcaagtgagcccaggcggttcccagaggagatgtcagcggtttagccagaaactgccaggacctggaattgccacttccttcctgccctgcctctatctctctgttctctttctgtgcgactccaggctgggctctggcattctcctaactctgagcattcattcaatgagagatataaagacagatgctgctccggctgccacagacagtggggcaggttgttcactgcacaagaggacccagctgcagaggtgagagggccccaggaaggggcccttctttgtaattcatccaacagctcccatacaagttagtgctggttctgaccttgccatctttctttctctctctctcctctcccttcatctgtctctgtgtctcagtctcttattttatttttgttgagacagggtcttgttctgttgtccaggctggagtgcggtggcacaatcacagatcactgcagcctcaacctccccagctcaagcgatcctcccgcctcaggctcttgagtagctgggattttaggcacacgccaccacacccagctaatttttaaatttttgtagagatggggtttcgccatgttgcccaggctgttctcaaactcctgggctcaagccatctacccgtctcggccacccgaagtgctgggattgcaggcatcagccactgcgcccggcctctttttcatctgctctctgtcgctccatttctgtctgtggttctgtttgtatctcgttatctctccctctcttcaatatctctctctctgcgtttctcagttcgtctgcatctcagtctctgtctctctccatgtctctgtatttttttctcaaatctcctattgaaaaagacccctctttccctaggccaggctcagtggctcatgactataatcccaacactttgggagaccgaggcaggaggattgcttgaacctaggagttcgaaaccagcctgggaaacatggcgagacccagcctttacaaaagcatttaaaaattatccaggtgtggtggcatgcccctgtggtcccagctact

SEQ ID NO: 2216 - DNA, 957 bp, Homo sapiens
cttggtattttcagcagtttcatagtgattctcaaacatccttcaagtcttataaagtgcgattaagccccatcttttccaaagtgtatgtatgattctaagaactttacatttatccatgttaaatgtcaggcctctgggcccaagcctacatgcatacatccagatggcctgaagtaactgaagaatgacaaaagaagtgaaaatggccggttcctgccttaactgatgacgttaccttgtgaaattccttctcctggctcagaagctcccccactgagcaccttgtgaccccccacccctgcccgccagagaacaaccccctttgactgtaattttccactacctacccaaatcctataaaacgtccccacccctatctcccttcactgactctctttttggactcagcccgcctgcacccaggtgattaaaaagctttcttgctcacacaaagcctgtttggtggtctcttcgcatggacacacgtgatatttggtgctgtgactcagatcaggggacctcccttgggaaatcaatcccctgtccccctgctctttgctccatgagaaagatccacccatgacctctggtcctcagaccaacaagcccaaggaacatctcaccgattttaaattggacaggaatgtcaggcctctgggcccaggcctgcacgtatacatctagatgacctgaagtaactgaagaaagacaaaagaagtgaaaatggccggttcctgccttaactgatgacgttaccttgtgaaattccttctcctggctcagaagctcccccactgagcaccttgtgaccccccaccgctgcccgccagagaacaaccccctttgactgtaattttccactacctacccaaatcctataaaacgtccccaccccatctcccttcactgactctcttttcggactcagcctgcctgcacccaggtgattaaaaa

SEQ ID NO: 2217 - DNA, 1269 bp, Homo sapiens
agagggactgggaacaaaagacacagggaaggaccggttggtttttttcctttttataagattttttttctttgtttttgtttaatatgaaaattacttgaaaagacaagggccaaccccgccaggcagctcggccggccgcggccgcacgatcctaacattccaggtgtaagttacagagctcaagttcatctacaaaaaaagtaataaaaataaaatttaaaatggcaccttcaacagaacacaacaaaaccttagggcccggcctccgggcaaaaggccccgcagcacaggggcacggggtggcccctcatctccgctccagccaaaaagtaaacacaaagctaaaaacgacaactcctcggcattctcggaataagttagccgcgcttcttcctctcctcccccagtgtccgccaaggagcgcgtttctctgcaggtgagggcgggaggtgtggaaaattcagtgggaacaaataagcttttatgtaacttgctggttaaccgctttttacaaaacaaaacaaaaagctcgaagatgcctgctgacaaggactccctcctgtttctaccagctcttatggggctgttcctgggacgccctgccattaggaacagacaagtaaagccagcccagagtgggctggccctgggcccaggactaggcaatgggggcagccccaataccagatggctgggagggtgccccaggaaaggagggctggggctggggccgagacacagacaccgccaagggatgtcgggaggaagctgcaaggacaggccaggggtgcgtgtccagacaggtggagatggggggcccggcacccgatctcaggcccaccctgcgctgcagccggcgtgctgaccccacaggacgtgcctgccaggacacccagcagcctcgagagaatgccccaaggggacagggttggctgggctgggcagccactacccatatccacctccaggtcgccaaaccggccctgctgccctggccagcaccgtcagtgaaagccgcctggcgaaggggctccaggcacatccacactggcaggcccagcacttgcacacccgggccccacacacctggcctcctcatgctaggcttggtcctatctgctcttccccaaggggcctggggtcccgcagcccctgctccaagcaaccggcacagagcacctgagccagtcctccgacagaaggcacccatgtgtacaagctcagttgcccacggcccacacagacacccccgaccaccctccccac

SEQ ID NO: 2218 - DNA, 1269 bp, Homo sapiens; identical to SEQ ID NO: 2217

SEQ ID NO: 2219 - DNA, 707 bp, Homo sapiens
caacggaaagccgcctttaagtagggtcgcgaaggaaggcgctgcctcgcgttggaggagcttgctctgagctgctgccacctgctgggctggagctggagctggagctgcgaattcggagtcccggttccctgtgccacctggcgagctcagcaaactaaaagtctctttgtcttcatcgtttccggcactgatgtgagcacatcataagcacaagacctggacacctttacaatcagagggcctaggactggagctctggatctgaccggagcaaagaggaagcacgcaaatccggacatgacgacgaggaggcagtagagacccatcctcaactgttcttgtcctagagcctctttccctacttctaaatgagtggaaagccacccacaagcccgtgagtgaggatgcccttggtaaacccaggtgatcacaccctgggcaggccctgccccacagggccccatcccgctgctccccagcctgtcctcaccaactgcccaggcaggagcaaagcccacggggaggacctgtgaccacaggcaaggaccacggaccccagccccagggattttgacctcaagaaaggaaacatccacaatttaccctccatctggtgatccagctgcatctggggtgggtttggtctctgctgggaccatgaggttcagaccaccaagaaatagcactagcacaggtgaaaatca

SEQ ID NO: 2220 - DNA, 993 bp, Homo sapiens
ctttggaggaacgctttattgggcgcggacgttccgggcggccggcgggcgctagagcggaggcggtcggcggcagccggcgggcggcggagcgggacggaccaggcggcggcggcggggccggcgacgaggcagcttcacgactggcggggacgggccggagtcgggctgggcgcccgcgcgtgtcctcccgcggaccttccactggactcccgcgggccggcgccgggatcggggtcggggcccgctcggtccgccccgccccccgcccggcgggccgcttgcgaggcacaccctcccggaccgcgcacacgcgcaggcacacccccgcctcccgcgcgcacgcggccgggcccggccggcccacgcgcgcccccttcccgcggacgcccgccgcccgcccgccgccccggcctcctccgaggagtgcaggaaggcccggggtcccgcggccagggcgcgcgggggacggcggcctagcggcagcgggggcgcccgcgcgggaagaccggctctgagggaaggtcacttacccgctgcatggctttcaggattaaagccagctcgtagcggggcatgcctggaggatcggcgagtgcggctcggaagccagccggttcccgggacgcgaaggggcggcgaaagcacggtccgagagcgcgagcccgggcttaaaggcgctggcagctgcgcagacgccgcgccacgccccctcggcgcgccccgccccgcccgcgcgccttgccgccgccccgccccctctccgcccgcgggcggccgccacgccccctccgcagccccgcacccgccgcaccgcccccgccccgaccccagcccagcccgccggccgcggctaggggcggtgctgcagacgcggcccagagcggctcgcggcggccgcacgccccctcgcgaccctgcctgcccctaccccgcctcctgccatgcctgctacctagctctcgaaccggctggaactttccatgccttcct

SEQ ID NO: 2221 - DNA, 3501 bp, Homo sapiens
gatgggcacatggaccgaggtcctgggaagccgcctgctcccacttgcatcctgcctgttactctcgtcacccagacgctgttcacccaggctctgcagcaggcgctgggctggatggtctaccgtgtaaacgaggggatttcccatcccacgggctgcttgaggagcagcagcctcacagaatggccatgcacagagtgcagggcggcaggacgggaaggccctgcctggagtcaggcacacgagtgccacagtagtggcatgattttgcccacctgagactcaaggactgggacacctgtccctcctcctccacccacgctgcggggaactgcatggctcctccgggcggggaccatagctttccgcctcaacgtacctggggctcggcatgctgcgttgaattttggagtggatgaggagtgagggtgtggcagggcggctggagctgcccaactgctgaaactgctgcaggtgccacagcggctggctccctgaaagcgtcctcctgcctctgagaccgtagcgcaggagggtgcgagtgcacctccgcaaggcctgacgctgctgatccacttcctctccccacgatggggacacacttggcgacagttccatctggggaagagacccagccggaacccagggaagagcaggctgtgaaaactgggcagaaacttgcggcgactcggaagacactgccaggaaaccctccccgggcctcctgtggggcttgtagcagccgcaggggttggctctcaccttctagtcccagccaggttgtcttggagtcagctaatgggcaaggcccctacctctcttaggatctgaggatgggaggggctgcgtttttccagaggatctgcacgtgtgcaggctgagtgttgagacttgattggtgtcaactggcactgcctgcccatgatgcacaaaagctactgtaagaaacagggtccatgtctccagggagcaggaccccgttctgaggccacaaccccgagggcagtctccgcctgcagagtcctccctctcgcaccggctcacctcgtggtgaatcccttggctacggtttggtgtgagaaaagagatgggtgtttcactccctgctgcatccctggtgacggccctggcatttcggggcatgagatctttgcttaaaggttttgcggtggtcactgcacagggggtgggggtggggtcccttggtgcaatttatccgattctgctgcgtggatgacatccacagtgttcctctccagtggggattatctgagacctttccgcatgcccgcacccacagtccgctccctcacggcagcatgaactcaggaggcgggcgttcccacagtcattacatttgcagggcctctctatgtccactctgatgcctgaggaccagcgcttccacgaaggtgtggccacgtccagtgctgctcattggcttctctcctgcgggaatgttctgatcccgaacggagcctgagcatgcgcgaaacccttcccacgttcacaaggtgcttctccagtgttccattacatctcacctatgcacactacatgcatacggtttccaccggctgtgcgtgtccctagaagtcacattcacggcgtttctccctgggaggaattctcccgtgcatggctgctctgagaccatttgcacctgcggccacgcgtgggctcctcgaggcttacaaaccaggctggactcctgaagccctagctgcacttggcactcggcgaggtttttctacaaaatctcatctcagccatctgagtccttcaccatttatcttatgaatccgctcgaacgtacaaggaaggcctctctgccctcctgctccagggaggaggttttgaccctcagctccacctctgcggctggcccggtctccgcaaacctttttctgcttggccagctggtgccatgctaggctttcccactaggggcgccagagaaagcgcgcgaggctgcggaggagagaggggcacactctttccggtttgcttccggttttttcctcaggcttccggtctgtttggtgccctggtcgcgtgtcttccgaactctgctgcttcgccccggcaagagcacttccttccgcggctgctaaaactggtgcgcgggttcccaacttcgcagaagagcttcatcggccccccgctagagacctcagaccgcagccatcgacgcctcgcctcggggatctgtccccaccctcggggccagccctagcgtagcaggtgctccctgcagtttttgcttctgagatagagttctcttttcagctccttcggtagtcacttcgtacatagtgattcatgatgcgaaatcctctctgttgaaataactgacgaggcctctgtcttctgactggaccctgacttccatgccctttccactctcactccagtacatgcccaaaccccaatctttgttgctccaggcattgcctctgtggcgctgtgtcccctcctttgaactctgatccttctgctcaggccctttctcccagtctgaagtaactcaccatgagtcaggccctgtgctaggtgctgggatgaagcagtgactgacacaggcctggacctgtccttgggaagagtgcgtctgtgacacagatactgtgccatgtggcaaagtaagcgcgtgggacagcagagccttgtttgccattaaagtaatatcacaagtctgttaaggttggagaatcaagtgaacatgctgaaaagttatggggaatgtagtctcatagctgggggagctgggggccttgtcaattggttcccccagtctggagagcaatctgagagtaagtagtgacactgtgtgtgctgagtgtgtctgtgggggtgtttttggataaaattaacatttgaatttgtgaactgagtgaagcagagtgcccttcataatgtgggtgggcctcattcaattagttcaaggcccgcataggaaccacctcctgcctgactgaaccgggacctacgtcttttcttgccttcagacttgaatggagacatcagctctttgtgggtctcaagtctactggctttcaatcagctcttctgcttgacagctgcaggtcttgggactgcccagcccccataaccctgtgagtgcattcctgataataaccctctttctcttgtcctcccccaccccacatcattggttctgtttctctggagaaccataatacatcatttactaatcaggaaatagattcagagacattaataactcatccaacctcacagttaactgtagagttgggcttgaaattccaaggtcgattttcttagccaatacaccatgctacatatatgtatgtaaaaataaaaacgcttgtgaactgaaaagggtccaaacttaagctcattttggtccttaattgctaatccataggcatgttttggtccttaattgctaatccataagcatgtttcggtccttatttgctaatccataggcctgcacacctgcccccaaggccatgg

SEQ ID NO: 2222 - DNA, 2839 bp, Homo sapiens
gatgggcacatggaccgaggtcctgggaagccgcctgctcccacttgcatcctgcctgttactctcgtcacccagacgctgttcacccaggctctgcagcaggcgctgggctggatggtctaccgtgtaaacgaggggatttcccatcccacgggctgcttgaggagcagcagcctcacagaatggccatgcacagagtgcagggcggcaggacgggaaggccctgcctggagtcaggcacacgagtgccacagtagtggcatgattttgcccacctgagactcaaggactgggacacctgtccctcctcctccacccacgctgcggggaactgcatggctcctccgggcggggaccatagctttccgcctcaacgtacctggggctcggcatgctgcgttgaattttggagtggatgaggagtgagggtgtggcagggcggctggagctgcccaactgctgaaactgctgcaggtgccacagcggctggctccctgaaagcgtcctcctgcctctgagaccgtagcgcaggagggtgcgagtgcacctccgcaaggcctgacgctgctgatccacttcctctccccacgatggggacacacttggcgacagttccatctggggaagagacccagccggaacccagggaagagcaggctgtgaaaactgggcagaaacttgcggcgactcggaagacactgccaggaaaccctccccgggcctcctgtggggcttgtagcagccgcaggggttggctctcaccttctagtcccagccaggttgtcttggagtcagctaatgggcaaggcccctacctctcttaggatctgaggatgggaggggctgcgtttttccagaggatctgcacgtgtgcaggctgagtgttgagacttgattggtgtcaactggcactgcctgcccatgatgcacaaaagctactgtaagaaacagggtccatgtctccagggagcaggaccccgttctgaggccacaaccccgagggcagtctccgcctgcagagtcctccctctcgcaccggctcacctcgtggtgaatcccttggctacggtttggtgtgagaaaagagatgggtgtttcactccctgctgcatccctggtgacggccctggcatttcggggcatgagatctttgcttaaaggttttgcggtggtcactgcacagggggtgggggtggggtcccttggtgcaatttatccgattctgctgcgtggatgacatccacagtgttcctctccagtggggattatctgagacctttccgcatgcccgcacccacagtccgctccctcacggcagcatgaactcaggaggcgggcgttcccacagtcattacatttgcagggcctctctatgtccactctgatgcctgaggaccagcgcttccacgaaggtgtggccacgtccagtgctgctcattggcttctctcctgcgggaatgttctgatcccgaacggagcctgagcatgcgcgaaacccttcccacgttcacaaggtgcttctccagtgttccattacatctcacctatgcacactacatgcatacggtttccaccggctgtgcgtgtccctagaagtcacattcacggcgtttctccctgggaggaattctcccgtgcatggctgctctgagaccatttgcacctgcggccacgcgtgggctcctcgaggcttacaaaccaggctggactcctgaagccctagctgcacttggcactcggcgaggtttttctacaaaatctcatctcagccatctgagtccttcaccatttatcttatgaatccgctcgaacgtacaaggaaggcctctctgccctcctgctccagggaggaggttttgaccctcagctccacctctgcggctggcccggtctccgcaaacctttttctgcttggccagctggtgccatgctaggctttcccactaggggcgccagagaaagcgcgcgaggctgcggaggagagaggggcacactctttccggtttgcttccggttttttcctcaggcttccggtctgtttggtgccctggtcgcgtgtcttccgaactctgctgcttcgccccggcaagagcacttccttccgcggctgctaaaactggtgcgcgggttcccaacttcgcagaagagcttcatcggccccccgctagagacctcagaccgcagccatcgacgcctcgcctcggggatctgtccccaccctcggggccagctcaccatgagtcaggccctgtgctaggtgctgggatgaagcagtgactgacacaggcctggacctgtccttgggaagagtgcgtctgtgacacagatactgtgccatgtggcaaaacttgaatggagacatcagctctttgtgggtctcaagtctactggctttcaatcagctcttctgcttgacagctgcaggtcttgggactgcccagcccccataaccctgtgagtgcattcctgataataaccctctttctcttgtcctcccccaccccacatcattggttctgtttctctggagaaccataatacatcatttactaatcaggaaatagattcagagacattaataactcatccaacctcacagttaactgtagagttgggcttgaaattccaaggtcgattttcttagccaatacaccatgctacatatatgtatgtaaaaataaaaacgcttgtgaactgaaaagggtccaaacttaagctcattttggtccttaattgctaatccataggcatgttttggtccttaattgctaatccataagcatgtttcggtccttatttgctaatccataggcctgcacacctgcccccaaggccatgg

SEQ ID NO: 2223 - DNA, 2839 bp, Homo sapiens; identical to SEQ ID NO: 2222

SEQ ID NO: 2224 - DNA, 6980 bp, Homo sapiens
gtgattcatgtctgttttgttatgtgtatttcgctgggatggaaaatgttaattgggttccccaggcagcctgttgggcagcatcttgcaaattaagaatcttgtctgtggttccataacacagaaaggggtgattttctcttgtaaagtggtttgaaccccacagccatggcactagcgagcagggtcatcagagctgctccattcttctggaagctgcagagaaagggagcccggaaacctggtatgccggcaaaaaggatgccctggatctgttcctgaaggattacagcatgaagaaaaataatccccagaataacatacgtgtgacagaccaggattcagcccacagcctggagccaagacaccatccgacccagatgaacctgcgtggatcacctgagccactagtgacccagagatcctgagagtgaaaaacatgcatggtcctatacaccactgagttttgggatgacttgttacttagcactattatgacaattgctgactaatataccaggctcctggaagatttgttgtgaggttctcataaaatgatgaatgtgaaattgcattgtaagctgcttttaaaaaaggtacttagctggagtgaaagctctacaaaggcagaaattgttttgctactgtaactagatgagttcctggaataaaatagtagctcaataaataccatattaattgaattggatggatggatggatatatatatatatatatatatatattttaaccttggaacttctatcataggcatttttccttgggttgaaactactaatttctcttaagtacagataccccccgagaaagctaaaatgctgtattgtttatcacaatacttttggttcatgataattactgccagatacctggagtaattatagaaattgtagagaacaagaggtgaggggtgggagagctaagaaatggattttccagttttgcccatggctactttgtgcagcacctctgacaaaagctttgggagttttccagaaactagcattctgcgccctccccaagcacttatttcttccttccccagggtgccgtgtttgcatttctgcagcacaacatggagggtaaagggattgcagagtgagtctccacttccactcgtctctgttgttggagaggattaaaagagcaggagaggggctgcctgtgtcctgggaaattttcaggacagaagaagaggctggccctgtgcagtaggtgcagagcaggcacccggcctccagggccaccgatgactccagggcctggcaggagccaggatgtggctcctcgtggagggctatgccagccgtgtgtccgacccagagcacagaaccattgccccagcagggcttttcagtggaaccgagtgtccccacacgagctttgtctccggatgcacacgaggagattctgcagcacagtggatccgattaagccattacagctttccagagggaaaagaaaatttaggacgtgtagaaactaagtctttgcccacaatcaagtttccattcaaattatgaaaaggaagtgattgaatgagaatgagatgaccttccccttcccccacggatcttcctccctctggttccctctgctgctgacacgagcactgcacccaggcgacggccccgggcgcccaggctgactcccgcactcgggcgctgagctcatggccggttctgaagaactctggttctgctcatgccccacatcaaaacggccaagtcttcagatttgggatttcccaagccaaaagcattttcatagaattgcatttcaatatttacattatctttaaagaaagtccagctaaaaataaaaaataagtaaaaatgttaaaaataaaacaaccccagagagaagtggggtctacctgaatgcaatgcaagatgaagtggacatctggacgcccctcctccagggcttcgcatgctccccggggctcaggggctcgggtggggcagctcctcatggcgtggggtagggagggtgaccccaggttcttagtcagggcaggtgcaggcctgtgagacaccaggcgaaggaggcagagcaggccgtcctgtgtggagtggcttattctaattcaaactcccctgttttcttcctcttccttttgggggaactcatccctctgagacctcagacagacatgcaccaggctatgggtgggggtaatgcagggcaggcagggtggtgcaggagaagcattctgctcttttctgcagtaaggtaaatatcgtggccgtcatctgttccacctccttcctgctgtctggcttcgttagtgcagatcaagagcataggtcagtgccctggagggtgttcaggatgaccgtagcagaggtctccgtgccacaaatggaacccagccttgctaacttctccaggctcggtgcccagcacccccagggcacacagaaaccactgtggtgtgagtggtgctggagcagcagacacaggcgcgttgttgtcgggaggtgggggagcccccgccggcttgcgtgttttcttccttagcaactgcccctcagaagcaatacaggacttaccctaatgtcacctctgctgagtccacgccggggaatggctgagaaacaacttcatgccagaatcctgtcaatctaagtctctacaaaattctaggaaccaagaaattataaactgaaagctcttaatgagaagctctctgtgggcaatgatctgggctctgcagggggctccagcagctgccagagggaaataaacgtggaaaagaacaacctgaggctgctcggctgaaggccggagcatggggactgccctaaccctcactcacggtgcagggagcttcccaggaagtctcagctcacctgcagccttcgaaccaggagaggctccgtgaaagagcaggatgctcgaggtctggcctcaaccctgtcatcattgtcaatccctgcggctcctccttccagggaggctgggcagaagagcaacaggagcaggtgctcaggggcaacacagaagacaggagcaggtgctcagggacaacaagtactcaggggacagaaggtgccaggaggtagtaggtgttcagggggcagcaggtgctcagggagcagcaggtgctcaaaggcagtacagcagacaggagcaggtcatttctaaataagtttaaaaactgaaacatgaattactaagcatgagtttaaagtttatatcctttgacatcgtgtttttacatagtatagagaagctaaatgtatttggttctattaataaacatgaaaattgtccgggtgcagtggctcacacctgtaatcccagcactttgagaggttgaggagggcagatagcttgagcccaggagtttgagaccatcccaggcaatgtagtgaaactttgtctctacaaaaaaatacaaaaattagccaggcgtggtggctccagttttgactgcaaggatggacccctgaaaacgcccaaggcttcagaggatgaccgctagagccagcagtttctctttccataatcaatcatgttatttgatagttatgagagttgattcaagattgagagatggaataggctgttattactcaggctcatttcctaaagtaaatcataatttatagatgtgggacacataggctttgagattccgatacaattagtgcaaacatttagaagataaattggcctccattccaaggtaaccaaatggatcccttttttaagaattgagaatactataaaacaaagatgcaaaaatacccaaaattgatcaataaggatcacgcagagatttattttttgaagacaatactaacatttcaaatgtaggaaatactattttatgctttaaacagggacatttagtctcgagttctagttttaatgccctaacctggtttatccataaagtggagagaggctagtgcataaattcatgtggtacagccaatcttattcattttttctcaagggacagttataaccagaatgaacaaagcctggaattcattaacagagcttacagggaaggtgagtggtttcgaagcatttttactaatcctttgataagtcaccctgatgtgagaggtggatttagcgacttgcttatgccaagtagcatatggcaaaagtaatgatatttcactactgcacgtatctgcaaagggagcactcactctggggcaagccaggcctgtgtcatgaagacactcgagcagccctgtggagaggcccaggcgtaagaaacagacgcctcttaccaacagtcagtgaggaactgaggtctcctgccatgagccatgtgagtgcgcgatcttggaggtgggttctctagcccctgtcaggcagtcagatgatgcagccccagtcacatgcaatcaagtctaggttcttgatattctagttacttaaagattgtcaagcaagaagtcatttcttccccggctatgctattcaaaggttcatgaatcttttggattttgtatattttagaaattccagaatttatcagtaggaaccagaaatagaatatccagcaggaacggcatgatgtataaaaaaatatagtcctttttgtacattcccctcttccattattctaactgtatctaccttcaaatcacacctaagatttcagggatagaccctttacctcgaagataatgaaacccatcagattataattttttttttgttatggacaattcccttccctaatatttctcaaactgaaggttgtaatctacttcaaagagtcgtccaaggaaggcatggtgatcgacgagtttcaaataactatcaaatacatttatttatcctaaaaacgttgacagtaatgatagaaatactcatttttaaaattcttgaattctgatacatagttctattttaaagtcctgaaataccagtatttttttattggtatactacaattataccactatttttggaaactaaggtctgaattattaacttcttttttttgagatgaggtgtcatctgttgttgttcaggctggagtgcagtggtgcaatcacggctccctgcagcctcagatccctgggctcaaagaaatcctgtgagcatggcactgtacccagctgattttttaatggtttgtagagacagggctttgctttgttgcccaggctggtctcaagctcctaacatcaagcaatcctcctaccttggcctcccaaactgctaggattacaggtgtgagtcaccatgcccagcctttatttatctcttaaaatgaaagtcattgactaaactattcaattttgtgccaaaaaaaagatgaactaatgtgcagtcttcaaaactgataggattattctggaaaattttgtacatacacacacaaaaaaagaagcattgatgacttttgttaaaaacaccaaataatatgtcattttaaatgtttatgaacgattaatttcttatttcaatataatgcttagttgattatttgtaataaaagtttatttttgtttatgtgctaatccattaggatgtgatatagtttggatatttgtccctacccacatctcatgctgagttgtaatccccaatgccagaggtggggcctggtgggagatgtttgggttctgggggtgggtccctcatggcttgatgctgtcttcttgagagtgagttctcatgagatctggttatttaaaagtgggtggcacctccctgcccactgtctctcacttgttcctgctcctgctcctgccatgtgatgtgcctgctccccctttgccttccgccatgattgaagcttcctgaggcctcccagaagtagaagccgccatgcttcctgtatagcctgtagaaccacaagccaattaaactttttttaaatgaattacccagtctcagctatttctttatagtaatgcaagaatggcataatacaggatgataatatgttgaaggtttatagattcaaaaaatgtattttagttaatttgaaaaataatgtaagaaacacatgataaatattcaattacgtttgtgaaatacactaaatccctacctgcttatttcctagctgggctgctataacacagtgccactcactgggtggcttttactgctcacagttctggagacgtggacatttacaatgaagactgattagggccagtttcctgattcacagatggggcctctcgctgtgtcctcacatggcagagggacaaacaggctccctctctctcttttatatgggcactgatcccatacatgagaggtccactctcaggaccaaatcacccccttgagaccccacctctcaacactatcaccataaggattagccttcagcatctgaatgtgtggggaggaagcacaaacatttagatcacagcgccctgtccctggtttcccaaagttcacatcttcctcacgtgacaagtacattcattccatcccaacagccctacaagtcttaactcgttccagcatcaactcaaaagtgtgaagtccagagtctcatttaaacatcgtctaaatcaaatacgtgtgtgatttaaggtaaaattcattgtgagacaaactgctttccagctgtgagcctgtaaaatcaaacatgttatgtgtttccaaattcaatggtaggtgttatggtttggacttgtgtccccacccaaatctcattcaattataatccccggtgttggaggtgaggcctggtgggaagtgattggatcatgggccggagttcttaagaatggtttggtaccatctcccttggtactgcatagtgcgtgagttctcataaaatccagttgtttaaaagtgtatagcacttgtccttctctctccctcctgctccagccatgtaagatgcctgcttcccctttgcttttcaccatgattgtaagtttcctgaggcctccccagaagctgagcagatgccagcatcatgcttcctatacaaccaatggaactatgag

SEQ ID NO: 2225 - DNA, 3913 bp, Homo sapiens
accctgggtcccaatcaggtgctgctgggaggaggcgcgtcagccaggggtggaggaagcagaaaaggctctctcacctctaacgccgcagtggattagagcatctgagaagctctggaaaaaacctctcaggaaaacaacgacttcagcaggacccactagccaaggaaaggggataaaataaatagcaaagggaaggaaaaacacgcacctctgggatgctgcaggtcctgttgcagccgccgccatccctcgaagccaccgttgcttctgccagagctgctactagcgcgcttatcagctccgccaccgcccaagggggaaacttctgcagaaaccccaaccgagcttccgtcgtaagtagccaacgagcagccacgcagcgtgctgctagcggggcgggaggctacgcgcgggcgcgtggcctgctggggcagtggaggaccgagtcttcccagcccgcaccctggcctgggacccgcgctcccagtcccgggacccgcgctcccagtccccgcccctagcagccatggttatggaggcccgggccaacacgttctccttctcttccaccgcgcccactgctgcggtcactcggaccaagcctccaggagtagtagctcagaagcacttttgtagcataccgttacccctcaggagcttagcggttaagggcgtttgcatgtcttttagtaacacaagctccaggccgggcgccgtggctcacgcctgtaatcccagcactttgggagtccgagacgggtggatcacgaagtcaggagttcaagaccagcctcgccaagatgctgaaaccccgtctacgaaaaatacaaaaattagccgggcgtgatggtgggcgcctgtaatcccagctactggggaggctgaggcaggagaatcgcttgaacctgggaggcagaggttgcagtgagccgagatcgcgccactgcaccacagcctgggcgacagagcaagactccttaataaataaataaataaataaaaaataaataaaataagctacttcgagctccgttttccctaggttttatcatggctgccacaggtggccaagccctttcgtctccgtgatgtcactggaggctgcgtggtcttttcagggaacagaggggcctggatggcgcctggattccggcgatcgttgcgctgggaatggaaaagggctgggactcgctggaagtcgttctgaactaatagagctaaaggccttctggttcctggggagacgcgcctggcccccgtgtactattcattcccttcctcataactccacagcccaggctttcttcttagtgggcttcctagaccgaaagtgatctcagggccgctttgtttcccatcccggtcggtcaggccctccgtcagcgccctttgacccatgcagatcggatggggaaagctgccagcgccttccagggatgggggcagaatggggagctggagggagtggtctttttctaactttataccactatcaaactgtgttaattcatgtagctttataataagtcttgaagtcctgtgactttattctcccaagattgctttggcttattctaaggctattgtatttgtaggtgaattttggaattagcttgtcagtttaaaaaaaaaacaaaactgctaggatttgtactgggcttgcgttggatctgtagatctgtttggggaaaactagtatattaacaatactgtccttcaatccattaatatcattatttcccaccatttatttaagtggcctctaatttttcctggtaatattttgtagattgtacacatatttatatcttaatgtttggatccaagttgtgcttggatcgattgcagtatagagatcaaacatatatttcattagatttattcttgagcagtgttttaaatgcgatgttaaatagcattttatttttttatattctcgtttgttgtaagaatatagaaatgctattgatttttacatattgatgttatattcaagcatgttgctaagttcccttattatttgtaagggacaaaaagactacagagtcttttggaatttatgtgattacaatcttccaatctgtgaatagagatggtttaactttcctgtaatctttataccttttagttttgttgctggctagtatgtccactattgaatagaaatagtgataatggacttccttgtcttggttgtaaaatcaagaggaaagcattcaatatcaagtgctttttctgcctttattgaaatgttcatatgtatttttaataataatatgttactgttatataataataattttaaaataatattttaataataatgttacaatgtaaccaattacattggttaattttcaaatgttatctaaatggccaattgtccttccggatccccattgattccgattgggatggcactgtaagagaggcagaaccagtgaaggaaacaaggttttttcaggagttatatacaggggtggtccagtggtggtgggctggcctggagaaatactaccgttcgtattaaaaaaaaaaaagcatgtagtccatatagcatatagcattttcacttagaaccctccttctagcaatctccatttaacccaaaacaaagggcctcgatcacctgtacagcctgtgttccaagggatggggcagggatatggctgtccttcatagataagtagtgaatctcagtgttggctactcccggattccttagcctgggactccaaacacacttagaatagggtaattctcaggtatgctccagttatggctcagccatacaccaaggtgtatacaccaacccctgccatgcaccaatatgcatataaatatgaatagcctctgaaagggcgaattcctagattgacctataggcccacatgaaaagttctatattaatagctatgtcatgactgggtgcagtggctcatacctgtaatcccaacactttgggaggtcgaggtgggtggatcccttgaggccaggagttggagaccagcctgggcaacatgacaaaaccccatctctactaaaaatacaaaaattacctgggcttggtggtgcacacctataatccaagctactaaggaggctgaggcacaggaatcacttgaacctgggaggcagaggttgcagtgagtgagatggcaccactgcactccagcctgggcaacagagtcagactctgtctcaaaaaaaaaaaatagctgtatcatggacattgaaattataatgagataccaaaactaccaccagaatgacttaaattaaaaggatttccaataccaagcattgacaaggatatggagcattttttagagagaatgaccaaggagttggctacagtcaggtgctgcagaatcagatctgtggaccttaatgtgcatctggtgaaataaataactataatggtgatgaagaaagcaattgcccaggaatcctactgtggtctgagataagaagatcatattcctattgccacatccctggaggccatttgtcttttttcaatgactgatcatcctattcagagtgagaggatctggcatggaaacaagaggcctgtcgtaccatggcaactgaaagccactctttcccacttaccattgttttcaagccattaatttcctattaaacttcattttcctcttcctgagagtttcactataaaaatatatgtgtgtatagatatatattcctagcataagagtactataatagtgttttacatagaacttttacaacaattctttgaagtgctttattgttcccatttgacaggtgaggcgatctcaggcacaggaaggctgaatgacatttccaaagtcacctccttgtaagaggcagtgtcagaagctgacaatggacttgaccactatgctgtcgtagcaacagagag

SEQ ID NO: 2226 - DNA, 15256 bp, Homo sapiens
accacagataatttgttatttttgcagggttcttgatgcaaactgaacttttctggaattcttgcatcatttttacatgcacagcagacttttgatgagcaacttcttagctattcaatactccttaaggcattctgagttcttctgttttcgattttgtccttgaacaacagtataggtggcaaacaatatccggagatacaaggcctggacacaggaattttgatgatcttgatttttcatctcatcttccttttcaaggtgaatatgtactgggccagcaccacctctgccgccaggatgcacacactgatgctagcttctgtgcccagttttgccatgtccacctggtccacaaatgtggccctcatactcttgctgacaaagatgacattcacaagctttggaagtatggggcttatgccttaaccatggggaaacccatgaagcccccagaaattggtgcaggcgtgcctgaccatgtatctgtatcacagacacagatactgcatttgttttttttatttttatttttttacaaattgtagctttgtggcaaccctgtgtcaagcaagtctataggtgccattttttttccaacagcatgtgctcaattcatgtctttgtgccacattttggtaattcttgcaatattccaaactttcatattattgttatatctactatggtaatctgtgatcagggatcttaaatgttaccattgaaattattttgaggcatcacaaactgcacccgtagaagatggagaacttaattgataaatgttgtgtgtgttctaactgcttcacttgctggtggttcccccatccctcttcctctccttgggccttttttttttaatctgagacaaaacaatattgaaattaggccaattaataatcctaaaacagcctctaagtattcaaaggaaaggaagagaagcacttttctcactttaaatcaaatgctagaaataattaagcttagtgaggaaggtacgtcaaaagctgagatgggctcaaagctaggccttttgggccaaattgttagccaagttgtgaatgcaaagaaaaagttattgaaggcaactaaaagtgccacctcagtgaacacataaatgataacactgctgacatggagaaaattcgagaacatgtggtgtttggctttttattcctgcattagtttgctgaaaataacagattccaactccatccatgtccctgcaaaggacatgatctcattcctttttatgactgtatagtattgcatggtgtatatgtattacattttctttatccagtctattattgatgggcatttaggttgattccatgtctttgctattgtgaatagtgctgcaatgaacatacccttgcatgtgtcttgaataatagaatgatttatattcctttgggtatacactcagtaatgggattgctgggtcgaatgatatttctgcatctaggtctttgaggaatcgccacaatgtcttccacaatgttgaactaatttacacttccaccagcagtataaaagcattcctttttctccacaccctcatcagcatctgttgttttttgactatttagtaatagacattctgactggtgtgagatggtatctcattgcggtttcgatttgcatttctctaatgatcagtgatgttgagcttttttttcatgtttctggccacatgtatgtcttcttttgagaactgtctgttcatgtcctttgcccactttttaatggggttgtttgttttttgcttgtaaattagtttaaggtatttatagatgctggctattatacctttttcagatggatagatggcaaaaattttatcccattctgtaggttgtctgtttactctgttgatagtttcttttgctgtgcataagcttcttagtttaattaagtcccatttgtcaatttttgtttttgttgcaattgcttttggcatcttcatcatgaaatctttgcccgtcctatatcctgaatggtatagcctagcttttcttctagggtttttatagttttgggtttaagtctttaatccatcttgaactgatttttgtatatggtgtaaggaaggggtccagtttaagttttctgcatatggctagccatttctcccagcacaatttattaaatagggaatccttttctcattgcttgtttttgtcaggtttgtcaaagatcagatagttgtaggtgtgtagtcttatttctgggttctctattctgttctattcgtctatgtgtgtgttcttgtaccagtacaatgctgttttggttactatagccctgcagtatagtttgaagttgggtagcatgatgcctccagctttgttctttttgctttgggttgccttggctatttgggctcttttaaaatagttttttttttttccagttctgtgaagaatgtcaatggtagtttaatggaaatagcattgaatctataaattgctttggacagtatgggcattttcatgatactgattcttcctacccatgtgcatggaatgtttttgcatttgtgtcatctctgatttctttgagcagtggcttgtagttcttgaagaggctcttcacttcctttgttagctgtactcctaggtattttattcttttttgtggtaattgtgaatgggaattcattcatgatttggctgtcagcttgcctgttgttggtgtataggattgctagcaatttttgcacattcattttgtatcctgagattttgctgaagttgcttatcagcttaagaagttttgggctgagaaaatgtgattttctagatatagaatcatgtcatctgcaaacaaagatagttcaacttcctttatttcctatttaaatgtgctttatttctttctcttgcctggctgccctggccagaacttccaatactatgttgaatagaaacgctgagagagggcaaccctgtaccggttttcaaggggaatgctaccagattttgcccattcagcatgatattggctgtgggtttgtcatatatggttcttattattttgaggtatgttctttcaatccttagtttattgagagtttttaagatgttaaattttactgaaggccttttctgcatcttttgagataatcatgtggtttctgtctttagttctgtttatgtgatgaatcacatttattaattagtgtatgtagaaccagccttgaatcctgggaatgaagccaacttgatcatggtggataagctttttgatgtgctgctgagtttggtttgctagtattttgttgaggatttttgcattgatgttcatcaaggatattggtctgaagttttctttttttgttgtatctctgccaggttttggtatcaggatgatgctggcctcatggaatgagttaggaagcatttccttcttttaaattttttagaatggtttcagtaggaatggtaccagttcttctttgttcctctggtagaatccagttgtgaatccatataatcctgggatttttttggttagtaggctattaattactgtctcaatttcagaacttgttattggtctattcagggattcagtttcttcctggttcagtctttggagggtgtatatgcccaggaacttatctatttcttctagattttttagtttatttgcagagaggtgtttatacttttctctaacgattgtttgtatttctgtggggtcagtggtaatatccctcttataatttctgattgtgtttgattcttctcgcttttcttcttattagtctagctagtggtatatttatcatattaatcttttttaaaaaaccagctcctagattggctgatttattgaaaggttttttgtgtgtctatctccttcatttcagttccaatcttggttatttcttgtcttctgctagctttggggtttgtttgctcctggttctctagttcttttagttgtgatgttagttgttaacttgagatttttctagctttttgatgtgagcatttagtgctatcgatttccttcttagcactgctttagctgtgtcccagagattctggtacattgtattgttgttcttggtttcaaagaacttcttgatttctgccttaatttcattattaacctgaaagtcattcaggagcaggttgttcaatttttatgtagttgtatggttttgagtgaatttcttaatcttgagttctcatttgattgtgctgtggtctgagagactttgttatgatttccattcttttgcatttactgaggagtgttttgtttctgattatgtgataaattttagaggaagtgccatgaggtgatgagaagaatgtatatattctgttgtttttgggtaaagagttctgtagatatctatcaggtcaacttgatccagagctgagttcaagtcctgaatgtctttgttgatttttgccttgatgatctgtctaatattttcactggggtgttaaagtctcccactattattgcatgagagtctaagtctctttgagggtctctaagaactttctttatgaatctgagtgctcctgtatgtgtgcatatatgtttaggacaattaggtcttcttgttgaattgaaccatttaccattatgtaatgctcttctttgtcttttttttttatctttgttggtttaaagtatgctttgtcagagactaagactgcaacctctgctttttcctgttttccatttgtttggcaaatttccctccatccctttattttgagcctctgtgtgtctttgcatgtgagatgggtctcttgaagacagcatactgacaggtcttggttctttatccagcttgccattctgtgtcttttaattggggcatttagcccatttacatttaaaattaatattgctgtgtgtggatttgatcctgtaatcatgatgctagctggttatttttcagacttgtttatatggttgcttcataatgtcaatggcctgtatacttcagcgtttttttgtagtggcaggtaatggtctttcctttccatttttagtgcttccttcaggacctcttctaaagcagatctggtggtaatgcattctctcagcatttgcttgtctgaaaaggatattatttcttccttatgtatgaagcttagtttggccagatatgaaattctgggttgaaaattcttttttatgtatgttgaatgtaggctcccaatctcttctggattgtgggatttctgctgagaggtccactgttagtctgatgggcttcccctttgtaggtgacctggcctttttctctgcctgcccttaccatttttttctttcattttgaccttggagaatctgacgattatgtgtcttgggaatgatcttctcatggagtatcttactggggttctctgtatttcctgaaattaatgttggcttgtattgctaggttggtgaagttctcctggatggtatgttttccaagttggttccattcttgtctctttcaggtaccccaatcagtcatagattcagtctcattgcataatcccctgtttctcaaatgttttgttcatttttttcactctgttttctgtttttgttggcctgtcttatttcagaaagacaatcttcaagctctgagattcttgcctccacttggtctattctgctattaaagcttgtgattgcattgtgaagtttttgtagtgtgtttttcagctctatcagattggttatgttcctctctgtactggctatttaggctgtcaactcctgcattgttttatcatgattcttagcttctttgcattgggttacaatgtgctcctttagctcagtgaacttcatttttatccatattctgaaggctacttctgtcatttcagtgatctcagccttagcccagatctgaaccattgctgggcaggtgttgagattatttggaggaaagggagcattctggttgttgttttttttctttttctttttctttttttaaagttttcagtgtttttgtgctaattctttctcatctttgtgggcttatctgcctttgatctttgagtttgctgacctttggatggtttttttgttttgttgttgctgttgtgttttatttgttttctttgaacgactagtctgggcactcttctgtagggctactgtggtttgctacgggtctaccccagaccctagtcacattggtttttccagtacctggaggtatcatcagtgaaggttgtgaaacagcaaatatggccacctgcctattcctctgaaagctctgtcccaggggggtactgacctgttgctggcctgaccgtgcctgtaggaggtggttggagattccagttggaagatctcacccagtcaagaggaatggaatcagggacctgcttaaagatgcagtctggctgcattttggtagagcagctgtgctatgttggagatctcttcagcacccaattgatttgggctcttcaaggcccacagcctgaactggatgagatgcccaaacagcaaatgtctgcctcacccactgggcactctgtcccaggaagaaattagaactctgttggccatagaacatgggtggggctggccagaggccctggctgggaggaccctcccagtgaggaggaatggatctgggtctgtttaaagaagcagtctggtcattccttaacaaaacagctgtgctggggaactgtgttgtggaactgcctctgctctgttccgtttggactttccagtgcctacaggctggaagggctgagtcatccaaacaaccaaggtgatggcccacccctcccacaaggcactctgtcccaaggagacatcagagttctgtccatagaatacagctggtggggtggctggaggccccagctgtgaggtcctgcccagtgaagaagaacggatcagggttatggctattgttttggctggcttcatagtatttcattgagttatctcatcctatttgccatttcttattactgaacatatttttcaccctcttaataccctctcactcctactcatgtacacagatttatacatgttttctccctgtctcatcccttatatctccatcaaaagcaaatgctgtcctgaatgtttataattattattcacttataaagcttaaaattttatatcacatattacgtctaaggcatatggtgtttatacttgctttaaaatttcattagaaaatatgccatatgttgttatttggtatttactttttaattcaacataatgttattaagattcattcatgctgttgtatatggttgccattcacttgtttttcattgctctttaatattatattttattagtatactacaatttatttatctgtcctcctgactatggccatttagattacttaaagtttttgctatatgaacagtgtttcctccaaacatttgtgtgcatatctcatgcatagatgtactaattttggagggatttttatatctaggaatagaattgttggattgtaggtatgcacatattcagctttgaaatacaatgccaaaggatggtggaaagtgatggtaccaccagtaacatataagaaattatgttgaaaggatgctggataaatcctattcaatagttggcaatatcagatttcttaatttttgtaaactgattacatataaaatgattttctaattctagtcttcatttatatttcctgattaccagagacactgagcatttcttttttttttttttttttttttgagacggagtcttactctgtcacccaggctggagtgcagtggcgcaatctcgatcttggctcactgcgagctccgcctcccgggttcacaccattctcctgcctcagcctcccgagtagctgggactacaggtgcccaccaccacgcctggctaattttttgtattttcagtagagatggggcttcactgttagccaggatggtcttgatctcctgacctcgtgatccacccgcctcagcctcccaaagtgctgggattacaggcgtgagccactgcacccggccgagattgagcatttctttagatgtttctagccacgtgtgtttcatgttttgtggtgtgacttttgtttattttgtcatatttgttattaatttgtaggcattctttgtaatctcttgatgtaaaattttgatccttagtcaattatatattcctgattcattttcaattatatgtgtggcaaatatgttccccagattatagcttgctttttgttttactttttaaagacgtcttttgatgaacccaagtttcttaattttattctaatttttacatattttttatggttatgtctctttgttaagcccttccctactccaaagcaggaggaaatccacatttattttattccatgttttaatgttttgcttttgacataaagatcttaaactatatagagttatttttgtgtaatgtgcatggcaggggtacattttaattttttttcttatcaataatcactatttctagatccttttgctgaacagtctcctcttttcacagtaatctgccacaccatctttgatagacacttaagttccatttatttttagatttctttctatgctcccccttctgaatactgtcttttcaattcttatatttgggtactgggttcatgggtgtctattacattaacatatttattaaaagaaatatgttaaattacagagggtcatgcatcgaccaatgatgaaagtgtctcatgaattaaatattatgattaattcaaatctgtgagcctgagggccatcaaaaagataaaataaataaacaatgctacaaagagcagtcctattcatgttctttttctctctttcttgcctaaggacaagttcccaggaatgagggagcaagagtatatgaaatatttttaaaggttttaactgtaaaacttaaatgctttccaaagggacatacacattacgctttgtggcaaagagtctaacatttaaattcagagttctggccctgtggcatccatcgtcctctctccttttgctccagcctccttccttaccacttccccaccacactgatcgttgtctaataccactaagaggcaatatatttcttcttcagatcctgtctgtatctgctaaagcagcacttacagactctactgctagttggccagattaaaaggaagaatgaaacaatttctggactcacgttggtctctctcttttcatttttattactgatacgcattttctagctagtttgctctttccccaaatatattcacagcttgctctttcgggttgactggttatagcattgctcagatgtcaccttcctcagtaagacctttcaagactgcccatttaaaatggcaacccttcactctcgattcccactgtctccctcctgtgcctttttttcatataacttatcaccacttgtctgtctccccttaatcagaatttggagcttagatctcttttgtccatgggtgtagtctcagaatctacaacaatactttaaacatgatagatgctttgtgaacatttgcaaatattattacaaacaaagcacatagatgtcgttcaatatatctgtcggatgaatgactgaagtccagaggactcaagggacccacgattatacttaacattttttggtatctgtcccactggaggtccagggatagttgaagcctcgggtagtcatactggaattgctggctgaaagacaaaattattttcagaatccagcttttttcgaaagctgtaatttaactttgctttgatgcacagaatttttaatctatgtgactttggggaaatctgaaattgaaaatgtgcttccctatgcaggaacactagctggcatattaagcaaaagctctgtagtttatgtttaatgccagcttgtcactgatttgtgttctttttctgttcttgtcacaaactcagatcactgagagtattgtgaagactactttaatattaccttaaaatcccttgacaaataaaagatacaatataataaatcaccagcccttattttttaagattatagaaattgtcatatcaatatatagtcaccgcagagtaacccaaaaccaagatattaacaaacatcaaatgaaaaatacagctgtttgctgaaacgtcaacattatagaagcagtagtaaaacttgtgagtgtgttgtctctttccaatcatgtaggaaaactttgctgaactcacgttgaggagtggtgtttggcctcaaggcactcacatctacaagggtcactgaagatgtagctggatatcctattttgaaaataaaattcccaaattattatatgtatttacattcgtatgtttaactgtgccactacatttaacaagagcctggaatattagagttggaaagaatcttagtgaacagcctcattttataaatgatgaaaccgaatccaaaaggaatatgcttgtggttaaataatcaatatccaatatcatttctttgctattaacccggtttcctaattctaaatgtattatattcatactttcaaaatatattatttcagtgtctactgtatgccagactctattctgcacgctggggatatagtaataaacaatgaagacagggtccctgctctcatgaaacttaccttatagtgaattttcacaaatactactgtgaaaaccgtatcttcacatgctaaatatggtttcatatttacttcaattgttagtttgcaaagtcatttctccatctttatactccataattgttacattctcttccttccccctcactcccccaaaatgaaagactgattcatattcatttgaaaatagctctatattttagaactattatataaagcaaggtagattaaagaagaatatccaacaacagtccattgaaatcaggtttatatctcttggaaataaaaattttaaatacattttgtgtgcatttctcttttggtccaaaatgtatttaaggtggtttatatcaatgtgcaatacaagaagataaaagcagaaaggcaaaataggaacaaggaaaatacagtagaaaaattatgttgagtcctgttgaaacctaaacagggatagtggacaaagtgcatttcctgatgtcttatgctcttagtagatgtgggccccacatttggtctgacctttctggtaggaagtgctaagaaataaagagtataggttatgtgcttgatgaatataataagataaaaacagtattattatgaatagctagagaaatagttattctttttgttgtgattaaaaagaaacttttccccagatcttcataaaaagaatgctgtataattgtgtaaagtatcctataaaatatcattacagtatgatagccagtatgttcattcatcctcaagctttagttggtagtgaatggcagccagctttcctggtacctcagttatgtgaaaggacatgccttaaatagagaacatgggcaatcaaatcaaatgaataagttggcattgtggttaatgcatttataagtagttcacatccagaggtcatcaatgataacctttttttgcaatgcagcctatcaatgaactacaaaaagatacttacacaccgtggcttcatgattaaaagagtcatacatataaaatacttagaagagtgcctgacatgtagtaaatgctaaaaagtatgtcttagaatctgtaaaataggtcacttgcagtttagcagatgttgataatacaagcatattctaactataggccacttgaatctcctgaggagttccacaattaccccatttaccttggtctttctggaagaaagttgatctaaggtaactaattctttcttccccaggcctggcccaagtcaagaactacattccaaagtgttgcactagaaaagggctaatagtcagaaatacagagtgtgatagtaggctggggcattagctttgtggtagggtaataacttctcactggcagaatcacctacaattcttctcctctgccatcccactgagccatcagtaccagattcttgtgcggtaattgtaacttctagctcactgcctcccaccattcatcaaaggctgtattaatagaaaaattgcacaagattgactacctaaagcatatatgatgcttttgtagattgctttgaactgagtattggaactacattcctagtcactgtggaattgctcttatatagtactgaggattttcccattggctgacactagatgacagtctaatacgatgcggggaggggtcgccattgttcacttgcagtgagaaagtccctgggactgtgctccaccacgccctctagaggagggcccaggcagtctctgcattaagagcggctgtgcttctggacaactgccttgttataccattttacaaacctatggatcaccaagtgatttataattttatttctgtcattaagaagactttgcttttgttctctctgcagcaattccttcagttacctcttttcaaaattctgtattgttatgtatttttaaagttacttcatattccttttgggacaagacaaggtaaaaattatatagaagaaaataaataaattaggtataagtaatttgaacactgtgagatactgagagatatgataggctcttcctaatgaataaagatggttctttcctccttcctcccctaccttctctctctcatgctgagaattaacctccaaaagtatttgctgagagacttggtaagtaaattcaaaggaattgttcttaacagtggtgctatgataacaattgtcataatgaggatgatgaaaaagatctaggaaataaacatcaaagaacttaatatttatttgtaaactacatgaccactacctagaaatctcagtctaataagcaactgccagcagcctttaaaaatatatcttacctgcaagcaacagacactttcctatgccagcctggttgcccacactgggtgctggcactgaccaggacatgtgatttaattctggcaggaatcacaggaatcctgatgaagtataacttgattgggaatttcatttatattaaaatgactgattaaatgttctcttctggaggtcagaaaataatgtgacataaatcatttctcaagggttactgcaggagaaggagaactcactcatttgattctacctattatgttatttagggaccttgttgggggagaaacatgcctcagggatgcatgctgccttaatccttgtgtgactatgtctctgccccaacttagacatctatgttgctttacccttctcacacacagtgctgtggagtacattgagggctgaatacatgccaagtgtggggaacaaaaagatcaatgatacctagtctcctagtctctttccccagggagcacaaagttatttcgctcctattggtctccagctgaattttctttagactttcacttgagggtctgaaccaacttgacaggttattgggataatgacccctttactatgggacctcactcattatgtagaagtcagagttaaagtcttttagagaactatgtagttcctagataaattaaatctacccctctctctcccactttacactgtggttcaaggttaaggccccttcacattccatgacctgatctctaaaaaccttcacatagtcctctcttgatactccctgcatacattttttttgtttgtttaaccaacatttgagagtctctaaatttcaggcactgtgcttggcactgggaatactgctctcctggagtttaagttcatgaaggagatggacatcaaccagacgatcacataagccaattcaaatgctagaacatattaaagcaggggtagcccagtcagaatcccaggaaagctttcccaaggaatttagtgggagattgtggccagcggagggagggtgggagctttcaggcagagggcatagccatgcaaaagcccagtgtgtggtctcacatgtcatggattagtaatagccatgtctggcacctgtccattccagggctgggcttttacaagccctcaggggtgttttttccatgtgctgagttgaactggatgtgagagctaggtggggcgttacctgccaaagtgcatatccaagacaaaagcagcaggagaacagtgaccaaactgtggcacagtgtgcagcaacactgcttatttcttaggagttttgttttgttttaaaaaatcccttcttagaacctgacctggagattctgtaactatataagaacatgtctgactgtctcttgatatcatgcagagaattaaaaaattttatttgcattcctcatagccatgtttttgaaagattcatattgatcatatatttccagatgtgagaaagcttgctttgtaccttttgttttaaggctaagtttatatttcacaacatagcaaaatctcttcaatattcaatagtgtgttctaaatcatgagatactatgtaggcaagtaagatgacaaactctgtgatagggagttgatggctttgtttgctgattgtttattccttcttcaatgtaaatgtttattattatcaaatcttgcaagtatccagagttacactataatgacccatgtctccaggaaataagatgaaatttagaggtaaacactacttcacacaaaatgttttgtttatactagctcagaaatggccatgaggttacatgaggaggtttgaagccttcctggctcatttctattttaactctttaaaaattttctcactaaaataaaaaaaaacccacccttttatgctatcactggaaattcaattaagttagaagacagctccagtcagtgctgaattgagtgggcagacagaaacatgttctaaaagagctaattctggtcatctccatgtgacatcattaagcagaactgaatctcttaacctatactcttgccagtcttcctagtgacctaactgctagagaaaggaaaggtagaggaaggctagaagacctatggttgattaacttttgggaaatactgaaatattttccaaacaacatagattttaaaaataatttaatatggacctactatatgccaaataaaagaagcaagtgagcagttgcaaagtagcataagtggagcataaagaataagctggtaacttaaaaaaaaagcgaggccgggcgcagtggctcatgcctgtaatcccagcactttgggaggttgaggcgggtggatcatgaggtcaggagattgagacc

SEQ ID NO: 2227 - DNA, 1843 bp, Homo sapiens
ggagaacctgtgtgtggaaactctgtatctaactaatctgatggggaggtggagaacctttgtatgtagctcagggattgtaaagggcaccaatcggcgccctgacaaaacagaccacgccgctctaccaatcagcaggatgtgggtgaggccagataagagaataaaagcaggctgcctgggccagcattggcaacccgctcgggtccccttccacatcgtggaagctttgttctttcgctctttgcaataaatcttgctactgctcactctttgggtccacgctgcttttatgagctgtaacactcaccgcgaagatctgcagcttcactcccgagccagcgagaccacgaacccaccagaaggaagaaactccgaacacatctgaacatcagaagggcagactccagacacgccaccttaagagctgtaacactcaccgcgagggtccacggcttcattcttgaagtcagtgagaccaagaacccaccaattccggacacaatttcttggctctcagtggcttccatggaagttctgcaatcaaccagcaggagaaccgcttaaacccaggaggcggaggttgcagtgagccaagtatgcatcactgcactccagcctggaagacagagtgagaccctgtctcaacaaaataaattaaaataaaaaataatatatttttctaactatcatcccttttccaaatcaggaattccccttaagttttcctcaatttccatggcaatatctttgcatagattcattaagaatttgtcctttttaaataaaaaatataaagggaactattcattaggcaacaaatgccttgtctgaaatatcacatttgagaatgctgctcatttaatcagaaaggtacgctactttaaagaactgaggtccactttctggagccaaaaactcataaatccctctcagaaaaacctgatttgctttgtagggtctcaggtttagagatgctgaaaaagatattttcgttgcagacaaaggacctcagagtatttggagaactttgagaagagaggaattctcccaaatgtataggtgtcacaggtaaaatacagtcgagagattttcttggactttaattccttaaatcaggatagcaaataataggggcttttacaaattcaatctgtttccttacaaaaattttcagcaaagtaatttcagcaaattaattttcagcaaagtaaatgtaagaagacttatgtgaaaaattaacattctccatgtatctatgaagccaaacctaataaaaccagctttaatttgtgctcaagaatattatttcactgagttttcttaaatcacaaaggggagactgttatgaaaactgatataaaataaaaaaaacaaggaagaaaagtctactagatgtctctaatggaagactgcatttttagaacatatccttataggcgattctagcctttctctgctatttggctctcacactctttaccgtgcagataattcacagcaatgcaaaagaatcctcatctatagccatgaaaataagttatttgttatttctggtaaaggttcaattgacctccccttccaggatgaagaaagtttcatgtctttctgcatcatttcaactattccttactacatataaatctgcacttgttaacttctattttgaattgattgtggcatctgcctgcttccccattaaaactgaataaaatctttaacacataaaaatgtgtgaagtaatttttctgtttccttgtacaaattagaaagtaaaattgataagtgttcaaatgactcaggcttcaagtcccatattcttcttagtagagcagaggatgcc

SEQ ID NO: 2228 - DNA, 912 bp, Homo sapiens
aaaagaaataatgagaaaatttttgaaaaatattaataaaataaagatgtaggctacatagctgaggctattattcacaccatatagaaattaggttctcgggccaagcagaaactataacataatcagaaagaatacctaaagaaataaagtatgacttcctaaattttttattttaaaaatgcccagtttatttatttgctttgcctaagatagctgcattcattattacagggtcaggggacttgtaaaaacaaatatcaattattataaataatcacagaaaacaaataaactggaaaataaacagcggttactaatttaaggttttaacccttaccccaaccacccaaaaaaagtagccatttttaaaataaagattaagagttggtggaatttaagggaaatgccatccggtaatgttacctaaatactagaaaggaatcagcacaaggaaacaggaacaaagcagtgcagtacttcggtattacagcgccacccactggctagaagtcctcatagcacatatgagatgtagccataaaatagatgaattcttgaaataaggaatataacactgactattctgattcagtagaacataaaaaatgtctaacaaaacagaaccagacacattatattatttctacaagtaaacagaatatctattagatatgttcacaagggttttatcaattttgaaatccaagtgtataatccccaaatgctgtaaggacttaaattttatagccaaaacaattaacacataaaatgctatttcatctctgtagctgaatacataaatagtatctttaagtaaaagatgcatacttgcatttcattgctaagcaattcataatatatttaaatgctggtaaaacctacaatggcatctgttgtgattttccaaat

SEQ ID NO: 2229 - DNA, 912 bp, Homo sapiens; identical to SEQ ID NO: 2228

SEQ ID NO: 2230 - DNA, 912 bp, Homo sapiens; identical to SEQ ID NO: 2228

SEQ ID NO: 2231 - DNA, 1039 bp, Homo sapiens
ccttccctggattacctatcaaggctaacaaagttcagccatgtggacatgtttgcagacagttgagactgtattactatctcatggctagagttccaaggtaaaagcttttggatctttgtgtgtatatacatctagatgtgtttatgtgtatgcacatgtattacattatatgttgtgactaccaaattggcttatacataaaagaacactcctagattaagtaaataagtccaaagtattttttacattcacgttacttaagtaaatttttaagaagctagcattaaaattattgtaagataaaaatagaaatgtcttcagaattgtcagcatacattttttcggggttttatgtttgtctctgctagatattttggggcatcagagtgtggcacagaaagttataaaactataaccagtagtttgagaccagtctgaaaaatgaagacccccccccgccccaccatctctataacataaaaataagacaattagccaggcacattgattcatgcctgcagctagtcaggagactgaggtgagaggatgcttgagcctgaaaggtcaaggttgcagtgactcatgatccagccactgcactccagcctgggtgacagagtgagaccctgtcaaaaaagaaaaagataagaggcagagaatgacaatggggcacaggagcattgcagagaaactaggggaacagttgtaattgttaatacgatggtcagaggaggcctcattgagcaagtggctttaaggtgaagatttaaagagggtaataaggttttctataggtataatgagaaaacagaatgcaagcagaagaaaaaggacagcaaagtgcctgaagcagagaaggcaaagagattgaagtcagggacatgactggagggatgtcagggaggtgactggattctaagtcatggagaacttagagggctgttataagacttttatatatctttctctgaatgagattgggagtgacagcaggacttgcacaacgaataacaaaatgtggcttttgttttaaaag

SEQ ID NO: 2232 - DNA, 1039 bp, Homo sapiens; identical to SEQ ID NO: 2231

SEQ ID NO: 2233 - DNA, 1098 bp, Homo sapiens
gactttgtctcaaataaaaataatttaataatttttaaaataatggtatgctttgattcctttctctttatcttttgcgtatatctaccataggtttttggtttgtagttaccatgaagctagtataacattgtatagttatactagtctattttaggatgataacaacttaactttgatcacgaacaaaagttctgtacttatcctcccattttatattttgatatttcacttaatgtctgtttatattgtgtatctgttaacaagttggtggagttatagtcatttttaatacttttgtgtttcaacctttatcctagagttgaaagtgatttacataccatcattacaatacttgaagaactctttaatgtttcagatctagcggtgataaattcttcagcttgtttgtcttggaaagtagttcactctcatttttgaaagaaagtttcttagaataaagcattctcggttggcagcattttctctcagcactttgaatataacatcctactctttcttggtctgtaaaatttctgctgtgaaattcactgatagcttgattcagatcactatgtatgtcatatgcttcacatagtactttcaaggatgcatagaatttgaattattgagaggcaagagttatctgcccatcagagaggcaaaaaagaaaattatagaacctattaagtattggctggggtaggggaaactgctacttccaaatagtgttgctagaagtgtacattaatgcagcaatttggatgaaattttagtagaatatattaagtttaaaatatacattctctatgacctagatagctcaattttttgtgcctgtcatggagaaatttttagacatatgcagagaggaagaaaactgaggcacaaaaagaataactaacttgataagggttatttcataattgacatgagggttaaaagttaatctgtaagacatttagaagaggccttggcacataataagtactatataagcatttgctcccatttttattagttaattgtactttattaataaattttctgtgtagtttttctgctttgcttagttggctcttaacgctttcattttca

SEQ ID NO: 2234 - DNA, 1098 bp, Homo sapiens; identical to SEQ ID NO: 2233

SEQ ID NO: 2235 - DNA, 1421 bp, Homo sapiens
ggcgtgagccactgcgcccggcctgaattctttaactagctatgattgtctatgtgactcaaataacacttatatactgtgatgtaaagttagtgttttacacacatatgtttaaatctctaacgagataatgtatttcttatgatctgaaacctagttttatatccttcttactgctcccttcccactgtggtggttagtacaaatctggccccatgtcaggtgctcaaagattacttgatacgttatttgacgatttcagaagattccatgaagctcatcaccagaactcaggcacgtggccacatctaacagcaagggagtctggaaaacacagttcagctgtgtgaaggatatttataaacatttagcaagatccaaaggaatggaccatagcacagccctgttttctttagacgctgactcctgctgtctgccagatcctcgtggtacaatgactggtgtagactggcttgttgaagtcactctctggatctgagcaacgctggctgagccgtgatgaagtattcctatccatccactatgcttcacagtgggaatctctcactgttcatcaccgctgccctagcagccgcagggattcttcacccatggttgcttaggtttataagcaaggaagctgaatgaagtccctttcctctctggatgagcccctgggtttctggaagagtcttaaaatcacccctaaatggcttccaagcactgaagcccgagatgttagctggcctgtgtgaggccttgagacagaatgccacagccacaccccaaggatgctgaaggggatttccctcctctgtggtttttctcctttcttcccgcagcactcctcctacgtgctaacatcttctagtcaaacaactctccttttcaaagggaccaggcacagtttctgcttatccctgagtagcagtgttcagtttcctgccagcctgtggagtttttcaaacaagccaatcacctcctcctgtgggaactgagaagcaccccaccctctcgatactacaaagcccctgcttgttccctagtgcaactcccatgtggtcctgtggagcatatggtatcttcctcttctgggcagtgagcatatgtgactaataaactatctatctcatctgttcagtgccaggtgtcatttgttctgccatcccatgacctagggtggggattccttccacaccaacagggtgaatgcaaggtgattaaaacaagaagcctcttcaggatctatatcctagggaaaaaattaaacaacaacaacaaaacaagaagcttcaactctgaccctgtattccagatgtgttacaggggcctgtctccccagagccactctccaggtcagagcttacctccccttgctcagggttaggagctctgggcaggaaaaggacatcatgttaaaa

SEQ ID NO: 2236 - DNA, 693 bp, Homo sapiens
gtcagcttcttctgcgggctctgcaggatggccatggtgatgagcgcgatgtacgacccgtcgtcgccctcgcccaccacatcgatgtccacgtcctcggccgtcagcaccgtctggccggacatgtcgctggcgctgccgccgccggagagggtcatccctcctcggggtgtggacaaatcctccaagatttaacttccaagaaaaccggcggcggagcgggtggaggaggcgaggatgtgtggccaatgcacgcggagtgcaaggccgcctagttgggagccgcaagagcctgcctggtgtggcaggcacacggaacccaatccctgtctgtccgctgcggcctgggaggggagcgccggcctcaccagaggaaggagcacgaggggaggagttccgagaggaaataattagtgaaatatttgcagaagatgctgggatgtggatttaattccggatggacagtggtgcttctgattccctcagtctgtttccccacccacgatctcctctttccttggcctagacacaccaaaaataattcaataaaataaaaataaaaatttaaaaatctgtaaacttgcttcattacaggcattgagacacacagattgactttcatccccattagacagtttcccaggatataacactactcatctgaggctgggagcagggtagggggtggtgaca

SEQ ID NO: 2237 - DNA, 3816 bp, Homo sapiens
gtgagacagccacaggctgagctttctgagcccttggggtgccacctcctgagtcctggttcctgcggctccgtcgaatctgcagtgaaggcctttgggaagcgtgggttatgtgggtccaggggtcccatcctcccgtggaggcccttgacctgaggatcactaactcacaccccaccgacttccggcccccaacaagggcagtgttcctcttgctccattctgctctgaagtcccccaaaccgcttcctggggctgcttagtgaaatacaaggctcatctctgaggacctctacagggctggatgggaaggactgatccacattcccaccaggaagtttagcagaacccccgcgtgccacctggaccccttggaaggacctggctcaggctggaccacctcttgagaggcaggagctctggatttgatcaagaattctttgctgagcatggtgcctcatgcctataatcccaacactttgggaggccagtgtgggaggatctcttgagcccaggagttcaagactagcctgggcaacacagagagaccccatctctaaaataataataataataaaataaaaaattagcagggcatggtggcatgtgcctgtagtcccagctacccaggaggctgaggcaagaggatggctggagcctgggatgttgaggctgcaatgaactgtgattaccccactgcactccagcctgggcaaaagagcgagagaccctgtctcaaataataataataataataatcttattttggagaataaagagacctctggatttgaggtgccatttgggtagaaagaaaagacgtttacaccgagaaatagtctgtgttgccctgaaggagcagagggatgcatcgctggaggtgacctacagttgaagaagactcattatgacagaccttgtccttcttccttgtggaaagtgtttcctctgctgctactgctcatgagactcttccccctccctgtcccagggaaccaaagggctttctaccacaccctttcttgccccccgcctcccatgtctgctgtgcctttgtactcagcaattcttgtttgctccattatcttccagccggatacagagtgaatagttaaccacacttaggtcaaataggatctaaatttttgttcctgctccgtgtaaagaggccagtgtttgtgtgttgcaagcagccttggaatagtaactcttctcatttgtttgggatctggccaccaagttccagaatgatacacggatcagtgcagaagttcatcaggctctcggaccttagggctgttggagaaggcttcagcagcagaactgatggtgaaggctcgtgttctccatcctcaactttctttgcttcgatcatacacaagaatacatttggaagggcaaaaaatgaacactgtcgttcattgcagccgtgttttgtgacacagatgcacagtctgctgtgaagaccttctctcaagtggcatttgggagtccatgccagatcatggtgcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattaaagtttttgtatgttgcagttgctgtgcttgtatgaccatttagtgaatttggtgtcttctaaatagaacagtggagtccttgtggacatctcagattcatcacaaaatgattgaggagaacctcttgaagatgtttagagctattgaaatttacagattgttgatgggttttcaccttttccttcctttcttgacacacagttacaggcattgtattccttggattcctacaggtgtcaaggaacagagatccacttacgttaccttcataaatcctggtttattcaaaagtcacagtaaggtagacaggaaatagtcccagccactgcctagctaagccttttcaaaaagcccaaggtcattcagcagatgcagaagcactagttggttttcaaagataacaagagcaataccatcatggtcgttttgatcctctgttcagcagcagggttcgctgcccctgactttagaattctgccatcgtgatgagctgaaggtcaccaacggtcccagtttgcccaggactaaagggtttcttgggatgaaggacattcagtgctaaacctgggacagtcctgggcaaactgggaaaactggtcaccctcctgggtgactcaacgaccatgcctctactttgttacttactattaactgactgatgctgttgactggtttagccaatctgcattcagagcttttgcgtctggttacttcgttggccttcaggcagccacagatggatgctattggatcaggcaccaatgctgaccaaatcaattgtttccaggatggtagggttgtatgaagaaccaactgagaccatgtccttctgagtgttgtggatggtgggcatggcaggccttcaaggtatcagggattcctctccaatacagccttacttacaaaggagaaactaactttctcatgaaaaacaaaacagttcattaagaaacaaaactaacacagccactgggaactgaggaagagagactgtaacatgtgtgcaagcacacacacacacacacacatgcatacacatgctgtctgtagaatcatgagccaggattccaaatctgcatctttgctagacagagatcaagaactaaaacctttgggatggtgttgtctgggaagcaaaggagttggctagaggacttcctgaaattcctttaaactctagaatcctttaaaatatcaagggtgtgtaaactggggctaagtatgtacattctctctaaaggctcctagataacctttgagttcaattcagtgtggagtggggcctcccagcttatacttacctttctagacactgacttttatctgggatgagggagcagaatttggaggtggtagtcagggcgggggtagggaggggagtgggtaagggatagttgcaccagcccaacttttttggtcttaagaacaacctgaacgcaaattacagggtcttttgtggactagaaaaagccaggttttcaggatcacgtggcgtcctgaagttgttgctgcttgtcagggcatctgacctccatcttctctgctgaaagacaggcatgagtgtttgcagtgccggaacaggggccttcagataatttcattcatctggcatggcaagaccacagggagggaattacatgctagggtagagatgaacttatggacgtatcatgcaccttggtgtttgcccctgtagtgattctcactaccttcgctaccattggagggatgctcacccacctccttgggtgccatttttcttttttaaaagatgaaggcatttcagatgatcccttcatttatgttctactttcattctttggtttcaaaagaagtcctgatcttatgtcaaaggcaacaatctcttctctcaatctctctctctctctcactctctctctctggctcactctgtcacccaggttggagtacagtggcatgatctcagctcactgcagcctcgacttcctgggctcaagaaatcctcctgtctctgccttccgagtagctgtgatcacagttgtatgccatcatgcccag

SEQ ID NO: 2238 - DNA, 3816 bp, Homo sapiens; identical to SEQ ID NO: 2237

SEQ ID NO: 2239 - DNA, 4626 bp, Homo sapiens
gtgggtgctcagagccttggactcgatgacctacctctcctgcctcccacctgactcctgaagtaggggagtgtattaacagtcacaggcctcagtttacctgctttcagcctctgcccttcccgagagggttgaagctgacttgctgcatcgcagttttgtcctttagttcatcagctctggaactttccacttctggtgtttttggtttccaaacagaggattgaggacgtatgagagcaatgtttagagtaaggtcaaagatgaggtggatctaactgggccttgggcatgggcgcctacctgtcagactctgtccttctcagacagctgcccaggcaggagctgcctcttgggacagtgagtgggccatctccattgagagagtagggggacaaagggaaaaggcagggactgggtcactcctggggatgctgtttgacatagaccatgagggtcagccccactgggcctggctgacctggtagatgggtaggtctagggtatgaacatggatattagttggccagggtgtgagaacttgtgtgaaagggtcggcccctgggtgactcagtctcctagcaaactataaaagggaagtgactcatttccagccctgaacaagaactcctaaggctaggccgccagcacctgtctgggacgtggttagttattaacgctgccagtaagagtgtcatgggaaccaaacgcaggcctagatgcctggaggcaacttggcttttcacagcttgcaactgtccactcaccttcccttgctgtggctcctctctgcctgaccccaaatgcagaggagccccttgaactcttagttgctggtggctccccaggtgccacctcctgagtcctggttcctgcggctccgtcgaatctgcagtgaaggcctttgggaagcgtgggttatgtgggtccaggggtcccatcctcccgtggaggcccttgacctgaggatcactaactcacaccccaccgacttccggcccccaacaagggcagtgttcctcttgctccattctgctctgaagtcccccaaaccgcttcctggggctgcttagtgaaatacaaggctcatctctgaggacctctacagggctggatgggaaggactgatccacattcccaccaggaagtttagcagaacccccgcgtgccacctggaccccttggaaggacctggctcaggctggaccacctcttgagaggcaggagctctggatttgatcaagaattctttgctgagcatggtgcctcatgcctataatcccaacactttgggaggccagtgtgggaggatctcttgagcccaggagttcaagactagcctgggcaacacagagagaccccatctctaaaataataataataataaaataaaaaattagcagggcatggtggcatgtgcctgtagtcccagctacccaggaggctgaggcaagaggatggctggagcctgggatgttgaggctgcaatgaactgtgattaccccactgcactccagcctgggcaaaagagcgagagaccctgtctcaaataataataataataataatcttattttggagaataaagagacctctggatttgaggtgccatttgggtagaaagaaaagacgtttacaccgagaaatagtctgtgttgccctgaaggagcagagggatgcatcgctggaggtgacctacagttgaagaagactcattatgacagaccttgtccttcttccttgtggaaagtgtttcctctgctgctactgctcatgagactcttccccctccctgtcccagggaaccaaagggctttctaccacaccctttcttgccccccgcctcccatgtctgctgtgcctttgtactcagcaattcttgtttgctccattatcttccagccggatacagagtgaatagttaaccacacttaggtcaaataggatctaaatttttgttcctgctccgtgtaaagaggccagtgtttgtgtgttgcaagcagccttggaatagtaactcttctcatttgtttgggatctggccaccaagttccagaatgatacacggatcagtgcagaagttcatcaggctctcggaccttagggctgttggagaaggcttcagcagcagaactgatggtgaaggctcgtgttctccatcctcaactttctttgcttcgatcatacacaagaatacatttggaagggcaaaaaatgaacactgtcgttcattgcagccgtgttttgtgacacagatgcacagtctgctgtgaagaccttctctcaagtggcatttgggagtccatgccagatcatggtgcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattaaagtttttgtatgttgcagttgctgtgcttgtatgaccatttagtgaatttggtgtcttctaaatagaacagtggagtccttgtggacatctcagattcatcacaaaatgattgaggagaacctcttgaagatgtttagagctattgaaatttacagattgttgatgggttttcaccttttccttcctttcttgacacacagttacaggcattgtattccttggattcctacaggtgtcaaggaacagagatccacttacgttaccttcataaatcctggtttattcaaaagtcacagtaaggtagacaggaaatagtcccagccactgcctagctaagccttttcaaaaagcccaaggtcattcagcagatgcagaagcactagttggttttcaaagataacaagagcaataccatcatggtcgttttgatcctctgttcagcagcagggttcgctgcccctgactttagaattctgccatcgtgatgagctgaaggtcaccaacggtcccagtttgcccaggactaaagggtttcttgggatgaaggacattcagtgctaaacctgggacagtcctgggcaaactgggaaaactggtcaccctcctgggtgactcaacgaccatgcctctactttgttacttactattaactgactgatgctgttgactggtttagccaatctgcattcagagcttttgcgtctggttacttcgttggccttcaggcagccacagatggatgctattggatcaggcaccaatgctgaccaaatcaattgtttccaggatggtagggttgtatgaagaaccaactgagaccatgtccttctgagtgttgtggatggtgggcatggcaggccttcaaggtatcagggattcctctccaatacagccttacttacaaaggagaaactaactttctcatgaaaaacaaaacagttcattaagaaacaaaactaacacagccactgggaactgaggaagagagactgtaacatgtgtgcaagcacacacacacacacacacatgcatacacatgctgtctgtagaatcatgagccaggattccaaatctgcatctttgctagacagagatcaagaactaaaacctttgggatggtgttgtctgggaagcaaaggagttggctagaggacttcctgaaattcctttaaactctagaatcctttaaaatatcaagggtgtgtaaactggggctaagtatgtacattctctctaaaggctcctagataacctttgagttcaattcagtgtggagtggggcctcccagcttatacttacctttctagacactgacttttatctgggatgagggagcagaatttggaggtggtagtcagggcgggggtagggaggggagtgggtaagggatagttgcaccagcccaacttttttggtcttaagaacaacctgaacgcaaattacagggtcttttgtggactagaaaaagccaggttttcaggatcacgtggcgtcctgaagttgttgctgcttgtcagggcatctgacctccatcttctctgctgaaagacaggcatgagtgtttgcagtgccggaacaggggccttcagataatttcattcatctggcatggcaagaccacagggagggaattacatgctagggtagagatgaacttatggacgtatcatgcaccttggtgtttgcccctgtagtgattctcactaccttcgctaccattggagggatgctcacccacctccttgggtgccatttttcttttttaaaagatgaaggcatttcagatgatcccttcatttatgttctactttcattctttggtttcaaaagaagtcctgatcttatgtcaaaggcaacaatctcttctctcaatctctctctctctctcactctctctctctggctcactctgtcacccaggttggagtacagtggcatgatctcagctcactgcagcctcgacttcctgggctcaagaaatcctcctgtctctgccttccgagtagctgtgatcacagttgtatgccatcatgcccag

SEQ ID NO: 2240 - DNA, 4626 bp, Homo sapiens; identical to SEQ ID NO: 2239

SEQ ID NO: 2241 - DNA, 3537 bp, Homo sapiens
gctgatgacgcagaggtcaatgttgcttccggagcccaggtcgttgaagatgccagctgcgatggcttcgctcaccagattcttggcttcctcctcctgagaaacagaacggcggcaataatgtccccggccaaactagggcctgctctgacatccgcaatgtacgtccactagcagtgcgcaagacctcccgcgagacaggtgttgtttttaatgcccatctcacagatgaggaaaagatctcaaagtaccttgattatttacccaaagttcccgacccaggcctttaaaactttttatgcatgcaccgcctcttgaccacatcagacaatcaccacaaaacgatgggctgacagttactagagggttagtaacttatctttaaaagggccaggtagtaaatattttaggctttgtggccaaaagtctctaccacacctactcaactctgtcacgctagcacaaaacagccacacacaaatacattaaaaaatgggtataactgtgttccaataaaactctattagcaacaggcagtgggccagatctggcccactgactgcagtttactaactatcccctgatcaagaatgtccaacaatagctgaaagttacttgagaaagtcagcactgtaggaggaagaaactaacaccaaaacacaagccggtagttctggggaaatgctggcagaccaagggcgggacctcttgcccagaataatctctctctcctactaaggaacctataggttcactgaagtaatccattactttgaatcactctctcctttgccccacctttaaacacaaatccccatccctaatagttactggtgaacagatggactcatccctttcttatccgagaagccccatcacatgctatgtcctatcacatgctataccagaagctagggctgcagaggtggatgacgcccccagatccctgccccctaggggcttaagagtctagcaggggcacctgacccaagtaagtacaatgcagggtaaggctggctaaagagcacgtgaaaaggagctgggaacacagctggtcagcagagcttcagggagggctgaaggacaggctgcacacgaggcactcagaaaacagcagtgaaacagaaggcaggcagcaacggcagtggtactggacctggggaacaccaagttcaagctctatatacaacgaggacaaaaatgaaccaggctccctgaaagcagggaatctaacctgtgctacggcgccttcccagtccacgagggcgtgagagtacatacacatgcaagtgcactccagcgctcacccaagcaacacccttggagaaacacggactccaggcccaaatccagcctgagaccctcaaagggcagatccgctaacctcaagttttcagaagatctgaacccactgggggctcctgctcctctgcctgccccatgccagactaggattccagtgacataagcgccctctacagactcagaaggacagagaaggttctgctggaagtgggctcctcagcaaaccagcagataggggttcctttgatatttataccccaggttttttcactctcacgtgacatctatgtggggccaatgaagccaattcttcttttgtacatatgcagtcctgtaagaatgcattcaaacgggatccgctaattaggaattttctcctggaattctcaacagtctatggggccagaagctttccacaaaccagtgaaggtggcagcaaagaaagcctcttagacgaggagctggcagcagctgctatctagatagacagcaaaaaccaaccactaattcagcaaacacaacctcatacctaaccgcttccctttaaatggccttcggtgtgtgcgcacatgggcacgtgcggggagaaccatacttattcccctgttcccggcctaccacctctgctcccccttctcttctctaccatttaactgtctcctctgctttgtttcttatcactgctgctggtgtctagagccagccagcagtacctggcagacatcgcgaccctgcgggcagcgcttaggactgcacatttacatttcccaaatgatctgggtagatggggacaggtgaagacttggggaaacggaaatatacgaatgacatgagacatgcatatctagtgtcaatccattcgactgggcacaggacagcagactgctgacagtgctatgtaagattatgagtgatcctccctctattttgcaaacagtctgtaagtaactgataaaactttaaaatatgcaaattttaaaattatatagtttgatttactcatcaaattatcatgtatgctgttatttaagtatgaataaaggcttttttaaattgggaaaatacatcttttaaattcctttcctccccaccaattctagggaagatcattccttaaggaagaaaatctcaagtttctcacttttttccccccagtcccactccatgtctcatatacacatggctgaagatgttaggagatggaatgaaacttagatttatggagcacctatatgctcactaaaacaatcaatcaatcaacatctaccagcactctaacgtgccaagccctgagttgggcactttgatgatcatcatgttcacccctgcccccaaccatcttttgatgttggtatggtcagaaactctggctgacggtcaatgacttacacaaggtcacacagcaggtaaacaaaaaatagtaaaacaggcccatcaggccccagagccacaaggccgcagcaccacaccaactcgcaagtgaccttccttgggccgggggctcctcagctagtccctgactcaaggctgtgtcattcacgccccaccaccaaagagccttaagacctgggtaaatttaagaggaggaggatggtgtttgccggtttctctctgggccaaccagcagctcctctgatggtcactcccattgggggttggagggcagtgtttcccaaaatacccaagactaccacttcaagggccttcttcattctcaaccaagttagggcaacatctctacaatgcaacaccagatcaatattaagatctaaggtcttatttaacatatccctcccttaacaccccaaaccctcataatcaaaacagcgtggaaatgaccaaaggctctactgtccacccactacttacacagttaatgtctttaacacacacctatagggacctactatgttccaggaactgcttcaatgctgaatactgtctctgactacagtatttccatacacagaattctagacacgtatgcaaatatgctactgggcatattcatactgtgttttctttatagtggaatttcacaattaaacaacttttgtctttaacatgtgctaccaaatatttaagaaaactatcaagaaaaaccacaaactaaaggcaagaggtggggaaaacaccacatttgtatctgtctccagcccacaataagcgcaagaagcactgtctcttcctttaggattagttcttcgtagggaaactgcacctcccttttct

SEQ ID NO: 2242 - DNA, 3537 bp, Homo sapiens; identical to SEQ ID NO: 2241

SEQ ID NO: 2243 - DNA, 745 bp, Homo sapiens
caagacggtccgatgtggcctggcagagggaacagccacaccctgttccagttgtcccggcttcaactttgggtgccctgcagaatgggcattgatggcgccccacttcacagaggaaaagtaaggaggtccatgagactggggcagcagcaggggcaggtacagagcacctcagccgcctctccacctgacagcaacatcaaagccgaggccaaggcgggagggcccagagtgagacacctcttccagacaagacttggtcgctgcctcctcctctgtcaccctgcgacacagcccagagtaccaggcggctggagcactgggggacacccggacagaaccctccctggaccaagtcctccaggaacgggatgaagccattgccaagaagcaggcggtggaggcggagctgcagagatgcaaagccaggctacacgccatggaggcccagctgctggaggtcctggaggagaaactgaggctgaggcgggagctggaggcctgggaggaggacgtgcagcagctggtgtggcagcaggtccagaatcagctgcagagagaggccaagggtactcggggagcccacgtggaccctggagctgccagcaccccccgatccagattctccctgggtcggggacgttggtggtgacacagacctcagcccaggactttgggagtagtgtctttattcattaaagcctgaggtctgaccacccctgtaaaacctcgtgcccacacagtg

SEQ ID NO: 2244 - DNA, 745 bp, Homo sapiens; identical to SEQ ID NO: 2243

SEQ ID NO: 2245 - DNA, 745 bp, Homo sapiens; identical to SEQ ID NO: 2243

SEQ ID NO: 2246 - DNA, 10365 bp, Homo sapiens
gagaattcctacgggtgggtttccgaatattgtgttcaactttttgaaagcagctcgtgaccccgaaactgcatcccccggagccggggacccaggcgccgggcgggcgggtgaacccggtcagtcccctccccgtccccgaaacccccgcctccgggtggtggcgacctggcctctccctgccactgcccggccagccccggagggaggctgggcaggtgctgcgggctctgccgaaagcgctgaaataaaaaaccatcgccactcagggagaactgaggcaagtggggctgagactctggcgacacccccgccccccagcctctgccccagcgcctgccgccctgccgccctgccgcaccccgcctgcttgggtggcgaccgcggttccggaacgcgaagcagggcagagggctgcagagaggcgtgtagctttgtgcgccaggacccggtggggcaggtggcagccccgggctgtccgcgcctcccagcagagccgagctcggcgccgcccaccgagcccacctcgcggtccagccgccgccagcgcctttcggctctggcctgaagcagtactcccgcctcctggagcgggtaagttgagagtccggagagcagggcagggaggcggggcggctggtcccagagcggagggccggactggctccccgccgggctgggggcgcaggctccataggatctcagtcgaggggttctgagtgcgtgtttgggtgggaagcagggctgtggagcgccagagcttcccctcccaaattcccaggcgctgggcactggggagtggagcagaagcagagggaccttgggttccggggcccagcggccttccacgctggtctgggaaccaagcaagccctagggcagtgcgaggactgggaagggaccctgggggaccgctagaggaggtggcgcgtggagggcgcctgcaccctggggtcgctcagagcggagagtctcgggtggataggtcagcttgcagatcctctaggtctcttctctgctctctggccgctctgattgcgggatctgggacttggcgcccgtacaggccgggtcacctgtgcagaacaaatttgctgccatcatccccgcttcaatcctggccccggcgatctaaaatatcgccttcaggtggggcagggagaaaagatgtctttggggtttaaatagtgttctccttgtacccggaccaactggcatttatttacaaatgtcacccgccaccccagcactgggaaagtctcaaccacatctggagaacgcccgagagacctcccactctctccttgttttgggttacagggaaagccaacgggtctgcaggcctccgggagacgaggatccggagggttggggcagctgcacccacttggccttgctcagctctaaacagccgaccaggaggccgggggaaggtttgccctgtgggggcaacgccccttccggctcccaggatgtcgggaggcggaggctggccgggtggcccgtagtctgggcctccccgcaagctgcaaactgaggcgcttggcgcgggcggccagggagggcgcaggggagcgcagcacgcaggcggggaggccgcgaagcccttcaaggaccccgattactttcctttgaaaaacaacaacaacaactgctccctccccgcacccccgccccccgccttagcctccggggactggcgctccaagcaattgtcgccccggacagtaaacacagctcagttgcctcaactttctccatgcataaaagttcctggcgtgcggggaaatttgaatatttgatcagcccctttgagtgaccctcattagtccggcgccctgctaaggccgggcattgcaagaaagctgctgggctcggcatttgtacgccttgttagcgcagcttaatgaagccgccccgacggctcaaaggcggcctcaggggccggcgacgcgcacctctcggcaccctgctctgcctaatgagccccgccgccctctaaaggaccctccaccccccacattctgaaacaggggaagtttggctctgtcttgaaccacggcacctcccactgccaggcccaggagggtgggcacaaacccagcctagctgcctgcagttacccattcccaagagagaggggctggagagttgggaggtgtgagccatactggttgggggcagtgcagggaggggagcgggtggcaggagaggcttttgctgtctcaggatccagcccagggagtgcactgccagcctctcccaagtggaccaattgcaaatcaattagtcactccagttccttaaaggtgcatctggactaatgctggggtggctgagggtcagccttccatcctcctatcaccttaggttcccttggcttccactgcccagaggccacacacttcttcccaaggttccccttctgaacagccagacctggtgtgccaggacttggatttgagaaagggtgggcagctcccctccctaacccatcattgcctccaccattcacagagcccagtcacatgttatgacaagtggcagtagggaaggcaggggaccacagcccgtcctgcactccccctcaacagaggtatcccttctttggcttctagtcccagggaggcctggcaaaaaaagtgctataggcaagaccaccctgcaagactggcctggcagcctggcagagaggcagagagccagagccctggaaggaagggaaaccaaagcagtcatctacttcaccttttcttagtggggcagctgacatggctggccagtaaatataagacaccctcttaaaaattgtgcttcagtcctcaggaagtgtagccttccttccctttctgtctcccctctcctctgatgcccttttccctggacagtcggagctcaaggtccttcactccctccttgcatacacagctcttgggcccttaagggttacttttggggggaattaatgctctgggcttgggaagcaggctgctccaaatccacactcaggactttctggaccccaccccccaacacacaaacacaaacatgcccaggatccctcagacacacagtgggcctggtcaggttggtaacctcaggaccccgtgcccgcgtgagcgtctctgggaggtcgtggaaaggaaccaaaaggccaggtaggccctgggatacagagagccctccaagtccatctggtttgcttctcttcctttctctctccctagctccgctagcatgccctgccccatttcccatcacataaccccctaacttaaccctaaactggcaatctttaggcatcacctctgagctgggcaaaggcggtgcccgggccttgatcgacccagagggctaaagtaggggcggggaagggaggggtgtgcgctgctggtgagaaaggggacctgaggcgagggtagaactcagccctgtggcctcgaggccaggcccaccggctgctcaggggaggaggcgaggggagggggctgggagtccgcaggcatcggtcggggcagcagggacctcaggcgtcggcgtggggggctagatccggaggagaggggaggggaggcgggggtcgggggatcgcgcagggcggaggaggggtgcagctctttaagagccacacggctggcaggagaggcgcgcggcccggtgctggtagagcactgaccccgaaggggatttagcgggaagagagtggccgggctctgggggttttgtccgagggggccgggagaggccgagacacaagaataaggagcggccgcggcatgaaaggcggcgaggagaggcagcactgctgctcttgacttctgagcagggcttagagagcctgccccggcttaagccgagctgctggtgctgaccctgagcgccgagtccgcgagctctgagtccggagcctcccagccgtggagccgtgggatgaggggggcgttgggggacagggcaaagtcgatcttggttgtacagccgcccgatcctagcgcggagctgcgagcctgaccggccgcgtctggcatggtcagagaaagaattttcttttcccaactccggcttttggttttgtgtgtccaccttgcgcaactccggagccagccgaccccacatggattctcaacaggtggccgggtaagtccgtttaaagaattctggttatatggtcagcccctccccgaccttcttccttttcccctccctcttccccctttggctgggccgggttccccgtgctcctcccgcaggcgacggctggggtggtggtgggggaagaggcgcccttcccctgggggtctctgggctccgagttgcagcccaggaagcctggcgggcggcccccaaggagttccacccggtacccccaagtcccgatcactcttagctccttggtctgggccctggcgccctgagagggggagggagaaagaacgcgcagcagcacctcaaaagccgaagtccccgggaagggggacaggggacccggtggccgggcagcctttgtgtgggggtttacggcggaaacagaactattcttcttgtgtgagaggcccgggatgtggccagggggagcccgcgccagccgtacaatagccggcagaagagcgcctcagcagccggggtaggagtggggtagggtggggtagacctgggtgggggaggggagggcgagagaagagggaggggaagcagagaaaggcaaaggcgagaaatccagggcgtccgagtgaaaagtcggaaaatgtttccagagcgcgccacaaacaggcgcgcgcgcgcgcttgcgggcgcatagtctctctgtctctctctcgcacacacacaaacacactcttacatgctcacactcattccacacatggagcccacgcacgcggttcctagtcgtgcagggtcgcatgcctgggcacccaaagtgaacgcagagtagagccgccctcccacccccaccaacggagagccctcccgcccagccacaggctccccgactggggagctaggagggcccccggggctggggcacagggaggatcttacctgccgaaaggtaagggaagccgggagcacggagcagcggcggataaatattcattagtaagtctctccttttaagccgcgcggtgcgctctctggctcctatctctctttccctccctccctctgtcctcttgtgagcctctctccccctctcgctctgtcttccccccaccccttcctgcgaaatgccgggtggatcccagtatagctaacctgttgggaagcctgagccgcgggcagcgcctccacagctgtttgcttttgctcttggggcgcgcgtttccccatcctctcccctctctccttttgcccagcccctctccccctcctaaattactacatcattagctttatttggtggggggacagctcagccaaacgcacctccctatagcagggtgaaaagccgctgctccccgaggcagccccaactccacccctacccctgcctcacccatctccatgtccctacccagttttgtttatttttcttctctctttccatcttcacttccgtcctgtaccgacccaactcccttaccattcctcccttcctcgtcgctgccaatacggatcccagacggggtcggggcagggagatgccaagtgagtaggtccaatatgccaaggtcgggactccaccctgccatgggcgtgggggtagtcctccaggtccccctttcccacgtaggctttccaccctgaccctaagtgggtaccggggcagcttgggccttgggatcagagcaccagggcgcacagcaagggcctcagccctccaggcctcagcgacctggagcctgggtcctttgacccggtctgggagactgcatggcggaggggaggtggcttcactttgtacgaatgctcaggagagacacaaccaccgaccatcggactgacgttctcccttttcaaacaaactgaccttaagtcagcagtaagtctgcatcattctcacgagaaaacacatctacaagattctagaaatgcacaaggaaccgcttctagtcgcgcgtgaacacgtgcacacacaccacacccctcacccccacacacccgaggccaccgttcccgctggcctctgaaacctgtaggcgcgcaggcccgaaaggctaattctagcggaggaatacatcgcaaaaccgccccaggagagccctggccactcttgttggcccccattcttccagatccaggcctctaggatgccccagggaccctgaaggatggtgaggccccagggtgcttgggggtggtccgggaagctcactctggcagcccgctgagcgctgcgtgttgaggtaggagctggaggaggggccaagggaggcgggcccaggccaattccaagttacaaatacagctgctcctgcgaggcctaggagagttttgccccaaaacgtgcatatcattcgccccgagacgccatgacctccccagacatagccccagggcgcactcgacctcgaggtggcttgggtgatgggagcaatcgagagccaggagacgacctcgagacctccgcccgcccattcagcccggcccagccacagtccaccgagagacgccctagatgatggtcctatccttcccaaagggtggcaaggcgcaggatcgcggagggtctccctccttgtcctgaaaggttaagaaattgggcagatgaaggtatttaaaagaggcctagagggccctggggccgaaagccctatcaacctcacactccacccaaagtcccgcgtttgcacgtgcacacctccttctccccatgcagacccagggggtcgcgcacgtttgagctcagactcaagctgagtcacctgactatgcctggaacgtacaggcaatcgtaccgaatacacatgggagaattaaaggaacactacgggagaattaaaggaacactaacaggaatttgaggaataaagaagtgcccacaggcataattatttgaatacacgggtgcacaccctgttgtccagatgcagacaaaagccacagtgcctgcgaggagtgaccccaaccacaagggcagatgtacaggaagccgtgaacgggagagttcgccgaatgaggacgcaggccgcaaggccaagggggcttcctgctagagggacgttggctcggagggagaaactttgttgagccgactgggtgaaaggtttcaggtcaagtcctggccactagaaagaaccaaggcctcatccactcagagccaaccttttagccttcctctcagctctgttggagatacccagaaaaggacaatccaggaaagattcattttgaccgagattgtttttattgtttatttcttattatttttgacctaggggtttgcattctgaaaaaggatttgggtggcgcgtatgcaagttctcactcactgctgggagattcataattcttaataggaacattcagctctaaccatggcctgagaagctggagggcccttattttgcccctttcacccttcttatcctaaacttgatcattcaaaaggatccacaccctcctgcccccaactccaccccaataccctgtatgtcagatatgtttgcagaagaacacacttcaaagtaaaccaaattacatagtttatttaaaaaaattttttgtgatatattgggaagtcctcaccccctgctcccctgtctctggctgagcacggtgtccgggcggagttggggggttgccaagaggagtttccagagtggctcttgggcaaggcctgagaaactactctacataggcttgtttttagtgtgagctccctttgcctaaccagttctagtggctacctcccggtttcctgcagaagaggcaggctccctgggagcaggggcgccctcgcttccacttcacctcctttcctaactttctctcttttgagcacatcttctgagcctcgctctctcatctgaaagtggagtgtaagtccaagaagattcatttagacaaagaaggtggaaaaaaaggactttctgggccagcaagtcggatgaccaccctccaaggggcagaggagggcccattttgtgaagaagaaatcaactacccggaaaacgccacaggaggacatgtttctgcagatgtagttgccctagaaacagaagagtatgggggtgtgaatgtcttctcttttgggggcaaacactatgtccttttctttttctagatacagttaattcctggaaattttagcgagtttgttcttgtggatattttgaacaataaagagtgaaaatcactttggagtcacttaatcttcgttagaagggcagtttcttccagggccattttctttcaccagatttgtttttcctcgttcccaaatgaggtagttttaaaaatcaaagtccacttgctaactcacctgggaaagagactgcgacagaaggaagagaagtaaatagacatcactctcaaactaaaagtgtaactttcattcctggcagctgagattcagaacacaaagaaacaaactcgtttacctttgagtatttcccccgtttgggtaatttatctagagctttcccaacaattaatcacagcatcttgaagttggaaatgtatgctattattttcagccttacaaggttcgtcaaactctgcttctctggttttaaaaactgtttgcttctacatagctatgcccgttgcaacatttatcactcaagcagaaaagcaactcgttttctcacagcctcaaatgccccgtgtacagtcactggagcgaatttatttttctctgtctttcccaaatgcccttgtcacctctgccagggccacaagactcggggcaaaacttcggaggtttgagacctcttgagtgtgtggatcgctattattgttagtttttttgttgggagaaatcgtgctcggtgatcgcgtgcggttgtctctctctaagccgactagggttgcctgcgccttcctcagcagaaactcctagaggaagctaaccatttccgctgcccggggcaaagggctgaacggtgttgtcgggtctagggttggggtgggaaagtgaggacggtatgcggatcggggagggggcagtcatcatcttcaacaataaattaaaataacctgatacccctttaatcccttccatcaacagtgtcaacgcgctagagaggccgtctcacctccaaaggtatcttcactcccggagggcccgggctcccagccgcagtcccacactgggcccgcgcgccggatacgaggtgctccgacggcaaaaatcccatacatttttaactacagtgattactaaattaatagcaggcactaagacagatgtcaaaacgtcttgaaaatgtttatctgtgaataattgagaaggtggtgggacgcattatctgattgtgtaatgaaatatgtatgaggaacagctgtttgcaacagtcccctcccgccgcctcctcagccaaggcccttctctaggaagcaggagtcgcggcgaagttggtcgcctacttccgtccacttgggagccctcgcggcccctccccggctgctggcagaatggtggctccagcgcgccccagagtagtccggtttcccgacggacaacagcatggagtcctcctcagcctcgctctgtgggctccgtgcctgagtgaggctccaccgccggccgcgctgtccctcgcgccttcggggccggccgcgggctcggcctgcggggaccgaggggagcactggcccgggcggccgcggaggcctgacgtgcgcccaccgggcggtgcggcctgctcggaggcgaggcccgggagccccgcggctcagcggggcgggcctggggtcaccgaggggtgacggggctccggagagggctttgttcgcgctctcgccacactgcgcacttccttccagccccctgcggcccccaccccaaacctccgcgcccccgccctgtttgtttttccagccccgcgccctccaccccaacacgcaaacagccctcggggctgcgtcagcggcctgaggccgtggcccaggtcaggcctgagtccaaatggggccagcacggcgagccctggccccgcaggaagcggtgtgagggggagagggagctccagggccttcctggcgcgagaggggcaggcgaaggccggggggaaggtggtccaatagggcgcacggcctgggcgggcggcgaaggcccgaggcctgggctcggaagggtgcgggcggcctgcgcggctgcccagcccctgccgctgtccccagccccagctggacaggggaggcgcggcggagtgggggtgaggaggacgccaggaagggccccatcgggcctgggccttgaag

SEQ ID NO: 2247 - DNA, 6960 bp, Homo sapiens
tccgaatattgtgttcaactttttgaaagcagctcgtgaccccgaaactgcatcccccggagccggggacccaggcgccgggcgggcgggtgaacccggtcagtcccctccccgtccccgaaacccccgcctccgggtggtggcgacctggcctctccctgccactgcccggccagccccggagggaggctgggcaggtgctgcgggctctgccgaaagcgctgaaataaaaaaccatcgccactcagggagaactgaggcaagtggggctgagactctggcgacacccccgccccccagcctctgccccagcgcctgccgccctgccgccctgccgcaccccgcctgcttgggtggcgaccgcggttccggaacgcgaagcagggcagagggctgcagagaggcgtgtagctttgtgcgccaggacccggtggggcaggtggcagccccgggctgtccgcgcctcccagcagagccgagctcggcgccgcccaccgagcccacctcgcggtccagccgccgccagcgcctttcggctctggcctgaagcagtactcccgcctcctggagcggccgcccgatcctagcgcggagctgcgagcctgaccggccgcgtctggcatggtcagagaaagaattttcttttcccaactccggcttttggttttgtgtgtccaccttgcgcaactccggagccagccgaccccacatggattctcaacaggtggccgggtaagtccgtttaaagaattctggttatatggtcagcccctccccgaccttcttccttttcccctccctcttccccctttggctgggccgggttccccgtgctcctcccgcaggcgacggctggggtggtggtgggggaagaggcgcccttcccctgggggtctctgggctccgagttgcagcccaggaagcctggcgggcggcccccaaggagttccacccggtacccccaagtcccgatcactcttagctccttggtctgggccctggcgccctgagagggggagggagaaagaacgcgcagcagcacctcaaaagccgaagtccccgggaagggggacaggggacccggtggccgggcagcctttgtgtgggggtttacggcggaaacagaactattcttcttgtgtgagaggcccgggatgtggccagggggagcccgcgccagccgtacaatagccggcagaagagcgcctcagcagccggggtaggagtggggtagggtggggtagacctgggtgggggaggggagggcgagagaagagggaggggaagcagagaaaggcaaaggcgagaaatccagggcgtccgagtgaaaagtcggaaaatgtttccagagcgcgccacaaacaggcgcgcgcgcgcgcttgcgggcgcatagtctctctgtctctctctcgcacacacacaaacacactcttacatgctcacactcattccacacatggagcccacgcacgcggttcctagtcgtgcagggtcgcatgcctgggcacccaaagtgaacgcagagtagagccgccctcccacccccaccaacggagagccctcccgcccagccacaggctccccgactggggagctaggagggcccccggggctggggcacagggaggatcttacctgccgaaaggtaagggaagccgggagcacggagcagcggcggataaatattcattagtaagtctctccttttaagccgcgcggtgcgctctctggctcctatctctctttccctccctccctctgtcctcttgtgagcctctctccccctctcgctctgtcttccccccaccccttcctgcgaaatgccgggtggatcccagtatagctaacctgttgggaagcctgagccgcgggcagcgcctccacagctgtttgcttttgctcttggggcgcgcgtttccccatcctctcccctctctccttttgcccagcccctctccccctcctaaattactacatcattagctttatttggtggggggacagctcagccaaacgcacctccctatagcagggtgaaaagccgctgctccccgaggcagccccaactccacccctacccctgcctcacccatctccatgtccctacccagttttgtttatttttcttctctctttccatcttcacttccgtcctgtaccgacccaactcccttaccattcctcccttcctcgtcgctgccaatacggatcccagacggggtcggggcagggagatgccaagtgagtaggtccaatatgccaaggtcgggactccaccctgccatgggcgtgggggtagtcctccaggtccccctttcccacgtaggctttccaccctgaccctaagtgggtaccggggcagcttgggccttgggatcagagcaccagggcgcacagcaagggcctcagccctccaggcctcagcgacctggagcctgggtcctttgacccggtctgggagactgcatggcggaggggaggtggcttcactttgtacgaatgctcaggagagacacaaccaccgaccatcggactgacgttctcccttttcaaacaaactgaccttaagtcagcagtaagtctgcatcattctcacgagaaaacacatctacaagattctagaaatgcacaaggaaccgcttctagtcgcgcgtgaacacgtgcacacacaccacacccctcacccccacacacccgaggccaccgttcccgctggcctctgaaacctgtaggcgcgcaggcccgaaaggctaattctagcggaggaatacatcgcaaaaccgccccaggagagccctggccactcttgttggcccccattcttccagatccaggcctctaggatgccccagggaccctgaaggatggtgaggccccagggtgcttgggggtggtccgggaagctcactctggcagcccgctgagcgctgcgtgttgaggtaggagctggaggaggggccaagggaggcgggcccaggccaattccaagttacaaatacagctgctcctgcgaggcctaggagagttttgccccaaaacgtgcatatcattcgccccgagacgccatgacctccccagacatagccccagggcgcactcgacctcgaggtggcttgggtgatgggagcaatcgagagccaggagacgacctcgagacctccgcccgcccattcagcccggcccagccacagtccaccgagagacgccctagatgatggtcctatccttcccaaagggtggcaaggcgcaggatcgcggagggtctccctccttgtcctgaaaggttaagaaattgggcagatgaaggtatttaaaagaggcctagagggccctggggccgaaagccctatcaacctcacactccacccaaagtcccgcgtttgcacgtgcacacctccttctccccatgcagacccagggggtcgcgcacgtttgagctcagactcaagctgagtcacctgactatgcctggaacgtacaggcaatcgtaccgaatacacatgggagaattaaaggaacactacgggagaattaaaggaacactaacaggaatttgaggaataaagaagtgcccacaggcataattatttgaatacacgggtgcacaccctgttgtccagatgcagacaaaagccacagtgcctgcgaggagtgaccccaaccacaagggcagatgtacaggaagccgtgaacgggagagttcgccgaatgaggacgcaggccgcaaggccaagggggcttcctgctagagggacgttggctcggagggagaaactttgttgagccgactgggtgaaaggtttcaggtcaagtcctggccactagaaagaaccaaggcctcatccactcagagccaaccttttagccttcctctcagctctgttggagatacccagaaaaggacaatccaggaaagattcattttgaccgagattgtttttattgtttatttcttattatttttgacctaggggtttgcattctgaaaaaggatttgggtggcgcgtatgcaagttctcactcactgctgggagattcataattcttaataggaacattcagctctaaccatggcctgagaagctggagggcccttattttgcccctttcacccttcttatcctaaacttgatcattcaaaaggatccacaccctcctgcccccaactccaccccaataccctgtatgtcagatatgtttgcagaagaacacacttcaaagtaaaccaaattacatagtttatttaaaaaaattttttgtgatatattgggaagtcctcaccccctgctcccctgtctctggctgagcacggtgtccgggcggagttggggggttgccaagaggagtttccagagtggctcttgggcaaggcctgagaaactactctacataggcttgtttttagtgtgagctccctttgcctaaccagttctagtggctacctcccggtttcctgcagaagaggcaggctccctgggagcaggggcgccctcgcttccacttcacctcctttcctaactttctctcttttgagcacatcttctgagcctcgctctctcatctgaaagtggagtgtaagtccaagaagattcatttagacaaagaaggtggaaaaaaaggactttctgggccagcaagtcggatgaccaccctccaaggggcagaggagggcccattttgtgaagaagaaatcaactacccggaaaacgccacaggaggacatgtttctgcagatgtagttgccctagaaacagaagagtatgggggtgtgaatgtcttctcttttgggggcaaacactatgtccttttctttttctagatacagttaattcctggaaattttagcgagtttgttcttgtggatattttgaacaataaagagtgaaaatcactttggagtcacttaatcttcgttagaagggcagtttcttccagggccattttctttcaccagatttgtttttcctcgttcccaaatgaggtagttttaaaaatcaaagtccacttgctaactcacctgggaaagagactgcgacagaaggaagagaagtaaatagacatcactctcaaactaaaagtgtaactttcattcctggcagctgagattcagaacacaaagaaacaaactcgtttacctttgagtatttcccccgtttgggtaatttatctagagctttcccaacaattaatcacagcatcttgaagttggaaatgtatgctattattttcagccttacaaggttcgtcaaactctgcttctctggttttaaaaactgtttgcttctacatagctatgcccgttgcaacatttatcactcaagcagaaaagcaactcgttttctcacagcctcaaatgccccgtgtacagtcactggagcgaatttatttttctctgtctttcccaaatgcccttgtcacctctgccagggccacaagactcggggcaaaacttcggaggtttgagacctcttgagtgtgtggatcgctattattgttagtttttttgttgggagaaatcgtgctcggtgatcgcgtgcggttgtctctctctaagccgactagggttgcctgcgccttcctcagcagaaactcctagaggaagctaaccatttccgctgcccggggcaaagggctgaacggtgttgtcgggtctagggttggggtgggaaagtgaggacggtatgcggatcggggagggggcagtcatcatcttcaacaataaattaaaataacctgatacccctttaatcccttccatcaacagtgtcaacgcgctagagaggccgtctcacctccaaaggtatcttcactcccggagggcccgggctcccagccgcagtcccacactgggcccgcgcgccggatacgaggtgctccgacggcaaaaatcccatacatttttaactacagtgattactaaattaatagcaggcactaagacagatgtcaaaacgtcttgaaaatgtttatctgtgaataattgagaaggtggtgggacgcattatctgattgtgtaatgaaatatgtatgaggaacagctgtttgcaacagtcccctcccgccgcctcctcagccaaggcccttctctaggaagcaggagtcgcggcgaagttggtcgcctacttccgtccacttgggagccctcgcggcccctccccggctgctggcagaatggtggctccagcgcgccccagagtagtccggtttcccgacggacaacagcatggagtcctcctcagcctcgctctgtgggctccgtgcctgagtgaggctccaccgccggccgcgctgtccctcgcgccttcggggccggccgcgggctcggcctgcggggaccgaggggagcactggcccgggcggccgcggaggcctgacgtgcgcccaccgggcggtgcggcctgctcggaggcgaggcccgggagccccgcggctcagcggggcgggcctggggtcaccgaggggtgacggggctccggagagggctttgttcgcgctctcgccacactgcgcacttccttccagccccctgcggcccccaccccaaacctccgcgcccccgccctgtttgtttttccagccccgcgccctccaccccaacacgcaaacagccctcggggctgcgtcagcggcctgaggccgtggcccaggtcaggcctgagtccaaatggggccagcacggcgagccctggccccgcaggaagcggtgtgagggggagagggagctccagggccttcctggcgcgagaggggcaggcgaaggccggggggaaggtggtccaatagggcgcacggcctgggcgggcggcgaaggcccgaggcctgggctcggaagggtgcgggcggcctgcgcggctgcccagcccctgccgctgtccccagccccagctggacaggggaggcgcggcggagtgggggtgaggaggacgccaggaagggccccatcgggcctgggccttgaag

SEQ ID NO: 2248 - DNA, 1081 bp, Homo sapiens
tcctacacatacatattactcctacttcaaataatctccatgacatacaattgggtcaaatgccaataccagaaaaaccggtgactgttattttgtctgacatttccactttctctaaacaataacccctttagtacgaaccatctttgccactgtaggtcttagctaagtatggaataaatcaggattccaagcccttctcgtgtgactaatactttattaaagactgacagcaatagttctggcagtgtggctgggcacttgaattttggctccagcagttactgttatctaaccctttgctactgtacatgtggtcacatcagaccaacagcatcatttgggaggttattaaaaaacgtatctaggggccaggtgtagtggctcactcctgtaatcccagcactttgggaggctgaggcaggattgcctgagcccaggagttcaaggccagcctaagcaacatggcaaaaccccatctctaccaaaaaaaaaaaaaaaaaaaaaaaaaaaaattacaagaatcagccaggcatggtggaacacacctgtagtcctggctacttgggaggctgaggtgggaggatggcttagcccaggtcaaggtgggggtgagctatgatggtgccattgcactgcagcctgggaaagagaccatctcaaagaaaaaaaatttaagacgtgtctgaagcctcacctcaagcctatagaattagaacctgcattttgtttttaaatttgagagtcaggggtctccgtcacccaggtggtttcatctaccagcctcatacatccaactttaactggatcaagtatttaagtcagctcgacatttaaaatggaaacttcaattttattaacaatttacggcaatagacatttacagaacaaaaataagacagttccaagacaaaggagtgtaaaagtacagcacacaggttaatactcttcaccctcatcctctccgtcagcactatctgctccaacctcctcataatccttctcaagggcagccatgtcctcacgggcctctgaaaactcgccttcctccatcccctcacccacgtaccagtgaacaaag

SEQ ID NO: 2249 - DNA, 1081 bp, Homo sapiens; identical to SEQ ID NO: 2248

SEQ ID NO: 2250 - DNA, 1081 bp, Homo sapiens; identical to SEQ ID NO: 2248

SEQ ID NO: 2251 - DNA, 1081 bp, Homo sapiens; identical to SEQ ID NO: 2248

SEQ ID NO: 2252 - DNA, 1081 bp, Homo sapiens; identical to SEQ ID NO: 2248

SEQ ID NO: 2253 - DNA, 1081 bp, Homo sapiens; identical to SEQ ID NO: 2248

SEQ ID NO: 2254 - DNA, 2232 bp, Homo sapiens
tagaggcctcccttccgaggaggcggtgctggggcgggcgcaggactgcaggctggggctccgctccccggcgggagcccgcgcgtggttcccagcgaagtccccgcgcggctgggcccagcgtgagtattctccgcccgctgtcctccccctggaggcggcagcgcccgtttatttgaggcttctaatgtgaggaaaaacacggaatgacaagtgtgggaaagagcaagcactaaattactgtcagaaaaataaacggagtagcacagtgctgctcggtgatttacgggggcaattagtcaccaccccacggcgctgctgaggacagcacggcagcagacaagtcaggcccatgaggaagaagaggctttgcactgctctccagacaacttttcaaacaacaagagaggatatttgagcacattaggttttgtgtcttcattctgggtacctactcttcatattattctaccaacttaatacataaacatatttttagcacaatatgaacctgttctatgtgtgtttaaaagcctccagcagcaacttttttctctcccactgtccaaagttgggttttccccatcccttaaaaaacaaaacaaaaaaacctttcttcactccaaattgtccccctggtgtgtggttttggtctttctcattacttcttgcatcttgctacatgttctgcatttgctcagagccactgggtgctaaggaatttggtctgctgctcctctgggaaagtttggtaagctggtacaaggaggtgatgaacaaggctaaatgaaaatcatacataaacttcccaatatttgtgaacatgttctttaacataccatacatagtttctatgtatatgtaacatagcaaaacaaacttgctaaggtataattaattggtatgcatgccttcataaatattcaccatcagaagaaacctagaatgaaaggttgtgaaagaacccaggaatgagaaagactttattgactaaaggccatgtctatgtaggggcaacaatgaagctgtgggtgagcaaatgaagcttcatcaggagtttagtatccttatgtagcattacctaagaatgctaccatagtaaatttctgaagtactttacctgttacaaagaacgtttgtaatctccttttcttatttgatcttgccctggctttagtcaggaacacctgctcagttagaaatgtattcggtgggtatgtacgcagttggagaatgtgccccaacacacgccgcctttggcctgtatgttggagtcctagagaggcagacaatgttgatgagcttggtaccagcatggtgcgccattcatccggacacaatttctgataaagagggtcacaactgggagaaacctcagattctacttgcttctcttctccacgttattagactttttttcccctcttgaattttataagcacactccttttaaaacaattaattaataacgagcactgggatttgatgtagaattgcgtatttgtaactgcaatggcactggttttcaactaccctgtaacaaggaagcaattctaaccagcaaaagaggcagacgtgtttctgtgcaacatcacaggcgtgtgaaattgttcagatattgagatatcaggagtgatataaattggaaatttaaccaaaaatattttccatcagtgaacaaagccgattttaaagtgcctcttgcatttttcagatctttctctttctttttcccaaagtcacattgtagtttctgataaaggaacacactgggaaaactaagcacatatttaatcaatgaaatttaaggtgtaaaaattctgcatttctgacaaatttaatgttcacttttttcttgatttaaatagagcattctaaaaatattacccctataggggataaatttttatatgcatgttatttttctttacaaagtgtgggctagtaaagagtgaaaaagaccttggctattgtacttatttcttgaaagaaataatagcatcttaatgactggattcaaatctctgcttatcacacaacttccgtacagttcaaagagaggacttggattgaatgaaaacagagagctggggcttcctacattcccctgtgtttgtgttcatacagaatatttatgcaatattctgacttggccataatctgtaattcctgcctattattctcagttgcaactataaattctagattaatggttataattttggtaaggca

SEQ ID NO: 2255 - DNA, 1109 bp, Homo sapiens
tgggcagctcaccagagaggccagaggaggcggcaggaaggtggggtctctccagccaggggcttcctgaaagagctgccttctgagcaggccccccaggctaggaagatgtgcacctgccgagctgggcaggagagggtggcccagtggaggacccagcatgggcagaggtttggaggtggcaggtcctgagggaagcggaaggcagccaggttgtgacagcctgtgaggacctcttggctcccggagccttctctctcctggaatagagatgacaccgtgctgccattgaactcaacccgaaaaaatgatctgttgcaaagctcacaggaaataatggagcaatgttacacgataaactgtaaagtgtggtgagcatgtgaacaagcgtccaggacccagcgaagccccaggctactgggctaggcgtcagatgagaagaggcagagggcaacctcctgtaggatctgaggccttcatgtgctcagcccatggctgtcgtcacggtgacgtgtgcatgcgatgtatctgggccatccttgttcttgaacgcgggcagtgagtcccacggtgatgtggcatgtcacgagctgaaggaggggcacctgcattcaggcttgcgaaccagcgagacagcctttggacctttcggagcctcactttcccacactaagaattggagtggaattcccaaggtgctggaggttgaaaggcattgagaatctaaaacgctttgcagacagcaagaccctctgtgtaagttaagaatgctcactcagtcccagcaggtactcagagggatccttttatttctccagaacattctgcaggagaggggacctgtggaatgtagttgagtcctgagggtgcggccccgtgatgaaattagtggcctgataagaagaggcccagagaaccggctctgtctctgctctctgtcgcacgaggaccccacaagaagacggccacctgcaaacagccattgaatctgccagtgacttggtcgtggagttccagcctccagaactgtgagaaataaatgtttgcgatttaaaccgcacagtctgtggtgttgtgttggcagtctgaactgacggagacagcatctg

SEQ ID NO: 2256 - DNA, 1109 bp, Homo sapiens; identical to SEQ ID NO: 2255

SEQ ID NO: 2257 - DNA, 3577 bp, Homo sapiens
ctgaactgagtgagggcagccatcacaagccccattctaatggtggcagagtatggactctgatgtgtggaccgctagatcggctgagtggcacagcctcctggtgcctcctcatgtgtcaagtggggatctagtaacactggctgccccagtggctgctctgacggaaggagggaagctggtcctgggcttgtagctgtgcttggtgtaaacatgctgtctgcagcattgccagcacagccccacctcagccccatgcccagcacactgtaggtgcctggcacctgttacacagttgctagcgggctgtgcactcaggcctggctctgtccctgggctaggtggtgctggggtgatccaagggttccttgggaatcctgaggattccagggaaccttgggaatcgaagaggcctgtgctacctcacactgtcctcctcacacggcgttgtctgcaggcccttggcaactcctgacctctccgaaactcttccacatgatgaggtcagcagggaccctgccggcattccatccaagctactgatcccgcccagtgccggctcagtgccagagtcctcactgtggtgacctgaacactttgtttcacgattcatagcagggaagaggagttgagtccggatgatgatgtctgcagacatttcctaactgtttcacagagaagagggttgaggagtgcagactctgcctcagctccatcctgagggtgggactatcaggtgaagggaagctctcagaggacttctcaatttcccaagactcagagaagaggatacaaagggtctgagagccctccagccctgtctgagcaattttttttccagcatgccaaggggacgacaacattgactctggtcagggttctgggtgcccgtgacgtctgcagccgcacacccaggggcccccagctcctctccacgccagcacagactcctgggaactctccctgggaagctgacggggtcctgggatgtgctcagggtcaggcctgcagaagggccctagccagtgttgggaaccggctgctggctccggcctgggctcactgtgtggcccaggctcgccatgtcaccctgccttcccctgggagagaggaggccaaggcagccagggaacgcctctttgtcttggtgcccagggctgtcagataaagccgttgagccagccgcaactggggcatccagactgcttttccagccacgccaggcctcgccccactgtcccgtttgcccaaagggggctgatgagtttagtaatgtttactgagcacccgcccgccttgtggagctgacagccagggagacgagtcggctgcagactttgccctcacaggcaagacagccacaccttgaactctgactcaaggaagagagtgggcagctcaccagagaggccagaggaggcggcaggaaggtggggtctctccagccaggggcttcctgaaagagctgccttctgagcaggccccccaggctaggaagatgtgcacctgccgagctgggcaggagagggtggcccagtggaggacccagcatgggcagaggtttggaggtggcaggtcctgagggaagcggaaggcagccaggttgtgacagcctgtgaggacctcttggctcccggagccttctctctcctggaatagagatgacaccgtgctgccattgaactcaacccgaaaaaatgatctgttgcaaagctcacaggaaataatggagcaatgttacacgataaactgtaaagtgtggtgagcatgtgaacaagcgtccaggacccagcgaagccccaggctactgggctaggcgtcagatgagaagaggcagagggcaacctcctgtaggatctgaggccttcatgtgctcagcccatggctgtcgtcacggtgacgtgtgcatgcgatgtatctgggccatccttgttcttgaacgcgggcagtgagtcccacggtgatgtggcatgtcacgagctgaaggaggggcacctgcattcaggcttgcgaaccagcgagacagcctttggacctttcggagcctcactttcccacactaagaattggagtggaattcccaaggtgctggaggttgaaaggcattgagaatctaaaacgctttgcagacagcaagaccctctgtgtaagttaagaatgctcactcagtcccagcaggtactcagagggatccttttatttctccagaacattctgcaggtgagctggggaagcccactggccctggcctcacccccgagcccgagccttcagcctgggaatggtctggcctcttccttgctggctctccagcctggcctcgcaggaccctgggcgggaccccaggaaccctcacccgctatgtgcttccccaagaagcgctccctgtggcctaatttgagaaaacaatgggcctcaatccatattaatgaccctagagggaccctttgtcctcggtgcacaggctgtaatcagcggggctccgggggctctggcctaatttggagggacaggttttatcatcacccttgattcgggtgacccaatctgacaggcccacgaccccctgtatgcggggtccacgtcagagatgggcttcctcccagcggcccaccccagcgggctggggagagggaagggggaggtggtggccatgggggaagttcggggtgaagaaggggtcacagccagacccccacttggatgggcctgtgatcgggttctcgggaggagcaggatattgattagatcagtgaatggtgtggaggcagctctccccaggcacgtgctcccgaccacccaccagcaagcgtctgttgcctgccggtgccagggctgggtggggactctgggacaggccggctgcctaggaggggccaggcaggagccaaggggctggctccagggactgccaggagggccccagggaaggggagccgggaagcgttttggctgcctccggcgtgaagtcgtggaaacgtgtttgcaggttagggccgtggcatcctcgttgcaccatttgagcgcctatggggtgccagatacatgacaaagggccacctcatttaatgcttccctcaaccttcccaggccccgatccccatgttctgggtcaggaggcccattcgaggtcaaggggtgggcgaaggctgacgagacaaacccagggactagctcctgagtcccaaaacctagcctgaggcaagggcttgagtctgaattctcgctacggaccaaatgtgtgcgtcctccctaaatacatatgttgaagccttaactcccaatgtgatggcattaggagaggggacctgtggaatgtagttgagtcctgagggtgcggccccgtgatgaaattagtggcctgataagaagaggcccagagaaccggctctgtctctgctctctgtcgcacgaggaccccacaagaagacggccacctgcaaacagccattgaatctgccagtgacttggtcgtggagttccagcctccagaactgtgagaaataaatgtttgcgatttaaaccgcacagtctgtggtgttgtgttggcagtctgaactgacggagacagcatctg

SEQ ID NO: 2258 - DNA, 3577 bp, Homo sapiens; identical to SEQ ID NO: 2257

SEQ ID NO: 2259 - DNA, 3577 bp, Homo sapiens; identical to SEQ ID NO: 2257

SEQ ID NO: 2260 - DNA, 1660 bp, Homo sapiens
cttgtgattaacaggacttttattggtagtaaactagagcaaacaatcagaataatacatatgcagtattcagtacacacaataaaagttaaagaaattcaaaacctgtataaaacaaactggagaaaaatcatacagcttaagagatacagtggtaaaggtcctctccatcctttgattacagcttgtactctgtactcaatagaacttaccgcacttactgaaataagaaataaacactttttagtactcagcgtatttaagattaagtacattttctaagaatcttgcaatgacaagttggtgaccctttagctgctaaagctaaagggaggaaagtgggaaaaggaaattaactaatactttgtaaccatttttaatatttcttattttccaaacactgcttttataacagaagtgttttacacttgcacaatattaattactttattatacatggaagcctgcggtaggctgattacacaataagactgcaaacaaccagtggtacttttctgacgtcagaagagtacataagactgaaacatcaccaaaagtacataaaaaactcatcagcataaacatcaaagtacattaaaaaatataatcaggaaaaaaatacaattgctaaaaagcagttttagagtagagccactgccaatcagtagcttcaaatggcaattagagttcatagcaagttttgatgactttacaagacccctgtacaatactaatgcaccctttcattaaaatgtacattaaaggccgcaatttcacaaagaggttctgatgttattactataagcagacacattcttatccctcacaggagttatgtcaccagttggaattacaaccttattaatatctatccaagaacacggggttttattacatatggaaatctgtatgggtttttttttttttaaaggtgggttttggggatgtttaccctattgttttttatttggatgccctaaggcatataaaaaccgttgtaggccatgtataataaataatgcatgccccaaatttcagttaatcatataatttcaacttgagttctaatactggaaccagccaaccacttgggcttcaacactgtactagatgtcagtagaatcgcttgatggaattacagccttgttacagttgagatcaagagagggtgctttttttttttccttcttttattaaagctatcattccaggctttgatcaaagatccaagaatatttgttctaccaggctggaatgaatgtggtttggaagttcagagtacatttaaaagctgcaacaaaatataggtagccaacaatctcagaattttggatcagcccagatggagatagcaatttgaaatgtcttcgatcccttacttaaatgacgaaatgtctatcagcccagatagagcaatttgaaatgttttcgatcccttacttaaatgatgaaatgtatatcatactatctgtaaattggatattccattacagtgataacgtacagaattcccatgcgttattacactttcctgagagtaaagcaattagaataaccttaatcctagcaacaaagttttttttgtaggttttttttttttggtttttttttgtctttttttttgcgtttaaaacatttgggctattccctgacgatctat

SEQ ID NO: 2261 - DNA, 1660 bp, Homo sapiens; identical to SEQ ID NO: 2260

SEQ ID NO: 2262 - DNA, 1660 bp, Homo sapiens; identical to SEQ ID NO: 2260

SEQ ID NO: 2263 - DNA, 1660 bp, Homo sapiens; identical to SEQ ID NO: 2260

SEQ ID NO: 2264 - DNA, 1660 bp, Homo sapiens; identical to SEQ ID NO: 2260

SEQ ID NO: 2265 - DNA, 2847 bp, Homo sapiens
gagcaccttgtgacccccacccctgccagccagagaacaaccccctttgactgtaattttccactacctacccaaatgctataaaacggccccacccctatctcccttcgctgactctcttttcggactcagcccgcctgcacccaggtgaaataaacagccttgttgctcacacaaaacctgtttggtggtctcttcacacggatgcgcgtgaaaccctatacatactgacagaatatattttgcactacaaaagaagaaatccaagcttgtgaatttggaagtttatgtagatattgctctacacataccactctcttctctaaagtaagctgagttttctctgagaagaaaaaggtgaagatccctgccctcattatgcaagcacttggcaccggagaagaaaagttttattgccctttgaatggaagcagatggctccaggtctgacacttggcctctgagcccaagctaagccatcttatcccctgtgacctgcacatacacatccagatggccggttcctgccttaactgatgacattctaccacaaaagaagtgaaaatggcctgttcctgccttaactgatgacattgtcttgtgaaattccttctcctggctcatcctggctcaaaagctcccccactgagtaccttgtgacccccactcctgcccgccagagaacaacccccctttttcctttacctacccaaatcctataaaaaggccccaccccatctcccttcgctgactctcttttcggactcagcctgcctgcacccaggtgattaaaagctttattgctcacacaaagcctgtttggtggtctcttcacacggacacaccagtaatacaaattagaaatttgtattactaatacatgtcatacatacatttaatacatataagtaatattacattaggacttattttgccatcttatttcatattcacattttctatttctgtatttctgttttgcttctttttgtcattttctaaccccattgaaaaggctgattattctagtttgagagtttttttaaaagtgtatgttagttttctggaagctacctctaatttattaagatacatacctaagtttatttttctctatcatttctgaagtcgatcagtatctttatatttttgggcaaacaaggcaatgatgttagcatgatcccctttctagctttctggtatctcttgcccttcccatcctttaaccctgacatattggtttcatcgatttcttgttctggcagactttgggtatcctattttaggtaatgacagaatgttacaagttacttattttagcccacttccattatatattttaatgatttcctgtatttatttatcttcttgatggagttctgtttcccagagtgttttacggagtctttgtgtgataaaacttcagaggcattgagaatgttttcatttaccctcttattaaataatagttttgctgtatgtaagtactataaattgaaatacttctgaaaacattaccacatttttttttcttaaagtgttactcttgagaacctaatgtaaatctgatttttttttttataggaagacacaagttctttctttttcttttatttttgtacgtataagtttatggggtacaagtgttattttgttacaggtatagattgcatatttgggaaatcagggcttttagagtatcaatcacttaaataacatacattgtacccattaagttatctctcatcatccatccttcttctacctccttacccttctgggtcttcaatatctatcatcccacactctatacactctatatccatgtatatacattatttagttcccaccttttaagtgagaacatgcagtatttgtcattttatgtctgacttctgtcacttaagataatggcctccagctctattcatgttgttgcgaaagacatgattttattttttatgaatgaataatattttattttgcatgtatgatacattgtcttcatccagtcatctgttgggggacactttggtggtttccacatgtttgctattgtgaataatgctgtgataaacatacaggtgtaggtatctctttgatgtaatgatttcttttcctttgagtagatattcagtagtgggattgctggattcaatgatagtcctattttttattctttgaaaaatcttcatactaaaggtttcactaatttacattgccaacagtgtctaagagttccattttctccacgtcctcaccaacatctgttattatttgtcttttaataatagccatgccagttgctataagatgatatctcattgtggttttaatttgtgtttctctgatgattagtgggattgttttttcatatgttggccatttgtatgttctcttttgaaatacgtctattcatgtcctttgtctaatttttaacgagattatttgtttgttgttgttgctgttgagttccttgagttctttgaattcggatattaaattttataaatatattatttatgtaactatgccacatatagtttgcaaatattttctcccattatgcaagttgactgttcattcttttgattatttattttgctgtagggaagctttttgagtcccatttgactatttttgtttctgatgcctgtgatttgaggtctttgtcatgaattctttgcctagctcaatgtcctgaggagttttcctagattttcttctagtatttttatagtttcaggttttacatttaagtctttaacctatcttgagttgattttttacatggtgagagataaggtccagttttattcttctgaatacagcaacccaaatttccca

SEQ ID NO: 2266 - DNA, 373 bp, Homo sapiens
tcttttcggactcagcccgcctgcacccaggtgaaataaacagccttgttgctcacacaaaacctgtttggtggtctcttcacacggatgcgcgtgaaaccctatacatactgacagaatatattttgcactacaaaagaagaaatccaagcttgtgaatttggaagtttatgtagatattgctctacacataccactctcttctctaaagtaagctgagttttctctgagaagaaaaaggtgaagatccctgccctcattatgcaagcacttggcaccggagaagaaaagttttattgccctttgaatggaagcagatggctccaggtctgacacttggccaatggagctgttgaatggtggtggagccaac

SEQ ID NO: 2267 - DNA, 6360 bp, Homo sapiens
atctcacactgacacatgctggcatcatgagccagactttcaagaaggtatcagggcagttcctcgaaaagatcccagatgggaacaccagacaggttcgccaggtatagctaagcgagattatatgatttcctgcctagttgaagggcttaaaaaggcagcttacaaaactgttaattatgacagacttaaagaaactacccaaggtaaagatgaaaacccagcccagttcatggctcatttggcagcaaccctgagacgctttacagccccagacctgaaagggcagaaggccgtctcattctcaatatgcattttatcatccagtcagctcttgacattagaaaaaagcttcggacattggaatctggccctcaaaccccacaacaggaattaatcaacctcgccttcaaggcgtacaataatagagagaaggcagccaagcggcaatgcatttctgagttacaattacttgcctctgctgtgagacaaaacccagctgcacctccagcacacaagaacttcaaaacgcctaaaccgcagtggtcaggcattcctacaggacctcctccctcaggatcttgcttcaagtgtcagaaatatggccactggaccaaggaatgcccacagcctgggattcctcccaagccatgtcccatctgtgcagggacccactggaaatcagactgcccagctcgcctggcagccactcctatagcccctaaaactctggcccaaggctctctgaatgactccttcccagatctgctcggcttagcggctcaaggctgatgctgcccaatcgctttagaagccccctggaccatcatggatgccgagcttccagtaactctcacagtggaggcatatttaacacatcatttgactacctctggattccatttttttatgaaaagcaacctattaataacgctgttgttaccctaaacataatgattcctttttctcttgctgacttcaagatttttctttttctttgaatttcaaccatttgttcaaaaacttctgaagaatcttgtgaactgtgtctcaagattacctactggggaatggaagacagaagtatttgtcctttaacctttggctgtcattgatccaaggtgattccattggacatttctttcccaatacttttgggtgcacatgcataagggctggcatgttcaaaagagcaggaagtgagaagtatgttttaaaatcccaaagaaggtattgatgcacctgtatcaagccaatcaaaactttataacttgtcaccacaacaatggctggagtaagaggtaaaatctgaaagacttgaaaagctgcacaagagtcttctgatataaagacataatgaaaacttaaacagaataatataccatattcatggataggaatatcacaaatatgttatttttttccaaatgaattcatagatttgaataaaataccataacacttctatagtatgctttgctgaattgacaagctgactttttttatttataagaaggaaaaaatatcaccacaaagaaaaggaattctcctaaagaaaaacaacaaactggagagactataggcataaagaataagtaaaagtctttggggaattcatatatggataaattcaatacttgaacaaaattaatggcccaaaaagtagactcatacatgtagaggttataatataatttgtttacaacataattggcatttcaggcccattaatataacataacgtctacgttagtgtataataaacacagtacagtcacctgtacataaatggtgtggggacaatagattttccatatgaaagcaatgaaatgagatcttataccctaaataattaaattataattggattagagactcaaatattaaaggaaaaattaaaaatcatgtcattataagaaaatatatggttgacagtgacaaaagaaagaattatgtaaactgaatttaaaaacaacagcaacgacatagaccatcaagaaaaatatacgtatgtatgcaattacattaaaattaaggagttctgtttattaaaaggcttcataaaaaagtggaaagtcaagccacagacctgaagggaaaccttagaaaacagatgaattaccaaaagactactatacagaattcgtaactcccatggatcaataagaaaaaggcaaacaaaccaatagaaacattgtcaaaaaacatgaaggaaacaaaaatggtccattatattgacttaaaaatctactaacaaattttgattcagagtttgaaaaacactagtctagaccagataactcacagatttgaagaattagtgtcaacagaaacatgctgtttctttatactgtatattgtttatttgcaatgccagaatatagatagcatttccaaaatatttttttagtttcaaaaatcacaaaattgatagatgtatttaagaaattcaaacaataaaaatatatgtaataaaatgttcaccccttgctttattcttttttgccttcaccccctccccagaagtaactttggtatatttattgaggtgtgtttcttaaatacttttctactcacttacaaacacatatgtagtgtgttttaaaaaataattataatatcatgattgctattctgcaaccttctttactcacttactgacacattaccaacctcttttaacagtagtatatttactgatgtcatcaaacctgaggtgttttgatggtattgcattcatattttactggaaagggtcagcacaagatttacccaattgcatcattttttaaagtgagtctttatcttatttgtatttgcatattcaaatctttatgcaaatctattagatatctgtctcagcaataatttgaggcatatgttccagcgaattctgcaataccctagaaagcaggttttccaaagctggaaaattttcagacggtattgttagagaaagacagcattttctagaggtgtatttgattatttgattttctttttcttaaacaacaactattcaaattaaattcacagatacataatttgtcatgcagatgataaaaactatattgcctagagcttggatatgtgaatcaggagctaaaccaatatgtgaaaacacattagagaggctatttgatggacttctgaactgcgaaattcaacaactgtgctgaactattagcttgaaacatgcacttattcaattttgccttgaaatgaataaagagccatctccttatatatgtacaataagagactgaagctacttgtacttatttctaaaacttaatttcacttgagaaggaaaataaagaatgaatcaactctttcaacaagaacacatctgcttttgtggtacttactaaatgtataacctaccttttctataaatttgaatatttcactttttgcaacttcctgaaaaatagcaatctgatctatctatgctgactttaatgttgcctcttgacacttgatactttgtcaaaattcagctaatatgtataataaaaatacttttagacctggatagcgataaagggttacaaaactgcctagcataagagttgaaaccacctctcccatcctttcatttggcagatgtggatgatgacagctgagtgcagatatgcctcaaattcttctcaaggcagcacttcaggaggccccaactgatccatcagagttagcctgtgagataagatttactggccatccccgaagctgctaaaactctgctatcaagtgacctgtgaccttgggaaaatatattttttgtacttttatttttcttcaaagagcaatgtagctaattatagctacctcccatgattgatgtgaagaacacatgaaataaattgcaagaaacagcccaatttgttataccatagttggaaaaggcttgtggaatgaatccattgaaacatgcctaaatggtacttgaatttaaaaacaaaaaacttttaaattttaacttaaaacttgataatattataattttaggatttctctttttcttttaattgtggcaaaatatgcatataaaatttactgtcttaaccatctttaagtacacagttcagtgacattaactatatttacattgctaagtaaccaatctctaggaatttttcatcttgaaaaactaaaactctatattcattaaacaaacctgtattaacccctcttttcagcccctggaaactagcattctactttctatttctgtgaattagattactttagacacttatgtaactggagtcatacagtatgtgtcttttcatgactgacttatttcacttagcataatgtcttcgggttttatccatgttgtagtaggtgacgggatttccttcccttttaaggctgaataacattccactgaatgtacataccatattttctttatctttattccactgaatatacatcccacattttctttatctttattccactgattaatattctactgaatgtacataccacattttcttcatctttattcattagtcagtgaatatttgtgctgcttctacctcttcactattgtgaataatgctgctattaacatggctgtacaaatatctctttgagaccctgctttcaagtattttggatgtatacctggaagtggaattgctaaatcatttggtaattctacttttaattttttaaggaaacaccacactttttttatctctagtagctgcactattttacattcctaccagtagtacataaagataccaatgtttccacatcctcaccaacacgtgttatattctgagatttttctcattttttttgttttgttttgtttgataataaccatcctgttaagtacaaagtcatatctaattatgggcttgatttgcatttccacaaagattagtgatgttgagcatctttcatacgtattcaggccactcatatatcctctttgaagaaacgtctatattaagttcttgtcccattttttatttgggttgttttattgttgttgagttgttgaagttctttatacatgatattttggtttttaaccctttatcagatatataattgcaaatattgtctcccaccccataggttgccttttcacagtgttaattgtgatcttggatgaacagaaagttttaattttgatgtggttaaatttacctagttttacttctgctgcctgtgcttccaaaaaatcattgcccagaccaatgtcatggagattttcccatatgttttcttctagtagttttaaagtttcatgtctcatagttaactctcaaatggattttgagttgatttgcatatatagtatgagataaggttctaatctcattcttctgcatgtggatatccagttttcccaacaccatttgttggacaaactacactttcccccttgaatgatcttggcacccttgtcaaaaataagttgactgtatacgcaagggcttattcctgatatctattatattctactggtctagatgtctatctttatgccagtatcacactgttttgattattgtagctttgttataagttttgaaataaggaaatatgagacctgcaaatgtgttccttttctttaagactgctttggctattcagggtctcttgcaaacttacataaatttttgagtgaatattttctggaatttttatttgaattataaatttccaaaacaaaaatcaaaacaaaagcaaaaggtttttttggttttttggtctcaattaaggaattagttggggtggcttgtaattctcaaagtaaaaagatatacattttaattactgtataaacattttttaaaatccaaatgttaaatacaattaaactattaggaagatttgttctctttcccaggtttctgatttttttccttttcctgtacctcaagctctatattatgacacaaaaatatgtaatgctaactgcatcctttctgcttcattaaaaaagaaaagagagaaatgtaaatgttctaaagtactgtcaattcagatgtatcaattaggtttggaaatgtgaaaggagttaaatcttaaaatagaggaaaaaataaaaataaggaaacccctttaataataaaaatctaaaagctaaattttctcagtgaaagatttacttaaagtaaaatatgtatgtgttactaagatgaactctgatttattactgaatgctgtatatgatttccctttgcattttaccattgtatatatattagcattgttttctatgcattatttatgtatcacctgtgtgattacttaaaatattaaagaggaaggacatgagagatcctggcaatgtaacattatgcttcagtatcatcttaacagagcgga

SEQ ID NO: 2268 - DNA, 4598 bp, Homo sapiens
accctggcaggattgaagacttgtgggaaatttccagccttggtttagggtcctttatgttttcacagcctttcttccttggaaaggtaggctaaccttttcatattattttctgttttggaaactagaaacctttctcaattgtataaaataaacagaaaaatcagtgagtatgaatacggaatcatttattcatttttattttaatttctccttgattattaaagatatattttaatatactcttttttatttaattttttaattggctgacaaaattatatgtgtttttcacatacaatttaatgttttgaagtatatatacattgtaaaatagttcaatctagctaattaacaattgcattacttaacacagttatcatttttgaggtaagaacacttaacatccattctctgggtttttcaagaatacaatatactgtcattaactatagtcaccatgctctacaatagatctcttgaacttatttctcctatctagttgtatttatgtttccttttaccatcatctcccaacccctcttccacctaaccatgtagcccctggaaaccatcagtctgctatctacttctacaagattaacttttttaaattccacatatgagtgaaatcatgtgatatttgtcttactgtgcctggattatttcacctgatataatgttatccaggttcatccatgttatcacaaatgatagtatttccttctttttctcactaaatagcatttcattgtgtgtgtgtgtgtgtgtgtgtgtgtgtgtacacacattatatatgtcacatctctgtattcatccatctgttaaatatactaataaagaagaaaaataaagattacgctgaaatataatattatgatttagtatatatatggttatatttctttgggtttactctagcatggttattaaactctcaaagttaaagagcatattcaaaatgtaatgccttccctgaacatgctttatgttcacattatcttatttacttttacttatccactacatttaatcagacgtgaaatcctctggtttcatccttttaaggtgttccaaatttttctcttaggttttattacacagccatacactaaaaattgtacttggattgccgcagctacatcctagtttatctcccttattttcatctgtgacttcatctccaccagatgaatatagttaacatactggaagaaagtgattcttttctgttaatgccactccagaatgttttaagatttgacgttatcttgtcaggcctctgagcccaagcctgcacatatacatccagatggccagaggcaaccgaaaactacaaaagaagtaaaacagccagctcctgtcttaaatgattgaccaaccttacgacattccattatgacttgttcctgccctgccccaactgatagattgatcgacctcgtgacattcttcttctggacaatgagtcttatgatctccccaccatgcaccttgtgacctcctcttctgctgacaatagataaccacctttcactgtaactttccactgcttaccccagtcctgtaaaactgccccacccctatctccctttgctgactctcttttcagactaagcccacttttacccaagtgaaataaacagccttgctgctcacacaaagtctattggtggactctcttcacatggacacgcttgacatttggtgccttgactcagatcaggggacctcccttgggagatcaatcccctgtcctgctgctgtttgctctgtcagaatatccacctatgaccttgggtcctcagaccagcccaagaaacacctcaccaattttaaatcggatgtggatgatgacagctgagtgcagatatgcctcaaattcttctcaaggcagcacttcaggaggccccaactgatccatcagagttagcctgtgagataagatttactggccatccccgaagctgctaaaactctgctatcaagtgacctgtgaccttgggaaaatatattttttgtacttttatttttcttcaaagagcaatgtagctaattatagctacctcccatgattgatgtgaagaacacatgaaataaattgcaagaaacagcccaatttgttataccatagttggaaaaggcttgtggaatgaatccattgaaacatgcctaaatggtacttgaatttaaaaacaaaaaacttttaaattttaacttaaaacttgataatattataattttaggatttctctttttcttttaattgtggcaaaatatgcatataaaatttactgtcttaaccatctttaagtacacagttcagtgacattaactatatttacattgctaagtaaccaatctctaggaatttttcatcttgaaaaactaaaactctatattcattaaacaaacctgtattaacccctcttttcagcccctggaaactagcattctactttctatttctgtgaattagattactttagacacttatgtaactggagtcatacagtatgtgtcttttcatgactgacttatttcacttagcataatgtcttcgggttttatccatgttgtagtaggtgacgggatttccttcccttttaaggctgaataacattccactgaatgtacataccatattttctttatctttattccactgaatatacatcccacattttctttatctttattccactgattaatattctactgaatgtacataccacattttcttcatctttattcattagtcagtgaatatttgtgctgcttctacctcttcactattgtgaataatgctgctattaacatggctgtacaaatatctctttgagaccctgctttcaagtattttggatgtatacctggaagtggaattgctaaatcatttggtaattctacttttaattttttaaggaaacaccacactttttttatctctagtagctgcactattttacattcctaccagtagtacataaagataccaatgtttccacatcctcaccaacacgtgttatattctgagatttttctcattttttttgttttgttttgtttgataataaccatcctgttaagtacaaagtcatatctaattatgggcttgatttgcatttccacaaagattagtgatgttgagcatctttcatacgtattcaggccactcatatatcctctttgaagaaacgtctatattaagttcttgtcccattttttatttgggttgttttattgttgttgagttgttgaagttctttatacatgatattttggtttttaaccctttatcagatatataattgcaaatattgtctcccaccccataggttgccttttcacagtgttaattgtgatcttggatgaacagaaagttttaattttgatgtggttaaatttacctagttttacttctgctgcctgtgcttccaaaaaatcattgcccagaccaatgtcatggagattttcccatatgttttcttctagtagttttaaagtttcatgtctcatagttaactctcaaatggattttgagttgatttgcatatatagtatgagataaggttctaatctcattcttctgcatgtggatatccagttttcccaacaccatttgttggacaaactacactttcccccttgaatgatcttggcacccttgtcaaaaataagttgactgtatacgcaagggcttattcctgatatctattatattctactggtctagatgtctatctttatgccagtatcacactgttttgattattgtagctttgttataagttttgaaataaggaaatatgagacctgcaaatgtgttccttttctttaagactgctttggctattcagggtctcttgcaaacttacataaatttttgagtgaatattttctggaatttttatttgaattataaatttccaaaacaaaaatcaaaacaaaagcaaaaggtttttttggttttttggtctcaattaaggaattagttggggtggcttgtaattctcaaagtaaaaagatatacattttaattactgtataaacattttttaaaatccaaatgttaaatacaattaaactattaggaagatttgttctctttcccaggtttctgatttttttccttttcctgtacctcaagctctatattatgacacaaaaatatgtaatgctaactgcatcctttctgcttcattaaaaaagaaaagagagaaatgtaaatgttctaaagtactgtcaattcagatgtatcaattaggtttggaaatgtgaaaggagttaaatcttaaaatagaggaaaaaataaaaataaggaaacccctttaataataaaaatctaaaagctaaattttctcagtgaaagatttacttaaagtaaaatatgtatgtgttactaagatgaactctgatttattactgaatgctgtatatgatttccctttgcattttaccattgtatatatattagcattgttttctatgcattatttatgtatcacctgtgtgattacttaaaatattaaagaggaaggacatgagagatcctggcaatgtaacattatgcttcagtatcatcttaacagagcgga

SEQ ID NO: 2269 - DNA, 10131 bp, Homo sapiens
ggcccgggcgcctgggctgccgtcccggctctggcttcccaaagctcaaataagaggggccggcggcgcggggaagaggaggagccaggaggctcggccgctccattcactcagcagcccaagcccggccaggcagcgcgcgctgctccttgggggcgccctcgcagctggggtgagggcgggtccgagggagcgtccctctcggagacaccctcctcttcaacccaacacgcgctctcagctggccggtgtggcacaaccctccccccacctccccttcttggccttcgccagtgtgggagcctcgtctcactggagagtccgttcaggcaaggagaagaaccgggggccggagcggagcgtgtttcagaggtgcgtataaaatcccaggggcgccaggaggcagcagcgacggcgcagcgtgggacggccaggcgcgacgggagggaagcaaccggttgcagtccggcctcctgtacctggctggcccgggctggggctgcaagctttccagccaaacttatgtgaagcaaagtagttgcagtttgacaaagaatggcgtttcaataaatgacatagtaattttttacgctttggtttttagcttgcattgcataaacgttgtcgccattaaattctggctgcggacccgaagtgtgtgcgggcccaggacttactcgaagggcgcacttcttgggaatgcgcatcccgtaggcgcaggagaccctgaggaatccttgtgggggcggggaggggaagagcaccggtgcgaaccccggggtgccccctcgcccgacttggacttctccgactaaagaggtgggaggagttccctgcagcctgcggggccaagaagaaagtgctaagctgaggagccgcagtcggaggaccccagggacccgacaggaagtctccgtacgaccccaacggatccacatgcccggaagcccaggcgacactaagccagcgctggggaactgacgtactcctgcagtcgcagggcgctccatgcctctctgtcctcttctttgttgtgggtaacgttctctgcgggagacctgaggttttccaagggggacatgccagctacactggccttggcgccctgagctaagcaccaggactcacagcctagcacgaaggcaggtagcaccttcacccgccgcggacgataggcgctctcctgtacctcctttagctcgcgaggcccgcccttcgcgaggtcccagagaaaagcaggctgtggaaaactgggcgcccccttctttcacccaccttcttacccctgtcagcgccgagatctgtagcagaggttcctggtctgaaccaccgattggcaaagaaagctgcagattaaacttctcgttttacagagaaggaaactgaggcccagacagccgaaggagaggcagtctatggagcgcagcggtaaagagcaaggggttggtggccccagaatggaacctcagctctgccaggacaggaaacaagttagtggcaacgccgagctgaaacccgggtctctcaacgtccagttggaggttttacccaccacccctctacctcttcagagctaatgggatgcagaggcgaggacagcccctggaaaaccatgtggcgttgatacactggcaaagcgcaggcatcccggcctcgaaggtgcataattattgcaatatgaaaaaatcgaggctgggtaggagcagggcagtgaggatttctcaacccttactttcaccccggcgctgtccactgcatctgacagagcgcggagctgggctgctacagccgcaaccccagggaccagtgcgcacgcctgggccgccctccgggagtcacccagcggccgcggacaactgaataaacaccccaaagcgctgcggtcggtcaagggcggggacagccacactgcgcgcggggcccgcaggccgtaataaagagtggctcgacctcgctgctgcctgtcgcgggagaggaacaagctttcgactagcgcctctccccggggcccgcgccccgagccccacgcgcaagacagcccaacagctgttcctcccctccccgccgactccaactcttcggaatctgcccactcggggctgcagggcaagtgtttaggatggttcccagccccgcgctggcggtgaaaatttcaacgtcattccttcaattaaaaaaaggggggggcaagggaggggctttgtgataactactcccagcttcttctgatcatttcaaaattaagtcgattttttttaaccagtccccacttactgtcctaactctcctcgctgaccctatctgggagcccggaaccgttaggtactgccgaatgcggtgcaaaatttccccctctcccccagttcgcagtgcctggagccgctggggttactcgtctgttctgatgccaccgcgagatggtccccgagctccccgagagtcctcagtgaaaggattccgcggcactgcctctattattataccgtaaatctttttaaattctggaactaattatatagaggatatgtctcaatttgttctgcattaatgccacagtggggatggaggccaggccgtggccagagcagatacgtaggcccatgaaattgatgaactgagagttgcttccagtcctgagcgcaccatctggaattccagtctgaggttacaattagaactcctgaccccagattcaactttgcaaacaacaggggaaaaaaatggggaaaagaaaaaccacgagagagggaaaaaaaattattctgcacctgtaaaaaaaaaaaaaaaaaaaaaaaaaaaaaaaaagtcacacaatcttaaaatctttccgtcttagacaattctttccaagtatttcttttgtgttttttaacctataaaagataatggaatgttttatagactggattttatctcatcccctttccctctcccaactgccctcagtttaatagttgtcagttttacctcagtgttgaatttaattatataggaacaaaatattcctcagtaaatttgcttgctaaatattctgtcacatttacttcccctttgagaaatggcttaattatagaaatctacctgcatctaggaattttttttcccttttcttttttgaccgccattccagcttaatcgtaagcagagattttatttgtgcagtaattttatttgtgttctaaattcgtttagccaatttcttccttctttctttagtaacaccctgctttattttcctctcactttgaccccctgaagaaaacgaaggaccaagcagtactggagaatctgttaaatttattagcataaatgcttagacaaaacgagatataaatcattcagatgtattaagccataaagtatcccaatgaagtcagtcccttgccagggtcctggtgtataaatgttcatataaaacaaggtatcagtattatctttcaaactgaatatatgttgtaaaaatatccaaggttgagttaggaatatggggggagggtgcagcagggcaggaaggggatattctttagaccagtttgttaacatagtggtggctcagaaagtatggtggaaaggaaaaatttcaaccgtttacatttggagtcttcttagataatatgtttttaaataacggtatgcaggatatatttgagagcaaaggaataagagaaaaaaaagatgactagagggagaaaggcattgatttctgtagaatgcatttgtcccccaaagatcagtttagcttcacaaaaatccacccagaggaggcactggctcttcacacagataacggattatccagtagagaagagctacctgggccttcgtctggcaactgggatatgcagccgctggtcagcagagggatgtgtattcattagcggtggaagacgaggaaagcgcccgggagtgaggaagaggaatggacagaattcctggcagaagcttaccaagacaaaaatcagacacaatgtttaagcagcaattgctcgtgaagttcataaccatggctctctgtaaatcttggcaaattgggacattctttgctttttggaaatgattgttttcaagactttttttaaaaaatcaagttgtccaccagaaaaatggaatagctcaccttccccatcttttttttaaagcagggatatcctcatcctttccgtgccattcattctttcattcattcactcaccgtgcaacaaagattgttgggcattgtagcagcaagtaggagcacagggtaatgacaggctcaccccgctctcacagtttatattccagtaggtatgacagatacattacaaggaaacaatgagatattttcatatagtagtaattgctataaaagaacaaggagatctgtaagactagagaatgactaaaggtgagatgggaatgaggagcaacagatagccctcacttccttttgctttctgcccacactaccacattttagtgtgtttaggaagtattccaccttacagtccagatgcaggaagggtttgaaggatttggaatggttggtctggataaatctctgcctacaaaactggactttatgaaagcggcagggcagctgtttatatagctggcttaaaatcatcaccactagctgagtgactctgaaagctatttaacccctgagaaattcagttttcttctcttcaagataaaaaataacagcaagttatgaggactacataaggtaaggcatgtaaatttcttagcctttaggaagcactcaatacatgttggctattatctatatagacataaattctatgctttgcttccaattaattgataagttataggcttagtattgatattggtgtgaattcagaaaaggtggaagtctttgttcttgttggatcagggtgaagagcaggaagagaaacctttgctgaatctgaccttaaacaaggttgttgccatctagaaggaaatttaaatgattttgccctacaccaggaccctaaaacaggaaatatgtggcttttgcctcaaaatcaagcttaggttccttcttttagtacagaagtctataggttaacaacctgaaaatcttagaattgcattgaaaatcttagaattgcattgttccttagagccacatttcaggtttgcagccttgtccaggataaagaattctggggtaggtataaaaacacctgaactcaaatcctatctctatcagttactgtgatcttagggaaatagcttcagctctcagtttttcagtagctttatgtgtaaaatggagattatataaaatgaaataaagcatccataggtgatttgaaaactctgaagtgtcagacagtgcagaagaccatcataacattgttacatgtgaacatgtggaaaggaatatgtctattcagaacactggggcacattgcttgctctcatggttcttcatttttaagtgagtatagtacctttcatgcagggctattgtgataagtaagtgagatcatatatataaactttcaaaacaatgcatagcatagaatgtgtgctatgtaagcatcactgctacggttattgttactgttctctggccatcttgttgggccaagtgttgaaccttataattttcacatagagagcttcttactgtagaagtttataatagtatagagagcaaggctttgggatcagatgactggggtttaaagcctcctcgctagttattttctgtatggctttgggtggcttccttattttctctgagctttaattttcataaccttaaaacagggctaatgataccatcacctcacagggttgttttgagaacaaattaaaacaccatatgtaaattgctttcgtggcacctggcatgtagtaagaaatcaataactggtagttattaaacctacaattcttctaatcagacaatattagctatgacttaaaacaggtgagcctgcaagagcttgaattacagcatgattctgaacaaacacagaaagtaatttctatcttcttttaaactcacctgtactacactgaaatctcactctttcacatatgaaagactttgcaaccaaggcactgacaaggatttcctttttgactatgaacgctttaggttaaaattctgaatctcatttatttttaatgggtttctttgcaaaatacccagcgtatgtcaaggacattggtaatcccatgttcttcaaaataagcaggaaattgatttcagccaatggggagaaaaagtagtttgatcctcttcctggagttaccacatagcatttattaatagctctgtaaacggtctggaacacagtatcagcttgctgttcaaaatatgacaaaagtttatgcaaagttgcttaggaaaaacaagatctagtcattagaaatctgacactggtcaatagtacatttattccaagtctccataaatcacaaacaaatgaaacttctattgtgatcactgttccagatctaaaagaccctcccccttactttggtagaaattaaatacattttagaaagcccaatattttttcctctacaaatagaggctaattacaaaatttcccaagaaataataaatattaaactataatcaacagatgtgacacaagatgaataagaagcacataacttagctttcattccttatgtagggcgcatgtttatctttaattatccccaacctgggaatggcataaatgttatctgttttatttattatttgtatctagagtgacatcacattttgattttgcccaggacagtctcagcttaagctgttgtcccagcttaattattaattactctccttttactccaaagtattctacttttgatggtaaataaggacttcacttgcttaaaattttattttattaaaaaaatgatagatttaagaaagccattggaacaagggtaaaagataggctaaatggggctaatgagaagaaaaaaattgaattaatattagaatcaaaggatgcagatagttactataattgagcataatgcaattctgaacttcctgacagccaagtaagaaaggggaaaatagcactagttacctatctttcgtgatgcaataaagggaagaaacctagtttttcagaagagatgaattttttctagtactaaactcaaagaggaacttaccatactagcctttctataagagttatcaggtaacggttagcgacttcaaaaataatgtttcaaaagatgcaacgacattttctggtagtttatttcaacccaatgtccacagcattaaaattatggttctgtaaactgtaagaggagagaggcaataatatagtccctttttgtagttttctggaggatctgacctgatcaaatcaacctgatttgttaatttttagaatgtgcctaatgggtttttttttatttttattttttattttttttgaggcagaatcttgctctgtcacccaggttggagtgcagtgaccccatctcggctcactacaacctccgctacccgagttcaagcgattctcttgcctcagcctcccaagtagcggggattacaggcacccaccaccccgcctggctagtttttgtatttttaatagagacagggtttcaccatgttggtcaggctggtcttaaactcctgacttcaggtgatccacccgccttggcctcccaaagtctgggattacagccgtgagccaccacgcccgaccccgtaattttttaaaagcatcttttattcgttaatcatcagttaacttgaacccgaatccaaacgctgcgaaagacctgaccattgttctccagaatctgcgaacgatttggtgagagctctagggcagtggttgttctcaactgagatgatttgcaacccagcagacgtctggcaatgtctagagatattttttgtcacgacttacagtaagacaggatcactagatgcacagtcctggtatctagtgagtagaggccagggatgctgttaaacattctataatgcacaggacagaccccccagaacaaagaattatccagcctaaaatgtcaatagtgccgagactgagaaactgtgccccagggtactgttagaagaagggatggagggccaggcgcggtggctcacgcctgtaatcgcagcactgtgggaggtcaggcgggcggatcacgaggtcaggagatcaagaccatcctgattaacacggtgaaaccccgtctctactaaaaaatacaaaaaattagccgggagtggtggcgggcgcctgtagtcctagctgcttgggaggctgaggcaggagaatggcgtgaacccagcaggcggagcttgcagtgagctgagatcgcgccactgcactccagcctgggcaacagagtgaggatctgtctctaaataaatatataaataaaagaagggatggagacatagtttttagctggagtcaaaagaaaaaatcctcatggggaaggggagcttgggctagattccttcatcccacccagtggagctggaggatgtctctccccaagctcagcaaatgtcaggaaaaaaatacaagaagaggcaatcatgtggaaatgcagtccacaaagggaattgtggataaactcatttaaccagaaaggaggaagaatccatgtagagcaataagaaagaaagccagatagcacagcacatgcaaatttagggcaaagagtttctgttttgatgttatgctccaatatcactaaatattgctggtattttttaaagccacacaaatcaagggcagcataaacttttatgttcccagagttcatctttggaatactggcttatagtgtatatgtggatatgcacatattttgcttcctctcctccacatcgttttttaccacttacataatagggattccttggaactcagttttatatcacattaaatttaaaaatgggtgcctactcaaaaagacaacctatcaaggcacagaaaattctgaaccactgctgtaatgaatacatcattggaatctccattaagaaatattattctgacctagttctctgtgtcatgctgcagattgtccttctcttgactcatggaatgctttgtgagaaagaactacaaagccgggtccctcgatattagccatctcacccttcaaagttcagccaggagtgggacaaaaccctcgtcaccatgttgacatgtttacttctggcgcaggaaaatactgctgttgcccaatttggtttcccagtccattcacttgcctggagacatatattttatgctttcctttgatgatttacaaataaattaacgtgattcactaaggtctgccagcatatatgcgttactggagaaatctgagatgttgaaaaagtattttaatttattgtatcccaatactttcttaagaaagtttcttaagaaccaaataaatatcatcagctagtttatatacctgacatatttattacggtattcccgctgagcacttcccattgtcatgtgttctcacacattgttttcacaaattgtgttttgaaagaagtcaagggaaattcaggccagagaagcaagatgttatcttttggaaaggatgagcccactctaatggaagaggataatccattcagaggcccagtaagtaaaacaggatgcacaaacctggctctcaacttgcttacagtctggctgtgcttcaggacttggtcatcattgaagcaggatgtgcaagtacttgtaagaagtatccttgtggccaggtgcagtggctcacacctgtaatcccagcactttaggaggccaaggtgggcagatcacgaggtcaggagttcgagaccagccttgccaacatggtgaaacctgtctctactaaaaatacaaaaattagccgggcgtggtggtgggcgcctgtaatcccagctacttgtgaggctgaggcaggagaatcgcttgaaactggaaggtggaggttgcagtgagctgagatcaggccactgaactccagcctgagcaacaagaacgaaactctgtctcaaaaaaaaaagaagtatccttgtaacaaccctcacttttaccagatccaagaattctctccagtacctctctatgttatacagggatactgaagacaatttcattaagttttacagagaggcccctg

SEQ ID NO: 2270 - DNA, 9999 bp, Homo sapiens
ggcccgggcgcctgggctgccgtcccggctctggcttcccaaagctcaaataagaggggccggcggcgcggggaagaggaggagccaggaggctcggccgctccattcactcagcagcccaagcccggccaggcagcgcgcgctgctccttgggggcgccctcgcagctggggtgagggcgggtccgagggagcgtccctctcggagacaccctcctcttcaacccaacacgcgctctcagctggccggtgtggcacaaccctccccccacctccccttcttggccttcgccagtgtgggagcctcgtctcactggagagtccgttcagaatccttgtgggggcggggaggggaagagcaccggtgcgaaccccggggtgccccctcgcccgacttggacttctccgactaaagaggtgggaggagttccctgcagcctgcggggccaagaagaaagtgctaagctgaggagccgcagtcggaggaccccagggacccgacaggaagtctccgtacgaccccaacggatccacatgcccggaagcccaggcgacactaagccagcgctggggaactgacgtactcctgcagtcgcagggcgctccatgcctctctgtcctcttctttgttgtgggtaacgttctctgcgggagacctgaggttttccaagggggacatgccagctacactggccttggcgccctgagctaagcaccaggactcacagcctagcacgaaggcaggtagcaccttcacccgccgcggacgataggcgctctcctgtacctcctttagctcgcgaggcccgcccttcgcgaggtcccagagaaaagcaggctgtggaaaactgggcgcccccttctttcacccaccttcttacccctgtcagcgccgagatctgtagcagaggttcctggtctgaaccaccgattggcaaagaaagctgcagattaaacttctcgttttacagagaaggaaactgaggcccagacagccgaaggagaggcagtctatggagcgcagcggtaaagagcaaggggttggtggccccagaatggaacctcagctctgccaggacaggaaacaagttagtggcaacgccgagctgaaacccgggtctctcaacgtccagttggaggttttacccaccacccctctacctcttcagagctaatgggatgcagaggcgaggacagcccctggaaaaccatgtggcgttgatacactggcaaagcgcaggcatcccggcctcgaaggtgcataattattgcaatatgaaaaaatcgaggctgggtaggagcagggcagtgaggatttctcaacccttactttcaccccggcgctgtccactgcatctgacagagcgcggagctgggctgctacagccgcaaccccagggaccagtgcgcacgcctgggccgccctccgggagtcacccagcggccgcggacaactgaataaacaccccaaagcgctgcggtcggtcaagggcggggacagccacactgcgcgcggggcccgcaggccgtaataaagagtggctcgacctcgctgctgcctgtcgcgggagaggaacaagctttcgactagcgcctctccccggggcccgcgccccgagccccacgcgcaagacagcccaacagctgttcctcccctccccgccgactccaactcttcggaatctgcccactcggggctgcagggcaagtgtttaggatggttcccagccccgcgctggcggtgaaaatttcaacgtcattccttcaattaaaaaaaggggggggcaagggaggggctttgtgataactactcccagcttcttctgatcatttcaaaattaagtcgattttttttaaccagtccccacttactgtcctaactctcctcgctgaccctatctgggagcccggaaccgttaggtactgccgaatgcggtgcaaaatttccccctctcccccagttcgcagtgcctggagccgctggggttactcgtctgttctgatgccaccgcgagatggtccccgagctccccgagagtcctcagtgaaaggattccgcggcactgcctctattattataccgtaaatctttttaaattctggaactaattatatagaggatatgtctcaatttgttctgcattaatgccacagtggggatggaggccaggccgtggccagagcagatacgtaggcccatgaaattgatgaactgagagttgcttccagtcctgagcgcaccatctggaattccagtctgaggttacaattagaactcctgaccccagattcaactttgcaaacaacaggggaaaaaaatggggaaaagaaaaaccacgagagagggaaaaaaaattattctgcacctgtaaaaaaaaaaaaaaaaaaaaaaaaaaaaaaaaagtcacacaatcttaaaatctttccgtcttagacaattctttccaagtatttcttttgtgttttttaacctataaaagataatggaatgttttatagactggattttatctcatcccctttccctctcccaactgccctcagtttaatagttgtcagttttacctcagtgttgaatttaattatataggaacaaaatattcctcagtaaatttgcttgctaaatattctgtcacatttacttcccctttgagaaatggcttaattatagaaatctacctgcatctaggaattttttttcccttttcttttttgaccgccattccagcttaatcgtaagcagagattttatttgtgcagtaattttatttgtgttctaaattcgtttagccaatttcttccttctttctttagtaacaccctgctttattttcctctcactttgaccccctgaagaaaacgaaggaccaagcagtactggagaatctgttaaatttattagcataaatgcttagacaaaacgagatataaatcattcagatgtattaagccataaagtatcccaatgaagtcagtcccttgccagggtcctggtgtataaatgttcatataaaacaaggtatcagtattatctttcaaactgaatatatgttgtaaaaatatccaaggttgagttaggaatatggggggagggtgcagcagggcaggaaggggatattctttagaccagtttgttaacatagtggtggctcagaaagtatggtggaaaggaaaaatttcaaccgtttacatttggagtcttcttagataatatgtttttaaataacggtatgcaggatatatttgagagcaaaggaataagagaaaaaaaagatgactagagggagaaaggcattgatttctgtagaatgcatttgtcccccaaagatcagtttagcttcacaaaaatccacccagaggaggcactggctcttcacacagataacggattatccagtagagaagagctacctgggccttcgtctggcaactgggatatgcagccgctggtcagcagagggatgtgtattcattagcggtggaagacgaggaaagcgcccgggagtgaggaagaggaatggacagaattcctggcagaagcttaccaagacaaaaatcagacacaatgtttaagcagcaattgctcgtgaagttcataaccatggctctctgtaaatcttggcaaattgggacattctttgctttttggaaatgattgttttcaagactttttttaaaaaatcaagttgtccaccagaaaaatggaatagctcaccttccccatcttttttttaaagcagggatatcctcatcctttccgtgccattcattctttcattcattcactcaccgtgcaacaaagattgttgggcattgtagcagcaagtaggagcacagggtaatgacaggctcaccccgctctcacagtttatattccagtaggtatgacagatacattacaaggaaacaatgagatattttcatatagtagtaattgctataaaagaacaaggagatctgtaagactagagaatgactaaaggtgagatgggaatgaggagcaacagatagccctcacttccttttgctttctgcccacactaccacattttagtgtgtttaggaagtattccaccttacagtccagatgcaggaagggtttgaaggatttggaatggttggtctggataaatctctgcctacaaaactggactttatgaaagcggcagggcagctgtttatatagctggcttaaaatcatcaccactagctgagtgactctgaaagctatttaacccctgagaaattcagttttcttctcttcaagataaaaaataacagcaagttatgaggactacataaggtaaggcatgtaaatttcttagcctttaggaagcactcaatacatgttggctattatctatatagacataaattctatgctttgcttccaattaattgataagttataggcttagtattgatattggtgtgaattcagaaaaggtggaagtctttgttcttgttggatcagggtgaagagcaggaagagaaacctttgctgaatctgaccttaaacaaggttgttgccatctagaaggaaatttaaatgattttgccctacaccaggaccctaaaacaggaaatatgtggcttttgcctcaaaatcaagcttaggttccttcttttagtacagaagtctataggttaacaacctgaaaatcttagaattgcattgaaaatcttagaattgcattgttccttagagccacatttcaggtttgcagccttgtccaggataaagaattctggggtaggtataaaaacacctgaactcaaatcctatctctatcagttactgtgatcttagggaaatagcttcagctctcagtttttcagtagctttatgtgtaaaatggagattatataaaatgaaataaagcatccataggtgatttgaaaactctgaagtgtcagacagtgcagaagaccatcataacattgttacatgtgaacatgtggaaaggaatatgtctattcagaacactggggcacattgcttgctctcatggttcttcatttttaagtgagtatagtacctttcatgcagggctattgtgataagtaagtgagatcatatatataaactttcaaaacaatgcatagcatagaatgtgtgctatgtaagcatcactgctacggttattgttactgttctctggccatcttgttgggccaagtgttgaaccttataattttcacatagagagcttcttactgtagaagtttataatagtatagagagcaaggctttgggatcagatgactggggtttaaagcctcctcgctagttattttctgtatggctttgggtggcttccttattttctctgagctttaattttcataaccttaaaacagggctaatgataccatcacctcacagggttgttttgagaacaaattaaaacaccatatgtaaattgctttcgtggcacctggcatgtagtaagaaatcaataactggtagttattaaacctacaattcttctaatcagacaatattagctatgacttaaaacaggtgagcctgcaagagcttgaattacagcatgattctgaacaaacacagaaagtaatttctatcttcttttaaactcacctgtactacactgaaatctcactctttcacatatgaaagactttgcaaccaaggcactgacaaggatttcctttttgactatgaacgctttaggttaaaattctgaatctcatttatttttaatgggtttctttgcaaaatacccagcgtatgtcaaggacattggtaatcccatgttcttcaaaataagcaggaaattgatttcagccaatggggagaaaaagtagtttgatcctcttcctggagttaccacatagcatttattaatagctctgtaaacggtctggaacacagtatcagcttgctgttcaaaatatgacaaaagtttatgcaaagttgcttaggaaaaacaagatctagtcattagaaatctgacactggtcaatagtacatttattccaagtctccataaatcacaaacaaatgaaacttctattgtgatcactgttccagatctaaaagaccctcccccttactttggtagaaattaaatacattttagaaagcccaatattttttcctctacaaatagaggctaattacaaaatttcccaagaaataataaatattaaactataatcaacagatgtgacacaagatgaataagaagcacataacttagctttcattccttatgtagggcgcatgtttatctttaattatccccaacctgggaatggcataaatgttatctgttttatttattatttgtatctagagtgacatcacattttgattttgcccaggacagtctcagcttaagctgttgtcccagcttaattattaattactctccttttactccaaagtattctacttttgatggtaaataaggacttcacttgcttaaaattttattttattaaaaaaatgatagatttaagaaagccattggaacaagggtaaaagataggctaaatggggctaatgagaagaaaaaaattgaattaatattagaatcaaaggatgcagatagttactataattgagcataatgcaattctgaacttcctgacagccaagtaagaaaggggaaaatagcactagttacctatctttcgtgatgcaataaagggaagaaacctagtttttcagaagagatgaattttttctagtactaaactcaaagaggaacttaccatactagcctttctataagagttatcaggtaacggttagcgacttcaaaaataatgtttcaaaagatgcaacgacattttctggtagtttatttcaacccaatgtccacagcattaaaattatggttctgtaaactgtaagaggagagaggcaataatatagtccctttttgtagttttctggaggatctgacctgatcaaatcaacctgatttgttaatttttagaatgtgcctaatgggtttttttttatttttattttttattttttttgaggcagaatcttgctctgtcacccaggttggagtgcagtgaccccatctcggctcactacaacctccgctacccgagttcaagcgattctcttgcctcagcctcccaagtagcggggattacaggcacccaccaccccgcctggctagtttttgtatttttaatagagacagggtttcaccatgttggtcaggctggtcttaaactcctgacttcaggtgatccacccgccttggcctcccaaagtctgggattacagccgtgagccaccacgcccgaccccgtaattttttaaaagcatcttttattcgttaatcatcagttaacttgaacccgaatccaaacgctgcgaaagacctgaccattgttctccagaatctgcgaacgatttggtgagagctctagggcagtggttgttctcaactgagatgatttgcaacccagcagacgtctggcaatgtctagagatattttttgtcacgacttacagtaagacaggatcactagatgcacagtcctggtatctagtgagtagaggccagggatgctgttaaacattctataatgcacaggacagaccccccagaacaaagaattatccagcctaaaatgtcaatagtgccgagactgagaaactgtgccccagggtactgttagaagaagggatggagggccaggcgcggtggctcacgcctgtaatcgcagcactgtgggaggtcaggcgggcggatcacgaggtcaggagatcaagaccatcctgattaacacggtgaaaccccgtctctactaaaaaatacaaaaaattagccgggagtggtggcgggcgcctgtagtcctagctgcttgggaggctgaggcaggagaatggcgtgaacccagcaggcggagcttgcagtgagctgagatcgcgccactgcactccagcctgggcaacagagtgaggatctgtctctaaataaatatataaataaaagaagggatggagacatagtttttagctggagtcaaaagaaaaaatcctcatggggaaggggagcttgggctagattccttcatcccacccagtggagctggaggatgtctctccccaagctcagcaaatgtcaggaaaaaaatacaagaagaggcaatcatgtggaaatgcagtccacaaagggaattgtggataaactcatttaaccagaaaggaggaagaatccatgtagagcaataagaaagaaagccagatagcacagcacatgcaaatttagggcaaagagtttctgttttgatgttatgctccaatatcactaaatattgctggtattttttaaagccacacaaatcaagggcagcataaacttttatgttcccagagttcatctttggaatactggcttatagtgtatatgtggatatgcacatattttgcttcctctcctccacatcgttttttaccacttacataatagggattccttggaactcagttttatatcacattaaatttaaaaatgggtgcctactcaaaaagacaacctatcaaggcacagaaaattctgaaccactgctgtaatgaatacatcattggaatctccattaagaaatattattctgacctagttctctgtgtcatgctgcagattgtccttctcttgactcatggaatgctttgtgagaaagaactacaaagccgggtccctcgatattagccatctcacccttcaaagttcagccaggagtgggacaaaaccctcgtcaccatgttgacatgtttacttctggcgcaggaaaatactgctgttgcccaatttggtttcccagtccattcacttgcctggagacatatattttatgctttcctttgatgatttacaaataaattaacgtgattcactaaggtctgccagcatatatgcgttactggagaaatctgagatgttgaaaaagtattttaatttattgtatcccaatactttcttaagaaagtttcttaagaaccaaataaatatcatcagctagtttatatacctgacatatttattacggtattcccgctgagcacttcccattgtcatgtgttctcacacattgttttcacaaattgtgttttgaaagaagtcaagggaaattcaggccagagaagcaagatgttatcttttggaaaggatgagcccactctaatggaagaggataatccattcagaggtttgtgaggccaatatcccccagtgggtgtgataaatccacagcgtctgaatccagaattttgcactgggaccttgaagttgcatgaacaatttagtcatgttccaaataaacacagtgtatcattattattattggataaacatgaacatctgttaggtcaagtttgccctatttccttaaaggcaactggagtccctgaacacagttctcatatgtctatcacaaatggatctgagatgggtgtataatgccaaagcggctccttgaccatctctgtgtttggaaaccagattttaaaaagaaaaaaaaaagtcacctgctcatctgaggtgggtcacatgcctagagagcaccatagagactgcagttcccttctgaatcccatcaacagagctactgtcaaaagatgaaaatatttgaatcagctggccttcttcatttttaaagcaatgttgtacatattttaagcaattatttggggcgagaggactctaattgacaccattctcttgtcctaactcagcctggcacctttccagctgtcactcagtgggcacaggatatggaggatgatttctcaccaggctgaatcagcaggttgcagcaggttacaactgcaagggactttacaaagcttctaatcctacccctcatttttcagataagacattattgatacgatctgcccaagatcatgcacttagttagtggcagagctttacccaaggccaggaaataaaatctgtctttctggaacagcattcattggtttgcacttaccgagtaccttttacag

SEQ ID NO: 2271 - DNA, 10357 bp, Homo sapiens
gcggtcgggttgcggagagcccccgggtgtgggcgctgccttgaactccttaccccagctgcctggctgccctcagcttcccaaagctcaaataagaggggccggcggcgcggggaagaggaggagccaggaggctcggccgctccattcactcagcagcccaagcccggccaggcagcgcgcgctgctccttgggggcgccctcgcagctggggtgagggcgggtccgagggagcgtccctctcggagacaccctcctcttcaacccaacacgcgctctcagctggccggtgtggcacaaccctccccccacctccccttcttggccttcgccagtgtgggagcctcgtctcactggagagtccgttcagcttgcattgcataaacgttgtcgccattaaattctggctgcggacccgaagtgtgtgcgggcccaggacttactcgaagggcgcacttcttgggaatgcgcatcccgtaggcgcaggagaccctgaggaatccttgtgggggcggggaggggaagagcaccggtgcgaaccccggggtgccccctcgcccgacttggacttctccgactaaagaggtgggaggagttccctgcagcctgcggggccaagaagaaagtgctaagctgaggagccgcagtcggaggaccccagggacccgacaggaagtctccgtacgaccccaacggatccacatgcccggaagcccaggcgacactaagccagcgctggggaactgacgtactcctgcagtcgcagggcgctccatgcctctctgtcctcttctttgttgtgggtaacgttctctgcgggagacctgaggttttccaagggggacatgccagctacactggccttggcgccctgagctaagcaccaggactcacagcctagcacgaaggcaggtagcaccttcacccgccgcggacgataggcgctctcctgtacctcctttagctcgcgaggcccgcccttcgcgaggtcccagagaaaagcaggctgtggaaaactgggcgcccccttctttcacccaccttcttacccctgtcagcgccgagatctgtagcagaggttcctggtctgaaccaccgattggcaaagaaagctgcagattaaacttctcgttttacagagaaggaaactgaggcccagacagccgaaggagaggcagtctatggagcgcagcggtaaagagcaaggggttggtggccccagaatggaacctcagctctgccaggtaaccaacagctgtgtgaccctagacgagttccgcagtctctctgagcctcagtttccttactggtcaaacgggataatgggatactagcgcccacctcatagagttgttctgaggattagataggagagcagtgtgggcctttgactcaatcaactttacagtttttgttactactactgtttaaggacaggaaacaagttagtggcaacgccgagctgaaacccgggtctctcaacgtccagttggaggttttacccaccacccctctacctcttcagagctaatgggatgcagaggcgaggacagcccctggaaaaccatgtggcgttgatacactggcaaagcgcaggcatcccggcctcgaaggtgcataattattgcaatatgaaaaaatcgaggctgggtaggagcagggcagtgaggatttctcaacccttactttcaccccggcgctgtccactgcatctgacagagcgcggagctgggctgctacagccgcaaccccagggaccagtgcgcacgcctgggccgccctccgggagtcacccagcggccgcggacaactgaataaacaccccaaagcgctgcggtcggtcaagggcggggacagccacactgcgcgcggggcccgcaggccgtaataaagagtggctcgacctcgctgctgcctgtcgcgggagaggaacaagctttcgactagcgcctctccccggggcccgcgccccgagccccacgcgcaagacagcccaacagctgttcctcccctccccgccgactccaactcttcggaatctgcccactcggggctgcagggcaagtgtttaggatggttcccagccccgcgctggcggtgaaaatttcaacgtcattccttcaattaaaaaaaggggggggcaagggaggggctttgtgataactactcccagcttcttctgatcatttcaaaattaagtcgattttttttaaccagtccccacttactgtcctaactctcctcgctgaccctatctgggagcccggaaccgttaggtactgccgaatgcggtgcaaaatttccccctctcccccagttcgcagtgcctggagccgctggggttactcgtctgttctgatgccaccgcgagatggtccccgagctccccgagagtcctcagtgaaaggattccgcggcactgcctctattattataccgtaaatctttttaaattctggaactaattatatagaggatatgtctcaatttgttctgcattaatgccacagtggggatggaggccaggccgtggccagagcagatacgtaggcccatgaaattgatgaactgagagttgcttccagtcctgagcgcaccatctggaattccagtctgaggttacaattagaactcctgaccccagattcaactttgcaaacaacaggggaaaaaaatggggaaaagaaaaaccacgagagagggaaaaaaaattattctgcacctgtaaaaaaaaaaaaaaaaaaaaaaaaaaaaaaaaagtcacacaatcttaaaatctttccgtcttagacaattctttccaagtatttcttttgtgttttttaacctataaaagataatggaatgttttatagactggattttatctcatcccctttccctctcccaactgccctcagtttaatagttgtcagttttacctcagtgttgaatttaattatataggaacaaaatattcctcagtaaatttgcttgctaaatattctgtcacatttacttcccctttgagaaatggcttaattatagaaatctacctgcatctaggaattttttttcccttttcttttttgaccgccattccagcttaatcgtaagcagagattttatttgtgcagtaattttatttgtgttctaaattcgtttagccaatttcttccttctttctttagtaacaccctgctttattttcctctcactttgaccccctgaagaaaacgaaggaccaagcagtactggagaatctgttaaatttattagcataaatgcttagacaaaacgagatataaatcattcagatgtattaagccataaagtatcccaatgaagtcagtcccttgccagggtcctggtgtataaatgttcatataaaacaaggtatcagtattatctttcaaactgaatatatgttgtaaaaatatccaaggttgagttaggaatatggggggagggtgcagcagggcaggaaggggatattctttagaccagtttgttaacatagtggtggctcagaaagtatggtggaaaggaaaaatttcaaccgtttacatttggagtcttcttagataatatgtttttaaataacggtatgcaggatatatttgagagcaaaggaataagagaaaaaaaagatgactagagggagaaaggcattgatttctgtagaatgcatttgtcccccaaagatcagtttagcttcacaaaaatccacccagaggaggcactggctcttcacacagataacggattatccagtagagaagagctacctgggccttcgtctggcaactgggatatgcagccgctggtcagcagagggatgtgtattcattagcggtggaagacgaggaaagcgcccgggagtgaggaagaggaatggacagaattcctggcagaagcttaccaagacaaaaatcagacacaatgtttaagcagcaattgctcgtgaagttcataaccatggctctctgtaaatcttggcaaattgggacattctttgctttttggaaatgattgttttcaagactttttttaaaaaatcaagttgtccaccagaaaaatggaatagctcaccttccccatcttttttttaaagcagggatatcctcatcctttccgtgccattcattctttcattcattcactcaccgtgcaacaaagattgttgggcattgtagcagcaagtaggagcacagggtaatgacaggctcaccccgctctcacagtttatattccagtaggtatgacagatacattacaaggaaacaatgagatattttcatatagtagtaattgctataaaagaacaaggagatctgtaagactagagaatgactaaaggtgagatgggaatgaggagcaacagatagccctcacttccttttgctttctgcccacactaccacattttagtgtgtttaggaagtattccaccttacagtccagatgcaggaagggtttgaaggatttggaatggttggtctggataaatctctgcctacaaaactggactttatgaaagcggcagggcagctgtttatatagctggcttaaaatcatcaccactagctgagtgactctgaaagctatttaacccctgagaaattcagttttcttctcttcaagataaaaaataacagcaagttatgaggactacataaggtaaggcatgtaaatttcttagcctttaggaagcactcaatacatgttggctattatctatatagacataaattctatgctttgcttccaattaattgataagttataggcttagtattgatattggtgtgaattcagaaaaggtggaagtctttgttcttgttggatcagggtgaagagcaggaagagaaacctttgctgaatctgaccttaaacaaggttgttgccatctagaaggaaatttaaatgattttgccctacaccaggaccctaaaacaggaaatatgtggcttttgcctcaaaatcaagcttaggttccttcttttagtacagaagtctataggttaacaacctgaaaatcttagaattgcattgaaaatcttagaattgcattgttccttagagccacatttcaggtttgcagccttgtccaggataaagaattctggggtaggtataaaaacacctgaactcaaatcctatctctatcagttactgtgatcttagggaaatagcttcagctctcagtttttcagtagctttatgtgtaaaatggagattatataaaatgaaataaagcatccataggtgatttgaaaactctgaagtgtcagacagtgcagaagaccatcataacattgttacatgtgaacatgtggaaaggaatatgtctattcagaacactggggcacattgcttgctctcatggttcttcatttttaagtgagtatagtacctttcatgcagggctattgtgataagtaagtgagatcatatatataaactttcaaaacaatgcatagcatagaatgtgtgctatgtaagcatcactgctacggttattgttactgttctctggccatcttgttgggccaagtgttgaaccttataattttcacatagagagcttcttactgtagaagtttataatagtatagagagcaaggctttgggatcagatgactggggtttaaagcctcctcgctagttattttctgtatggctttgggtggcttccttattttctctgagctttaattttcataaccttaaaacagggctaatgataccatcacctcacagggttgttttgagaacaaattaaaacaccatatgtaaattgctttcgtggcacctggcatgtagtaagaaatcaataactggtagttattaaacctacaattcttctaatcagacaatattagctatgacttaaaacaggtgagcctgcaagagcttgaattacagcatgattctgaacaaacacagaaagtaatttctatcttcttttaaactcacctgtactacactgaaatctcactctttcacatatgaaagactttgcaaccaaggcactgacaaggatttcctttttgactatgaacgctttaggttaaaattctgaatctcatttatttttaatgggtttctttgcaaaatacccagcgtatgtcaaggacattggtaatcccatgttcttcaaaataagcaggaaattgatttcagccaatggggagaaaaagtagtttgatcctcttcctggagttaccacatagcatttattaatagctctgtaaacggtctggaacacagtatcagcttgctgttcaaaatatgacaaaagtttatgcaaagttgcttaggaaaaacaagatctagtcattagaaatctgacactggtcaatagtacatttattccaagtctccataaatcacaaacaaatgaaacttctattgtgatcactgttccagatctaaaagaccctcccccttactttggtagaaattaaatacattttagaaagcccaatattttttcctctacaaatagaggctaattacaaaatttcccaagaaataataaatattaaactataatcaacagatgtgacacaagatgaataagaagcacataacttagctttcattccttatgtagggcgcatgtttatctttaattatccccaacctgggaatggcataaatgttatctgttttatttattatttgtatctagagtgacatcacattttgattttgcccaggacagtctcagcttaagctgttgtcccagcttaattattaattactctccttttactccaaagtattctacttttgatggtaaataaggacttcacttgcttaaaattttattttattaaaaaaatgatagatttaagaaagccattggaacaagggtaaaagataggctaaatggggctaatgagaagaaaaaaattgaattaatattagaatcaaaggatgcagatagttactataattgagcataatgcaattctgaacttcctgacagccaagtaagaaaggggaaaatagcactagttacctatctttcgtgatgcaataaagggaagaaacctagtttttcagaagagatgaattttttctagtactaaactcaaagaggaacttaccatactagcctttctataagagttatcaggtaacggttagcgacttcaaaaataatgtttcaaaagatgcaacgacattttctggtagtttatttcaacccaatgtccacagcattaaaattatggttctgtaaactgtaagaggagagaggcaataatatagtccctttttgtagttttctggaggatctgacctgatcaaatcaacctgatttgttaatttttagaatgtgcctaatgggtttttttttatttttattttttattttttttgaggcagaatcttgctctgtcacccaggttggagtgcagtgaccccatctcggctcactacaacctccgctacccgagttcaagcgattctcttgcctcagcctcccaagtagcggggattacaggcacccaccaccccgcctggctagtttttgtatttttaatagagacagggtttcaccatgttggtcaggctggtcttaaactcctgacttcaggtgatccacccgccttggcctcccaaagtctgggattacagccgtgagccaccacgcccgaccccgtaattttttaaaagcatcttttattcgttaatcatcagttaacttgaacccgaatccaaacgctgcgaaagacctgaccattgttctccagaatctgcgaacgatttggtgagagctctagggcagtggttgttctcaactgagatgatttgcaacccagcagacgtctggcaatgtctagagatattttttgtcacgacttacagtaagacaggatcactagatgcacagtcctggtatctagtgagtagaggccagggatgctgttaaacattctataatgcacaggacagaccccccagaacaaagaattatccagcctaaaatgtcaatagtgccgagactgagaaactgtgccccagggtactgttagaagaagggatggagggccaggcgcggtggctcacgcctgtaatcgcagcactgtgggaggtcaggcgggcggatcacgaggtcaggagatcaagaccatcctgattaacacggtgaaaccccgtctctactaaaaaatacaaaaaattagccgggagtggtggcgggcgcctgtagtcctagctgcttgggaggctgaggcaggagaatggcgtgaacccagcaggcggagcttgcagtgagctgagatcgcgccactgcactccagcctgggcaacagagtgaggatctgtctctaaataaatatataaataaaagaagggatggagacatagtttttagctggagtcaaaagaaaaaatcctcatggggaaggggagcttgggctagattccttcatcccacccagtggagctggaggatgtctctccccaagctcagcaaatgtcaggaaaaaaatacaagaagaggcaatcatgtggaaatgcagtccacaaagggaattgtggataaactcatttaaccagaaaggaggaagaatccatgtagagcaataagaaagaaagccagatagcacagcacatgcaaatttagggcaaagagtttctgttttgatgttatgctccaatatcactaaatattgctggtattttttaaagccacacaaatcaagggcagcataaacttttatgttcccagagttcatctttggaatactggcttatagtgtatatgtggatatgcacatattttgcttcctctcctccacatcgttttttaccacttacataatagggattccttggaactcagttttatatcacattaaatttaaaaatgggtgcctactcaaaaagacaacctatcaaggcacagaaaattctgaaccactgctgtaatgaatacatcattggaatctccattaagaaatattattctgacctagttctctgtgtcatgctgcagattgtccttctcttgactcatggaatgctttgtgagaaagaactacaaagccgggtccctcgatattagccatctcacccttcaaagttcagccaggagtgggacaaaaccctcgtcaccatgttgacatgtttacttctggcgcaggaaaatactgctgttgcccaatttggtttcccagtccattcacttgcctggagacatatattttatgctttcctttgatgatttacaaataaattaacgtgattcactaaggtctgccagcatatatgcgttactggagaaatctgagatgttgaaaaagtattttaatttattgtatcccaatactttcttaagaaagtttcttaagaaccaaataaatatcatcagctagtttatatacctgacatatttattacggtattcccgctgagcacttcccattgtcatgtgttctcacacattgttttcacaaattgtgttttgaaagaagtcaagggaaattcaggccagagaagcaagatgttatcttttggaaaggatgagcccactctaatggaagaggataatccattcagaggtttgtgaggccaatatcccccagtgggtgtgataaatccacagcgtctgaatccagaattttgcactgggaccttgaagttgcatgaacaatttagtcatgttccaaataaacacagtgtatcattattattattggataaacatgaacatctgttaggtcaagtttgccctatttccttaaaggcaactggagtccctgaacacagttctcatatgtctatcacaaatggatctgagatgggtgtataatgccaaagcggctccttgaccatctctgtgtttggaaaccagattttaaaaagaaaaaaaaaagtcacctgctcatctgaggtgggtcacatgcctagagagcaccatagagactgcagttcccttctgaatcccatcaacagagctactgtcaaaagatgaaaatatttgaatcagctggccttcttcatttttaaagcaatgttgtacatattttaagcaattatttggggcgagaggactctaattgacaccattctcttgtcctaactcagcctggcacctttccagctgtcactcagtgggcacaggatatggaggatgatttctcaccaggctgaatcagcaggttgcagcaggttacaactgcaagggactttacaaagcttctaatcctacccctcatttttcagataagacattattgatacgatctgcccaagatcatgcacttagttagtggcagagctttacccaaggccaggaaataaaatctgtctttctggaacagcattcattggtttgcacttaccgagtaccttttacag

SEQ ID NO: 2272 - DNA, 7286 bp, Homo sapiens
gcggtcgggttgcggagagcccccgggtgtgggcgctgccttgaactccttaccccagctgcctggctgccctcagcttcccaaagctcaaataagaggggccggcggcgcggggaagaggaggagccaggaggctcggccgctccattcactcagcagcccaagcccggccaggcagcgcgcgctgctccttgggggcgccctcgcagctggggtgagggcgggtccgagggagcgtccctctcggagacaccctcctcttcaacccaacacgcgctctcagctggccggtgtggcacaaccctccccccacctccccttcttggccttcgccagtgtgggagcctcgtctcactggagagtccgttcaggtaagcagtgagtccgggcagggtcgaatgcggtgggagtagagatggggttgttaatctaaaagagtggtttggagggaggggcaggtaggctccaagagggcgggaacttcaggaaagcgcagaaagaactcagtcaagcttcaaagaagcgtatacccttgctttgcacccttgagtctggctcttgcttctagaactgtcgggtaggggagtggccatgatcttggggtcactggggaaagaggtggccctttgtgggttccagaggtcgggactgaaagcgaacgtccctcagttgggtggccgggagttgcaccagttataagccgggcgtatttcgatcggctagtagttgtttacttggtgaggtttgcgccaggcggaaggcggttgccgcctacctaaaattggagtcagcagcacttagtttccctttccagtgaggaatatctaattcttctacggttaagccgggaaaacagcggctagtttaggagggaagaaaacccttgggcaaacgcccaaagcctgcgtatattccggccggagcatcctggcgcccagtttggggaggaggggtgaaggggagggtttggatacgaagcccggcagggagcgggtaactcctggagccactccgccgagcactgcctgtggccctggtcgaggataccattctggttgctcagtgattgaccaggaggcggaagccagttaaggggaccaaggagtggagtagggagaacctccatcggcccacgggcgcgagttagtgttcgaatctttgggagctcgaagagcttcgctaaatctgactcccttcgtctagtctctgtttggcagcccccgcgccccagagcaggtgtttggggcgggtagggggtgttttggtttggtttttggatcttctaaaggagtcagtatctattgggaaacaacccctaggcaaggagaagaaccgggggccggagcggagcgtgtttcagaggtgcgtataaaatcccaggggcgccaggaggcagcagcgacggcgcagcgtgggacggccaggcgcgacgggagggaagcaaccggttgcagtccggcctcctgtacctggctggcccgggctggggctgcaagctttccagccaaacttatgtgaagcaaagtagttgcagtttgacaaagaatggcgtttcaataaatgacatagtaattttttacgctttggtttttagcttgcattgcataaacgttgtcgccattaaattctggctgcggacccgaagtgtgtgcgggcccaggacttactcgaagggcgcacttcttgggaatgcgcatcccgtaggcgcaggagaccctgagggtaaagatgcggcacttgagccctccgcttgcctcccaggccacctttgctgcttgactttgcgtcgtctccactcagaagcttttaaaattattattaagaaaagaaagattctacaagacactgcccccacgctctctgctcagtcctctcccacacgatctatccctaaacctttcgcggggctcgcgcgtttggttttttgagtggagaaaggactctcgagacaaaattcactgccagttgccctaagaaccccccagatccctgtatctcccttccttctccccgcctattatttctacttggaagtcgtttttcttaactaggactcaactgtgaggggcgaggagccctttatgaaaagccggggactttcatttccaaacgaaaagattgagattgtttcttcttttaccatccttggcacttttagcggggggagaggaggttatctgaagggaggctggcttgaatgtgagtcgttgtgtttgtgaaacccagaatccttgtgggggcggggaggggaagagcaccggtgcgaaccccggggtgccccctcgcccgacttggacttctccgactaaagaggtgggaggagttccctgcagcctgcggggccaagaagaaagtgctaagctgaggagccgcagtcggaggaccccagggacccgacaggaagtctccgtacgaccccaacggatccacatgcccggaagcccaggcgacactaagccagcgctggggaactgacgtactcctgcagtcgcagggcgctccatgcctctctgtcctcttctttgttgtgggtaacgttctctgcgggagacctgaggttttccaagggggacatgccagctacactggccttggcgccctgagctaagcaccaggactcacagcctagcacgaaggcaggtagcaccttcacccgccgcggacgataggcgctctcctgtacctcctttagctcgcgaggcccgcccttcgcgaggtcccagagaaaagcaggctgtggaaaactgggcgcccccttctttcacccaccttcttacccctgtcagcgccgagatctgtagcagaggttcctggtctgaaccaccgattggcaaagaaagctgcagattaaacttctcgttttacagagaaggaaactgaggcccagacagccgaaggagaggcagtctatggagcgcagcggtaaagagcaaggggttggtggccccagaatggaacctcagctctgccaggtaaccaacagctgtgtgaccctagacgagttccgcagtctctctgagcctcagtttccttactggtcaaacgggataatgggatactagcgcccacctcatagagttgttctgaggattagataggagagcagtgtgggcctttgactcaatcaactttacagtttttgttactactactgtttaaggacaggaaacaagttagtggcaacgccgagctgaaacccgggtctctcaacgtccagttggaggttttacccaccacccctctacctcttcagagctaatgggatgcagaggcgaggacagcccctggaaaaccatgtggcgttgatacactggcaaagcgcaggcatcccggcctcgaaggtgcataattattgcaatatgaaaaaatcgaggctgggtaggagcagggcagtgaggatttctcaacccttactttcaccccggcgctgtccactgcatctgacagagcgcggagctgggctgctacagccgcaaccccagggaccagtgcgcacgcctgggccgccctccgggagtcacccagcggccgcggacaactgaataaacaccccaaagcgctgcggtcggtcaagggcggggacagccacactgcgcgcggggcccgcaggccgtaataaagagtggctcgacctcgctgctgcctgtcgcgggagaggaacaagctttcgactagcgcctctccccggggcccgcgccccgagccccacgcgcaagacagcccaacagctgttcctcccctccccgccgactccaactcttcggaatctgcccactcggggctgcagggcaagtgtttaggatggttcccagccccgcgctggcggtgaaaatttcaacgtcattccttcaattaaaaaaaggggggggcaagggaggggctttgtgataactactcccagcttcttctgatcatttcaaaattaagtcgattttttttaaccagtccccacttactgtcctaactctcctcgctgaccctatctgggagcccggaaccgttaggtactgccgaatgcggtgcaaaatttccccctctcccccagttcgcagtgcctggagccgctggggttactcgtctgttctgatgccaccgcgagatggtccccgagctccccgagagtcctcagtgaaaggattccgcggcactgcctctattattataccgtaaatctttttaaattctggaactaattatatagaggatatgtctcaatttgttctgcattaatgccacagtggggatggaggccaggccgtggccagagcagatacgtaggcccatgaaattgatgaactgagagttgcttccagtcctgagcgcaccatctggaattccagtctgaggttacaattagaactcctgaccccagattcaactttgcaaacaacaggggaaaaaaatggggaaaagaaaaaccacgagagagggaaaaaaaattattctgcacctgtaaaaaaaaaaaaaaaaaaaaaaaaaaaaaaaaagtcacacaatcttaaaatctttccgtcttagacaattctttccaagtatttcttttgtgttttttaacctataaaagataatggaatgttttatagactggattttatctcatcccctttccctctcccaactgccctcagtttaatagttgtcagttttacctcagtgttgaatttaattatataggaacaaaatattcctcagtaaatttgcttgctaaatattctgtcacatttacttcccctttgagaaatggcttaattatagaaatctacctgcatctaggaattttttttcccttttcttttttgaccgccattccagcttaatcgtaagcagagattttatttgtgcagtaattttatttgtgttctaaattcgtttagccaatttcttccttctttctttagtaacaccctgctttattttcctctcactttgaccccctgaagaaaacgaaggaccaagcagtactggagaatctgttaaatttattagcataaatgcttagacaaaacgagatataaatcattcagatgtattaagccataaagtatcccaatgaagtcagtcccttgccagggtcctggtgtataaatgttcatataaaacaaggtatcagtattatctttcaaactgaatatatgttgtaaaaatatccaaggttgagttaggaatatggggggagggtgcagcagggcaggaaggggatattctttagaccagtttgttaacatagtggtggctcagaaagtatggtggaaaggaaaaatttcaaccgtttacatttggagtcttcttagataatatgtttttaaataacggtatgcaggatatatttgagagcaaaggaataagagaaaaaaaagatgactagagggagaaaggcattgatttctgtagaatgcatttgtcccccaaagatcagtttagcttcacaaaaatccacccagaggaggcactggctcttcacacagataacggattatccagtagagaagagctacctgggccttcgtctggcaactgggatatgcagccgctggtcagcagagggatgtgtattcattagcggtggaagacgaggaaagcgcccgggagtgaggaagaggaatggacagaattcctggcagaagcttaccaagacaaaaatcagacacaatgtttaagcagcaattgctcgtgaagttcataaccatggctctctgtaaatcttggcaaattgggacattctttgctttttggaaatgattgttttcaagactttttttaaaaaatcaagttgtccaccagaaaaatggaatagctcaccttccccatcttttttttaaagcagggatatcctcatcctttccgtgccattcattctttcattcattcactcaccgtgcaacaaagattgttgggcattgtagcagcaagtaggagcacaggattgtccttctcttgactcatggaatgctttgtgagaaagaactacaaagccgggtccctcgatattagccatctcacccttcaaagttcagccaggagtgggacaaaaccctcgtcaccatgttgacatgtttacttctggcgcaggaaaatactgctgttgcccaatttggtttcccagtccattcacttgcctggagacatatattttatgctttcctttgatgatttacaaataaattaacgtgattcactaaggtctgccagcatatatgcgttactggagaaatctgagatgttgaaaaagtattttaatttattgtatcccaatactttcttaagaaagtttcttaagaaccaaataaatatcatcagctagtttatatacctgacatatttattacggtattcccgctgagcacttcccattgtcatgtgttctcacacattgttttcacaaattgtgttttgaaagaagtcaagggaaattcaggccagagaagcaagatgttatcttttggaaaggatgagcccactctaatggaagaggataatccattcagaggtttgtgaggccaatatcccccagtgggtgtgataaatccacagcgtctgaatccagaattttgcactgggaccttgaagttgcatgaacaatttagtcatgttccaaataaacacagtgtatcattattattattggataaacatgaacatctgttaggtcaagtttgccctatttccttaaaggcaactggagtccctgaacacagttctcatatgtctatcacaaatggatctgagatgggtgtataatgccaaagcggctccttgaccatctctgtgtttggaaaccagattttaaaaagaaaaaaaaaagtcacctgctcatctgaggtgggtcacatgcctagagagcaccatagagactgcagttcccttctgaatcccatcaacagagctactgtcaaaagatgaaaatatttgaatcagctggccttcttcatttttaaagcaatgttgtacatattttaagcaattatttggggcgagaggactctaattgacaccattctcttgtcctaactcagcctggcacctttccagctgtcactcagtgggcacaggatatggaggatgatttctcaccaggctgaatcagcaggttgcagcaggttacaactgcaagggactttacaaagcttctaatcctacccctcatttttcagataagacattattgatacgatctgcccaagatcatgcacttagttagtggcagagctttacccaaggccaggaaataaaatctgtctttctggaacagcattcattggtttgcacttaccgagtaccttttacag

SEQ ID NO: 2273 - DNA, 7286 bp, Homo sapiens; identical to SEQ ID NO: 2272

SEQ ID NO: 2274 - DNA, 678 bp, Homo sapiens
cccagttggagcttcccagcagctttgtttacctaagcaagcctgggcaatggcgggcgcccctcccccagcctcgctgctgccttgcagtttgatctcagactgctgtgctagcaatcagcgagactccgtgggcgtaggaccctccgagccaggtgtgggatgtaatttcgtggtgcgccgttttttaagcccgtcggaaaagcgcagtattcgggtgggagtgacccgattttccagtgagatgaacccggtacctcagatggaaatgcagaaatcacccatcttctgcgtcgctcacgctgggagctgtagacctgagctgttcctattcggccatcttggctcctccccccagatgaggaagctggaacttgtaggggatttaagaacctagccacacatcaagcacttggagctgacctttgttctgttggggacaccagccagattctaatggatagtgtttttcacatcctcagctcatcagccaactgacagagataatccaggaccattagttaaaaaaagaatcattatcttttggttaatctgaataaagtgaaaaaaaaaaaggtgccagtgacagaccaagggctttacaaactgtagttaaagaaatattaggaaaaattaggaatccaacttacaagggatgcgaaggacctcttcaaggag

SEQ ID NO: 2275 - DNA, 678 bp, Homo sapiens; identical to SEQ ID NO: 2274

SEQ ID NO: 2276 - DNA, 368 bp, Homo sapiens
ctgggggccaagagggaggcttccagaagacaacaaaagtccatgaagaacagggcacttctcagcaaccctcaaggaagcaattgaactaaagcttgaaaaccatggggtcactgagagaaggagcctgaagagagaaaaggatgaaggacccaaaaaagactaacatttaacagatgggatgtgaaacagaaccagttccagaaacctatggagaaagcacatggagataattagttctacttccagagagggtaaacatatcacaaatttttgtgacattgaagaaagaagagtttcttgagccatcactttattaatctgcaaagacttcattgatctgtatgactttggcatccctttgaatt

SEQ ID NO: 2277 - DNA, 2478 bp, Homo sapiens
gtgaatggacccgaggctgccccacctgacgaaatcagaacacacagagaagctgccgggagacccgggccgcaggagagaagacccagggaactcccagctggtgcaactgcccaggaggggtctttgtcagtgaggactggcaaaatcagtcgattttgtctgtctttatcttctttttattaagctcccatagttcaggtatgtatggtttccccagcctgcagaggctcagaaactgccaaggggagcaaggtgccctgaccagagaggggtcactccccatagaagagagacttgaagggcagacttcacggacccagctggatcttgggacattcctgacaacccagtcggggccctgcgctccctccccttgtagagatccccacattccaaattcgctgtcttgggaaggcaccccattcccgcttaaggatgcttcctcacacctcccctttcagatttcccattctcacccctcagccctacccccaccttatcttgcacccacacaccccatcggcgggttcctccaccccgggccgcccccgctcgaccccgttccccactggtggcacggaggcctgctcaataaacgacctttagtctcggattgccggcccggacattccactgaattctgtgaatgtgtagcagggttggaggaccctcggaataacccccttggggaggtggacaaggacaatctcagcgaagagcttgctcccctcctccccacccttaggaaacgtccgtgaaccggagtgagagggcagtgggagttcagggagcaaagtccaggcggaggagcgtgaggcggggcttccgtccgtcccgcacacttctgggattgttttctctttcagaaagcgctactgcggagtgaaccggtccttatatcttagtttcgtgactttgggggcggcaggcctgtgagttgttttccgccctggacgctgttttgcaaagatctctgcgcgcccaccgccaccctcccgggcgtgcgggccgggaagcagccagcggtgggaaactccgacgccctcctcgacacttttctccccccaactccccaagactcacttctagggaagtcctttttcccatcaagccctgggaaagactggccaggctgagagagggacccgtcctcctctgtgccaaaggcgggagcaaatcctggtgctgtcgcctttggatgtgagtcctggaaatggcgggggtgaggaaggtgggcaggggcaaggtttggccctcaggcgagaaccgacgccttgtcccggaagcgcagcacggccgagtgcgtccgggggtgcagacggcgccctggggtggtcctgccgccacctctcctttgactcaggagcgccgcgccgcgtccgggcgcgttctcagtcgcgcgaagccagagaggaccctgggcgtgattctccctccctggcacagacggagacccgagtgaccccggggtccgggtgggcgtggggaatggacccatagacccgggacgagcggcgcggagcccgcagctggccagcttcagccaccttgggagacgcagtgcagctgccgctgctgacagacaagaccaaggctcggctgggccccaccccagatccggcctgagcgccttccgcgctgctcggcctcaaggcgaaacttttcgcgcagaaactcctggagaacagccccggccgccagaagcgtacccaggccgtctgctgtgtgcccaccccgatccccatcagtgccccacgcactcgagctcttcttcggcgtctgcagcctcttcatccgcgcggagaggcggaggtctcccggaaacagtgtccgactgtggcaccccagagcgtccaatgcgagctcaggcctttcccgcaagtctggagttttcttatccagttgaggccgccttcgctgtactcactctctgcctcccaccccatcttctgccacccgacctccatctttgatggttagcgccttcagccctcaacagcttcgcacaaccaacccctagaagccgtggagtcagaccggccagggtgggacctaggttttaactcgggttctggctacacacgctgcgcctccatacagtttgtcccaggtttggcagcaggccggctaccttcaggaattctttgctttggcttctgtctgttcctgtctgttgggcaagtttctagctaccccactgagagaaccatagaacaaggaccctggcatggcatacagacaaggaatgtttgctgaattaatggagctggtgccttgcagcttcccttttgttccttgaagttgcccttgctctcctccacatcagctccctctcctcctcagctacttattccccaccctggcttcttctagtcgcagtccccaagtacttgctgaatcctgtatggacagcctaagcctccatttctgacaattcctgtggccccactccatttgttttttagacttctccct

SEQ ID NO: 2278 - DNA, 2478 bp, Homo sapiens; identical to SEQ ID NO: 2277

SEQ ID NO: 2279 - DNA, 3966 bp, Homo sapiens
aaagggtttacagtatcacagatgagttaaaagcaggctatttatagtgagtacacttcaagggcacatatatttaggagtgtggagcaaagaagaatgcaaagcctgattggggttgggggtgtgatcagggaaagtggccaaaagcctttcgtggagagacaggatctgaggaagggaaggagttcattattattctctgaagtcatcagggagcaccaagagggtgggatttcaggaagtatttaaatgaaaggagacacatggcttggcacagtgagagggaggttttccaggcttcctgtgctgtcttggggacctgctcagaggctggaccgcgtcatgctcagaaggccctgttttctttagacgctgactcctgctgtctgccagatcctcgtggtacaatgactggtgtagactggcttgttgaagtcactctctggatctgagcaacgctggctgagccgtgatgaagtattcctatccatccactatgcttcacagtgggaatctctcactgttcatcaccgctgccctagcagccgcaggccttctcctcttcagatggactgcagggggccacgagactccagtggcagccgctcaactctgaacacagccactgcatagagggttcagtgaagtgagtggggttgttactccccaccaagcagtgagtggctttctgctgttccactccagaggcctcacctcctgtgtttttaaactccagtttctgtctttccctgttggcaccaaacttatcttcataaaatataaatcaaatcacattatttccccatgaaatttgttgacgcctgtggctagtgggatcggtgccaaatcctcagcttactctgtaagatctttcacattctggcccccagcaactctcagcacttctcctggcactcctcaggtgacctctgctttagtaacccaggactcaccagtgttcctcaaagctcactatgacttttcattaagtcaagcttctgcatgtgctattttctctgccttgcaaaccctttcccttgctaggcaaattcacacttgttcccacataaaagatgatctcctctgtgaaggtaatccttggctcccctctgggtacctatagcactttgttcagaccttaaagaagttactgctttgcatgagaacacatttgtacatccaaccctccctggaggctttgagcatcttgagggactggaccgctggtgtattcttcttggaattcactgtgtctagtacaggtctgttgaatgatggaataacagcagcaacaaacccacatccacgacaacaacagttaaccttgactgggagcatttatgctgtgctgaatgctttgctaaatgctttacaagcctcagctcagtcctttaaggaaagtgacactactacccccattttttggtgaacgtaagtgctaatttggtcaggacctggagttcatctttgttttgcctagggaacaaaaacttatgaggcttacacatatcaccaatagaatgtttaaaaaaaaactttaaaatactggagtataactttttaaatccattctaacatgttagaggctcttgctttcatatgcaaagagctgatgtgccaatcataaattcaatctaactgctaaagcaatctccaaaaaaagaaaaattgtttaagacgtttccttaacccaatgtcacttttagcttgtatctgaaagttataaaagtgtttccttggaaaatatccttagtgaaggtgtttaatggagccaccttggccttgccctggttagtatgaatcaggcttaagagccatcgatggctatgcctcctactcatttcccaggcaatatctatgttagcctttgccaatgccagtgctttgtaccacatgccctgctttggtgtacaatttgaaatgccgaaagcactcactgaaaacttaagccaatccacaaaatatggctctgagaatccttcccataatggattcagttatagtttcatcattctaggtaattataaaggatagtaaagataactataatttcttaagaccctcttatttttcagctgtgcattgcctcaaaccccatattccatttacagaggaagaaactgaggctcaataatttgtgtaatttgtctaagatctccctgcaagtgaacgtagaacttgggaatggaaccaagattagtcttctaagtcctatgttcttcaccagtgagctacacagccttacggtgcagatagcacagcgtctgtgggcatccaacactcgaatagtttggaaaatcatcagcctgtgttccccaaatgagatctggtgcctcttcttggcctcagtatttctaggggaattccacattctgtgttatcagggtaggttaatcctaaaggtaactgggtactcgttcactattctgtagggttggagatttcctttggacattttccttgggcatggtgatgagtggcaccagggtaaggatgtagtgggcgacagctggcatagtagcctaagagcagggtaactggctgacctgcttagtgggccatgtttcaatctgtccctgatcttttcctaagcactctgtttctatcttattttgtttctacttctggcatgatctagacgaatctaatgatgaataatgacaaaactcaagaaatgttcttattactatgatttttaatcttgaaaatgaggattatgtgggtaagcagaaactccaggccaactccatgtaaagacctgggtggccctgctaactctttcgtatactgagaaaatcttgggtttacaaaaatattgcagcaatttgaaaatagttttctccaggctataaaatttacctaactaaaaccaatctaatcccttgatctaaagatcaaactttttgccaggtatagttttacattgttattttaaccttcaggtgggaaagcaattgtttctgtagagaaactgtctccataaccaaaaggaagtgcgggtggaagcaattaactggacagttcggtcaattaactcagaaacttactgaccagagtgttcagagctacctacctttattctggttttaattttgtaatttatcagagtccagaatttcagtctggataacttttatttaaacacttgatttctgaaactggccttgaactagtgcttctttggacttttttttttctcttctccctttggtttgctctcgacagctggaatgagagactggatggcgttgaaatgaaatgctggagccatccatccatgtgcttccagggtggcttcctggctgtgagaacacagtgaccctgtgaggccaacatggactcggttctcctgacataacatggctggaggagctccagctctgggatgttatcttgctgttttacactggtggttcagccagcccatgggaaactgaacttgggctgggagacctggcagcaaatccaaactgaaataagaatcagcacttcgagttcaactgtgaaacaaatgtgggcccaaggcctaaatgcccgaaagacatagggaagggttgaagtggaataaagaaagcttttggtgacactatgggaagggctattgagtatcttctcaggacagtacaaaatgtcagaggcacagcatatttcgaaacctatttttaaagctgctttagattttttaacttgatggatagatatattcattttttaaaaaaagaaatggtgaccctcttaagaggcaaagtacgagcctcaagtgttgtgggatgtatccatcattggttactaagttttccaatggctcagacactcccagaagcgaagactcctgagccaaaggaagatgagagctgaaaggagcatcgagctcatccagtgcaatgcttctcagcttgtgcccactttggattcacttggaaatattttagaaatactgatgcctgggccccattccagaccagt

SEQ ID NO: 2280 - DNA, 3966 bp, Homo sapiens; identical to SEQ ID NO: 2279

SEQ ID NO: 2281 - DNA, 1552 bp, Homo sapiens
cgatttgctgcctgaccttgttggtgcctgtgatgatgattatacagcattgtgcatgccattaaaggggaggggaggaacttgagaggagatcttagggccctagtcctggccacagagtctccttgcagcccaagacagaagctgatgattcacagtagagaagaagtgaatattccagttcattttatcttcaaacagctaattggattagctactatcacccgaattttacaccaagaaaactgatgatcagagaaataaagccaagttcctaggaccacaaagtgggtaagaggcagagcaggatttaaacccagatttgtttgacttcaaagcttatgctttttcactatttctcctcacacccactgaccccacaatgtctcataaggggatctgcaaggcagccctaaattccaagcaggacatgtaactcctcaatggacaaatggacactggaccctggttgaaggaacctgttgttcttatggtggagggcagaaacccaagagggctggagccaatccatccctgttttctttagacgctgactcctgctgtctgccagatcctcgtggtacaatgactggtgtagactggcttgttgaagtcactctctggatctgagcaacgctggctgagccgtgatgaagtattcctatccatccactatgcttcacagtgggaatctctcactgttcatcaccgctgccctagcagccgcagggattcttcacccatggttgcttaggtttataagcaaggaagctgaatgaagtccctttcctctctggatgagcccctgggtttctggaagagtcttaaaatcacccctaaatggcttccaagcactgaagcccgagatgttagctggcctgtgtgaggccttgagacagaatgccacagccacaccccaaggatgctgaaggggatttccctcctctgtggtttttctcctttcttcccgcagcactcctcctacgtgctaacatcttctagtcaaacaactctccttttcaaagggaccaggcacagtttctgcttatccctgagtagcagtgttcagtttcctgccagcctgtggagtttttcaaacaagccaatcacctcctcctgtgggaactgagaagcaccccaccctctcgatactacaaagcccctgcttgttccctagtgcaactcccatgtggtcctgtggagcatatggtatcttcctcttctgggcagtgagcatatgtgactaataaactatctatctcatctgttcagtgccaggtgtcatttgttctgccatcccatgacctagggtggggattccttccacaccaacagggtgaatgcaaggtgattaaaacaagaagcctcttcaggatctatatcctagggaaaaaattaaacaacaacaacaaaacaagaagcttcaactctgaccctgtattccagatgtgttacaggggcctgtctccccagagccactctccaggtcagagcttacctccccttgctcagggttaggagctctgggcaggaaaaggacatcatgttaaaa

SEQ ID NO: 2282 - DNA, 1552 bp, Homo sapiens; identical to SEQ ID NO: 2281

SEQ ID NO: 2283 - DNA, 1668 bp, Homo sapiens
gttccccatcccagggccccggggcctccgggactccccccgcaacccaatgccggctgcgccggcgtcatccgccatttggtgttttctcggagaagaagctacatgtggaatatattaacgcaacaaattgtgcgtacttgctagacattaggcatgatagcaagtgctagggttacaaagtattgctttttggggaacccatggttgttggggagaaaccagaagatcagtcatcacagtgcggcaagatcagacttgtggtttgttcaggttctgggagccgtcactgcagtgagaatgggggatctgcaaggcagccctaaattccaagcaggacatgtaactcctcaatggacaaatggacactggaccctggttgaaggaacctgttgttcttatggtggagggcagaaacccaagagggctggagccaatccataactcaggcacgtggccacatctaacagcaagggagtctggaaaacacagttcagctgtgtgaaggatatttataaacatttagcaagatccaaaggaatggaccatagcacagctgcctggaatttgaatgtggtatctggagcttcagtagtcatccaggactgtaagtgtgaaagccatgcactgagagtggtggaacagaagccctgttttctttagacgctgactcctgctgtctgccagatcctcgtggtacaatgactggtgtagactggcttgttgaagtcactctctggatctgagcaacgctggctgagccgtgatgaagtattcctatccatccactatgcttcacagtgggaatctctcactgttcatcaccgctgccctagcagccgcagggattcttcacccatggttgcttaggtttataagcaaggaagctgaatgaagtccctttcctctctggatgagcccctgggtttctggaagagtcttaaaatcacccctaaatggcttccaagcactgaagcccgagatgttagctggcctgtgtgaggccttgagacagaatgccacagccacaccccaaggatgctgaaggggatttccctcctctgtggtttttctcctttcttcccgcagcactcctcctacgtgctaacatcttctagtcaaacaactctccttttcaaagggaccaggcacagtttctgcttatccctgagtagcagtgttcagtttcctgccagcctgtggagtttttcaaacaagccaatcacctcctcctgtgggaactgagaagcaccccaccctctcgatactacaaagcccctgcttgttccctagtgcaactcccatgtggtcctgtggagcatatggtatcttcctcttctgggcagtgagcatatgtgactaataaactatctatctcatctgttcagtgccaggtgtcatttgttctgccatcccatgacctagggtggggattccttccacaccaacagggtgaatgcaaggtgattaaaacaagaagcctcttcaggatctatatcctagggaaaaaattaaacaacaacaacaaaacaagaagcttcaactctgaccctgtattccagatgtgttacaggggcctgtctccccagagccactctccaggtcagagcttacctccccttgctcagggttaggagctctgggcaggaaaaggacatcatgttaaaa

SEQ ID NO: 2284 - DNA, 1668 bp, Homo sapiens; identical to SEQ ID NO: 2283

SEQ ID NO: 2285 - DNA, 3918 bp, Homo sapiens
gtgagacagccacaggctgagctttctgagcccttgggaagatcaggttcaagttgccagccagactctgggcttccaggaggagtgggctgtggatggcctggcctcatttgcatgtccctctcctcccggccctgcaggtgccacctcctgagtcctggttcctgcggctccgtcgaatctgcagtgaaggcctttgggaagcgtgggttatgtgggtccaggggtcccatcctcccgtggaggcccttgacctgaggatcactaactcacaccccaccgacttccggcccccaacaagggcagtgttcctcttgctccattctgctctgaagtcccccaaaccgcttcctggggctgcttagtgaaatacaaggctcatctctgaggacctctacagggctggatgggaaggactgatccacattcccaccaggaagtttagcagaacccccgcgtgccacctggaccccttggaaggacctggctcaggctggaccacctcttgagaggcaggagctctggatttgatcaagaattctttgctgagcatggtgcctcatgcctataatcccaacactttgggaggccagtgtgggaggatctcttgagcccaggagttcaagactagcctgggcaacacagagagaccccatctctaaaataataataataataaaataaaaaattagcagggcatggtggcatgtgcctgtagtcccagctacccaggaggctgaggcaagaggatggctggagcctgggatgttgaggctgcaatgaactgtgattaccccactgcactccagcctgggcaaaagagcgagagaccctgtctcaaataataataataataataatcttattttggagaataaagagacctctggatttgaggtgccatttgggtagaaagaaaagacgtttacaccgagaaatagtctgtgttgccctgaaggagcagagggatgcatcgctggaggtgacctacagttgaagaagactcattatgacagaccttgtccttcttccttgtggaaagtgtttcctctgctgctactgctcatgagactcttccccctccctgtcccagggaaccaaagggctttctaccacaccctttcttgccccccgcctcccatgtctgctgtgcctttgtactcagcaattcttgtttgctccattatcttccagccggatacagagtgaatagttaaccacacttaggtcaaataggatctaaatttttgttcctgctccgtgtaaagaggccagtgtttgtgtgttgcaagcagccttggaatagtaactcttctcatttgtttgggatctggccaccaagttccagaatgatacacggatcagtgcagaagttcatcaggctctcggaccttagggctgttggagaaggcttcagcagcagaactgatggtgaaggctcgtgttctccatcctcaactttctttgcttcgatcatacacaagaatacatttggaagggcaaaaaatgaacactgtcgttcattgcagccgtgttttgtgacacagatgcacagtctgctgtgaagaccttctctcaagtggcatttgggagtccatgccagatcatggtgcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattaaagtttttgtatgttgcagttgctgtgcttgtatgaccatttagtgaatttggtgtcttctaaatagaacagtggagtccttgtggacatctcagattcatcacaaaatgattgaggagaacctcttgaagatgtttagagctattgaaatttacagattgttgatgggttttcaccttttccttcctttcttgacacacagttacaggcattgtattccttggattcctacaggtgtcaaggaacagagatccacttacgttaccttcataaatcctggtttattcaaaagtcacagtaaggtagacaggaaatagtcccagccactgcctagctaagccttttcaaaaagcccaaggtcattcagcagatgcagaagcactagttggttttcaaagataacaagagcaataccatcatggtcgttttgatcctctgttcagcagcagggttcgctgcccctgactttagaattctgccatcgtgatgagctgaaggtcaccaacggtcccagtttgcccaggactaaagggtttcttgggatgaaggacattcagtgctaaacctgggacagtcctgggcaaactgggaaaactggtcaccctcctgggtgactcaacgaccatgcctctactttgttacttactattaactgactgatgctgttgactggtttagccaatctgcattcagagcttttgcgtctggttacttcgttggccttcaggcagccacagatggatgctattggatcaggcaccaatgctgaccaaatcaattgtttccaggatggtagggttgtatgaagaaccaactgagaccatgtccttctgagtgttgtggatggtgggcatggcaggccttcaaggtatcagggattcctctccaatacagccttacttacaaaggagaaactaactttctcatgaaaaacaaaacagttcattaagaaacaaaactaacacagccactgggaactgaggaagagagactgtaacatgtgtgcaagcacacacacacacacacacatgcatacacatgctgtctgtagaatcatgagccaggattccaaatctgcatctttgctagacagagatcaagaactaaaacctttgggatggtgttgtctgggaagcaaaggagttggctagaggacttcctgaaattcctttaaactctagaatcctttaaaatatcaagggtgtgtaaactggggctaagtatgtacattctctctaaaggctcctagataacctttgagttcaattcagtgtggagtggggcctcccagcttatacttacctttctagacactgacttttatctgggatgagggagcagaatttggaggtggtagtcagggcgggggtagggaggggagtgggtaagggatagttgcaccagcccaacttttttggtcttaagaacaacctgaacgcaaattacagggtcttttgtggactagaaaaagccaggttttcaggatcacgtggcgtcctgaagttgttgctgcttgtcagggcatctgacctccatcttctctgctgaaagacaggcatgagtgtttgcagtgccggaacaggggccttcagataatttcattcatctggcatggcaagaccacagggagggaattacatgctagggtagagatgaacttatggacgtatcatgcaccttggtgtttgcccctgtagtgattctcactaccttcgctaccattggagggatgctcacccacctccttgggtgccatttttcttttttaaaagatgaaggcatttcagatgatcccttcatttatgttctactttcattctttggtttcaaaagaagtcctgatcttatgtcaaaggcaacaatctcttctctcaatctctctctctctctcactctctctctctggctcactctgtcacccaggttggagtacagtggcatgatctcagctcactgcagcctcgacttcctgggctcaagaaatcctcctgtctctgccttccgagtagctgtgatcacagttgtatgccatcatgcccag

SEQ ID NO: 2286 - DNA, 3918 bp, Homo sapiens; identical to SEQ ID NO: 2285

SEQ ID NO: 2287 - DNA, 3907 bp, Homo sapiens
ctggcttgtgtcttctgggtacgtgatccccctgacttcagtgtgagaatgtggccagagcgtctggggaagacagggagagttgtcagagaggagttttgaggaggccctgaaggctcgccggctgttaaggcctgagctgtagtgggcaagaagagatggccagttcaggtagaggaagcctgctttgagctgaagaccggaggtgaatctggacagggcttcccaggaccagtatttttccctctccaccctggtcttctcctgtaacgtgtggccgccttttccagcacggcctcctgccttcctggtgcactttttggagaacgtggtggaatcagaggtttctggctgactcggtgggtgctttgaaccaggaaaggacaagaaagaggatgggaaggactgatccacattcccaccaggaagtttagcagaacccccgcgtgccacctggaccccttggaaggacctggctcaggctggaccacctcttgagaggcaggagctctggatttgatcaagaattctttgctgagcatggtgcctcatgcctataatcccaacactttgggaggccagtgtgggaggatctcttgagcccaggagttcaagactagcctgggcaacacagagagaccccatctctaaaataataataataataaaataaaaaattagcagggcatggtggcatgtgcctgtagtcccagctacccaggaggctgaggcaagaggatggctggagcctgggatgttgaggctgcaatgaactgtgattaccccactgcactccagcctgggcaaaagagcgagagaccctgtctcaaataataataataataataatcttattttggagaataaagagacctctggatttgaggtgccatttgggtagaaagaaaagacgtttacaccgagaaatagtctgtgttgccctgaaggagcagagggatgcatcgctggaggtgacctacagttgaagaagactcattatgacagaccttgtccttcttccttgtggaaagtgtttcctctgctgctactgctcatgagactcttccccctccctgtcccagggaaccaaagggctttctaccacaccctttcttgccccccgcctcccatgtctgctgtgcctttgtactcagcaattcttgtttgctccattatcttccagccggatacagagtgaatagttaaccacacttaggtcaaataggatctaaatttttgttcctgctccgtgtaaagaggccagtgtttgtgtgttgcaagcagccttggaatagtaactcttctcatttgtttgggatctggccaccaagttccagaatgatacacggatcagtgcagaagttcatcaggctctcggaccttagggctgttggagaaggcttcagcagcagaactgatggtgaaggctcgtgttctccatcctcaactttctttgcttcgatcatacacaagaatacatttggaagggcaaaaaatgaacactgtcgttcattgcagccgtgttttgtgacacagatgcacagtctgctgtgaagaccttctctcaagtggcatttgggagtccatgccagatcatggtgcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattaaagtttttgtatgttgcagttgctgtgcttgtatgaccatttagtgaatttggtgtcttctaaatagaacagtggagtccttgtggacatctcagattcatcacaaaatgattgaggagaacctcttgaagatgtttagagctattgaaatttacagattgttgatgggttttcaccttttccttcctttcttgacacacagttacaggcattgtattccttggattcctacaggtgtcaaggaacagagatccacttacgttaccttcataaatcctggtttattcaaaagtcacagtaaggtagacaggaaatagtcccagccactgcctagctaagccttttcaaaaagcccaaggtcattcagcagatgcagaagcactagttggttttcaaagataacaagagcaataccatcatggtcgttttgatcctctgttcagcagcagggttcgctgcccctgactttagaattctgccatcgtgatgagctgaaggtcaccaacggtcccagtttgcccaggactaaagggtttcttgggatgaaggacattcagtgctaaacctgggacagtcctgggcaaactgggaaaactggtcaccctcctgggtgactcaacgaccatgcctctactttgttacttactattaactgactgatgctgttgactggtttagccaatctgcattcagagcttttgcgtctggttacttcgttggccttcaggcagccacagatggatgctattggatcaggcaccaatgctgaccaaatcaattgtttccaggatggtagggttgtatgaagaaccaactgagaccatgtccttctgagtgttgtggatggtgggcatggcaggccttcaaggtatcagggattcctctccaatacagccttacttacaaaggagaaactaactttctcatgaaaaacaaaacagttcattaagaaacaaaactaacacagccactgggaactgaggaagagagactgtaacatgtgtgcaagcacacacacacacacacacatgcatacacatgctgtctgtagaatcatgagccaggattccaaatctgcatctttgctagacagagatcaagaactaaaacctttgggatggtgttgtctgggaagcaaaggagttggctagaggacttcctgaaattcctttaaactctagaatcctttaaaatatcaagggtgtgtaaactggggctaagtatgtacattctctctaaaggctcctagataacctttgagttcaattcagtgtggagtggggcctcccagcttatacttacctttctagacactgacttttatctgggatgagggagcagaatttggaggtggtagtcagggcgggggtagggaggggagtgggtaagggatagttgcaccagcccaacttttttggtcttaagaacaacctgaacgcaaattacagggtcttttgtggactagaaaaagccaggttttcaggatcacgtggcgtcctgaagttgttgctgcttgtcagggcatctgacctccatcttctctgctgaaagacaggcatgagtgtttgcagtgccggaacaggggccttcagataatttcattcatctggcatggcaagaccacagggagggaattacatgctagggtagagatgaacttatggacgtatcatgcaccttggtgtttgcccctgtagtgattctcactaccttcgctaccattggagggatgctcacccacctccttgggtgccatttttcttttttaaaagatgaaggcatttcagatgatcccttcatttatgttctactttcattctttggtttcaaaagaagtcctgatcttatgtcaaaggcaacaatctcttctctcaatctctctctctctctcactctctctctctggctcactctgtcacccaggttggagtacagtggcatgatctcagctcactgcagcctcgacttcctgggctcaagaaatcctcctgtctctgccttccgagtagctgtgatcacagttgtatgccatcatgcccag

SEQ ID NO: 2288 - DNA, 3907 bp, Homo sapiens; identical to SEQ ID NO: 2287

SEQ ID NO: 2289 - DNA, 3907 bp, Homo sapiens; identical to SEQ ID NO: 2287

SEQ ID NO: 2290 - DNA, 3907 bp, Homo sapiens; identical to SEQ ID NO: 2287

SEQ ID NO: 2291 - DNA, 7803 bp, Homo sapiens
ggcaggtgtcagcgtctggatcttctctgggatcccaacagaagacattttcgtcctgctgtgctgaagacgggaccggaaggccattgctcagggagcgagcagatccagcctgtttggacgtggtgaggacccagccgtggggtttaaggccaagttagcctctcccttcactgattacaagagccattgttacaggtgctcacatgccaggagaaataagctggtgatttatgtggcacagcaccatcgatcgacctacaaaggaagcttcagtgcagccgtgttgctatacagacctctctcaccaaggcgtcatgaactgaagggctgggagaggcctcgtggaggaggaagagtttcgctcagctgcttgggtgtgggactgaatgtggttccagaactggtcgctgccttcacccgctgactctggtctcggcgatgacaagcccatggaacagacttacggcgtatgacctcatcggagacttgtacatggggccaacccccattttcccacaggaaacccacactctaattaagggctgaccctgaacttgaatctgagtcttctctttcttcaacagagagccatctctccagcccagctggcaaggagacaggtgatgttacaggaaaaaatacacagcttgtgcccttggaattaccagagttcaaagcctgttcagcatctacccaccatgtgacccgggtcgaattcttcagtttctctaagcccattttctcatctgtaagatggggaagtgtaatcagttctgaacccacatatacctcactgggcttgaacaggcctgagcaggcatgtggggctttactagctagccatcctttctgccgctctccctcattctccttcaagccccccaaagtccttggtggaggaggaagtggagacagaacgtttggtgttgggtgaggtacgtgaggaggctgatttcagaacctccaggaaacaaagctttagtgttccgagggcagtgcccgcctgtgcctcctcctcacagggggtagtaggagtggggtggggccgaggcatttcccagcacagctcaatcacatctcctgcgcctgcccttgtgacctgctcactggaaaggaagaaatgaccgagggagaagggagggcatttgaggagcaaggaagagacatgattccagctttacctggggaaaatcaatctcacagcaatgagaagaaataaatgatgagttaaaattaatttctatatttttctaattattcaagtgactaatgtttggtgtgcagaaatttaagaagactgaggactagaatgaattataacgcaggagaaaacaataaccatgcatagtcagcaagaggcactgataccattttgagacgactggatgccctttcgtatgctaggaatatgcagcccgtgttctggaaagtggggagaaggtcaggcggctcctagcagcaaagctgcgttatcctcaatatcctgtaggggagggtttagggagttcggatatccctgcctttgacattcatcttggcctcagtttttctcttacctggaagcaagagaggagttgattgtgagttcagagtggaaatggtggccaatccagaccctgcactgccactgactctccgggaatgtcagcgccaggtgagagccaggattccagggccagacctgagcttgtccatagcctgggacttgaatggggggaaacttgggcacagtggcaggtggaaaatcaagtctgtgcttcaggggcatctaggaatgccctgtctatcttctcccctccccaaccccatttacccaggtgcctcctgttactttcaatactaatgccttctttttttttttttgagacagagtctcactctgttgctcaggctggagtgcagtgacgcaatctcggctcactgcaacctccgcctcccgggtccaagcgattctcatgcctcagcctcctgagtagttgggactacaggcatgcaccaccacgcccacctaattttttttgtattttcagtagagatggggttttgccatgttggccaggctggtctcgaactcctgacctcagtggtgggattacaggcatgagccaccacgcccaacctgatgccttctttttctgaccatttcctctccagcaatcccaccgtggccacaggaaaacctggcccaggagattccaatgttcttggcttcccctcctgtcacagcctcagtgattttgtgatttcatcttgcttctcagggcttgcttttatcaaaagggttggttagtcacaatggctgttaataggtgcaacaaggcatagaagacctgttaggggttgaacttttccccctacaactccaaaatattaatatattgcagtcctaatcttcaggacctccaagaatgtaaccttatttggaaatagggtcgttgcagatgtcattggttaatgatgaggtcgtactggatcagggtgggccccttatccaatatgactggcatccttgtagaaacaccacagtgtgaagagacagagattcacgcagagggaaaactatgtgaaaagatacacggagaagaccgtgtaaaaggtggaggatgaaggtaaggcagttgcaagccaaggaacgcctaagataaggaacgcctaagatagccaatgaccaccaggtctcagagaggcccgggacagattctccctcactgcccctagaagcaagcaaccccgctaaccccttgatttcggacctctggtctccagaagtggggcccagctgggataacctgactctagggccaccaaggtttgtcatcctgggcggcattcggggctggtgtgacccaccttatgcacaaaggccagaatagacctagcggcattgacaataggactggaatgccagctttgtctgtgaaggaagggcgcaagggaggacagctgtggtgggcaaaccctaaccatttccatccttgtttagcttttgttctgactacgacaggactacgtagtcgaactacgactcccaggaagccgttcggccttccccaccccctccccgcccaccccgctccgccccgtcccggcgcgggtccgcctggtatataagggccgaatggcccagccgactgcagggcgcgcaggcggcgcgggtgcgcggtgcggcgctggtatccagaggacgcggtcaccgcctctggcatttgtcgttctgcgcttctccgcaaggaccctctgttaggcaggcgcccaccgtaagcctcccgggccttgtgaacctgcaaacccaagtctgagagacgatccgccttcagcgctttccagcttggcagagaggctttcccggcggggatctttggttggcgctggcgatgcgcggggaagaaaggcgaggagcggcgtccaggctgggtgatgtcccagcacgagtaggcgggatgcgctcgcttggtcctccgggcgcccggtccctgcccgcgtcgcgcgcccacccctggggacgagaaggcggccgcctgaggacccccgcccgcgacctccgcgagtctggagcgcagaggacagggtctggctgctctttggccttggatggaaagtggggaattgggtggggggctgcggaccccttaacgtggattacttggtgtgtatcagctgggctcagaagacccacgacctcttctccatccgtggattgatttgttctgcttaacagctgggtcgccaagctggaggtatttttccctctccaccctggtcttctcctgtaacgtgtggccgccttttccagcacggcctcctgccttcctggtgcactttttggagaacgtggtggaatcagaggtttctggctgactcggtgggtgctttgaaccaggaaaggacaagaaagaggtgccacctcctgagtcctggttcctgcggctccgtcgaatctgcagtgaaggcctttgggaagcgtgggttatgtgggtccaggggtcccatcctcccgtggaggcccttgacctgaggatcactaactcacaccccaccgacttccggcccccaacaagggcagtgttcctcttgctccattctgctctgaagtcccccaaaccgcttcctggggctgcttagtgaaatacaaggctcatctctgaggacctctacagggctggatgggaaggactgatccacattcccaccaggaagtttagcagaacccccgcgtgccacctggaccccttggaaggacctggctcaggctggaccacctcttgagaggcaggagctctggatttgatcaagaattctttgctgagcatggtgcctcatgcctataatcccaacactttgggaggccagtgtgggaggatctcttgagcccaggagttcaagactagcctgggcaacacagagagaccccatctctaaaataataataataataaaataaaaaattagcagggcatggtggcatgtgcctgtagtcccagctacccaggaggctgaggcaagaggatggctggagcctgggatgttgaggctgcaatgaactgtgattaccccactgcactccagcctgggcaaaagagcgagagaccctgtctcaaataataataataataataatcttattttggagaataaagagacctctggatttgaggtgccatttgggtagaaagaaaagacgtttacaccgagaaatagtctgtgttgccctgaaggagcagagggatgcatcgctggaggtgacctacagttgaagaagactcattatgacagaccttgtccttcttccttgtggaaagtgtttcctctgctgctactgctcatgagactcttccccctccctgtcccagggaaccaaagggctttctaccacaccctttcttgccccccgcctcccatgtctgctgtgcctttgtactcagcaattcttgtttgctccattatcttccagccggatacagagtgaatagttaaccacacttaggtcaaataggatctaaatttttgttcctgctccgtgtaaagaggccagtgtttgtgtgttgcaagcagccttggaatagtaactcttctcatttgtttgggatctggccaccaagttccagaatgatacacggatcagtgcagaagttcatcaggctctcggaccttagggctgttggagaaggcttcagcagcagaactgatggtgaaggctcgtgttctccatcctcaactttctttgcttcgatcatacacaagaatacatttggaagggcaaaaaatgaacactgtcgttcattgcagccgtgttttgtgacacagatgcacagtctgctgtgaagaccttctctcaagtggcatttgggagtccatgccagatcatggtgcttcatgagagactgacagctatcaggggttgtggcacttagtgaggactctcctcccccagtgtgtgctgatgacacatacacacctgacaatagcttgagtcttctctgttccttttactctgtagccaacatacacatgatttaaaaccctttctaaatatctatcatggttcatccttgtccaaatgcagagtcagagctatttgtacttcattattatttccaaggcgaatagttggctttctttttgcaaaaataattaaagtttttgtatgttgcagttgctgtgcttgtatgaccatttagtgaatttggtgtcttctaaatagaacagtggagtccttgtggacatctcagattcatcacaaaatgattgaggagaacctcttgaagatgtttagagctattgaaatttacagattgttgatgggttttcaccttttccttcctttcttgacacacagttacaggcattgtattccttggattcctacaggtgtcaaggaacagagatccacttacgttaccttcataaatcctggtttattcaaaagtcacagtaaggtagacaggaaatagtcccagccactgcctagctaagccttttcaaaaagcccaaggtcattcagcagatgcagaagcactagttggttttcaaagataacaagagcaataccatcatggtcgttttgatcctctgttcagcagcagggttcgctgcccctgactttagaattctgccatcgtgatgagctgaaggtcaccaacggtcccagtttgcccaggactaaagggtttcttgggatgaaggacattcagtgctaaacctgggacagtcctgggcaaactgggaaaactggtcaccctcctgggtgactcaacgaccatgcctctactttgttacttactattaactgactgatgctgttgactggtttagccaatctgcattcagagcttttgcgtctggttacttcgttggccttcaggcagccacagatggatgctattggatcaggcaccaatgctgaccaaatcaattgtttccaggatggtagggttgtatgaagaaccaactgagaccatgtccttctgagtgttgtggatggtgggcatggcaggccttcaaggtatcagggattcctctccaatacagccttacttacaaaggagaaactaactttctcatgaaaaacaaaacagttcattaagaaacaaaactaacacagccactgggaactgaggaagagagactgtaacatgtgtgcaagcacacacacacacacacacatgcatacacatgctgtctgtagaatcatgagccaggattccaaatctgcatctttgctagacagagatcaagaactaaaacctttgggatggtgttgtctgggaagcaaaggagttggctagaggacttcctgaaattcctttaaactctagaatcctttaaaatatcaagggtgtgtaaactggggctaagtatgtacattctctctaaaggctcctagataacctttgagttcaattcagtgtggagtggggcctcccagcttatacttacctttctagacactgacttttatctgggatgagggagcagaatttggaggtggtagtcagggcgggggtagggaggggagtgggtaagggatagttgcaccagcccaacttttttggtcttaagaacaacctgaacgcaaattacagggtcttttgtggactagaaaaagccaggttttcaggatcacgtggcgtcctgaagttgttgctgcttgtcagggcatctgacctccatcttctctgctgaaagacaggcatgagtgtttgcagtgccggaacaggggccttcagataatttcattcatctggcatggcaagaccacagggagggaattacatgctagggtagagatgaacttatggacgtatcatgcaccttggtgtttgcccctgtagtgattctcactaccttcgctaccattggagggatgctcacccacctccttgggtgccatttttcttttttaaaagatgaaggcatttcagatgatcccttcatttatgttctactttcattctttggtttcaaaagaagtcctgatcttatgtcaaaggcaacaatctcttctctcaatctctctctctctctcactctctctctctggctcactctgtcacccaggttggagtacagtggcatgatctcagctcactgcagcctcgacttcctgggctcaagaaatcctcctgtctctgccttccgagtagctgtgatcacagttgtatgccatcatgcccagaaagcagatcgctggggaggaacgcatcagggcagctgagggaagccgattctactgcagctttctgaatcgtgggttggggagatggagagggaaaggaaagggctttgagcaagacagaccag

SEQ ID NO: 2292 - DNA, 1097 bp, Homo sapiens
gcagctgcgactagcggaaagcgcgcgccagctgcacgcagggaaacagttctcattttgtgtgctcggctgactgcacgtccagcctcgggccagctcgagacggccacattgcctggttgaagatggctgagcgtaaaacagaatgcaagtcagctggagcacgtactactggaggcagagccccatgagaaggggccaagaacccgcacccatcaaaatcaagaagaaaggctgaacccggagagaaaagggagcaactgatgttgccatgcagatcccttggttgctatgagatggtaacatcactctgccccaccattggccagtgcctcctcagctgcggtgcctcccaggctgtgtggttctcacgcgggccactgacacagagctgttactatggtgaactttacaatttcctttgattggtggatttcagaaataggccatcagcggaattcattatattcagctaacctggctcagcttctcagcttctcaggtggattggtgagtcctggccaattacgcttcagctcatctctactctcagcaaataggaaaagggagtgaaggactgagttttaactcttctaatttcgtaacctgactctctataagaaaaagtaggagaaagactgaagaacccgagagaacaggcctctgagcccaagccaagccatcgcatcccctgtgacttgcccgtatatatgcccagatggcctgaagtaactgaagaatcacaaaagaagtgaatatgccttgccccaccttgactgatgacattccaccacaaaagaagtgtaaatggccggtccttgccttaactgatgacattaccttgtgaaagtccttttcctggctcatcctggctcaaaaagcacccccactgagcatcttgcgactcccactcctgcccactgagcaccttgtgacccccactcctgcctgccagagaacaaaccccctttgactgtaattttcctttacctacccaaatcctataaaacggctccacccttatctccttttgctgactctcttttctgactcagcccgcctgcacccaggagattaaaagctttattgctcacaca

SEQ ID NO: 2293 - DNA, 1250 bp, Homo sapiens
cgctgatgtaaagagagattggaaatgatatatctggctgggcaggtcactcatgcctgtaatcccagcactttgggaggctgaggcaggcagatcacctaaggccaggaattcgacaccagcctggccaacgtggcaaaacccgtctctactaaaaatacaaaaattagccgggcgtggtggtgtgcgcctggaatcccagctacccaggaggctgaggcaggagaaatgctggaacccgggaggcagaggctgcagtgagctgagatcatgccactactgcactccagcctgggtgacacagcaagactccctctaaaaaaagaaaaaaagaaaagaaaagaaaagaaaatgatatatccatgatgaattaaaatggagtggaacccactgatgggaaagccacagaaggtaccagttatccactcactgacttaggtgcctccactagaattctcagcacgtttttgcagaacctgggcaacaagagcgaaaccccatctcaaaaccacaacaacaacaacaggacaacagagatggacgacggatcgggaaagccaaccagacagcgtgaggccaggacggaaagaggcacagggagctctgctcagtgtcgctacaggggatctctcaggctcacaacgggccactcctctagggaagttctggtctcatcatgatccttgtttggtctcactccccatgtccttctctgtccctcctccaactgccatttatttatttaactgaaaaagtaccaatcacccacataggcatgacatactcatccatgtacccatttcttaaaattgatcattgttaacatttggtgtaatttgctttatttatttttaatgaaataaataaaactttacagaaaatgctttatttttctctttgttccctccccatcctatatttttctcctaaaaaaccctattatcagaaatattagtgtgtattcccagtttcgactttttattttattacacacacactcccacacatagctgtgacaatgaacttcacatagtatggttctgtattttctctttgtttttcaaacttacataagtattttactatttctcatggaaaaactcacttttcccatccaacgttatgtttccttaagatctctctatgttgatataaagaaatctagctcattctttttaatgaaaataaagtatattttatgaatgtaactcatgctaaccatggcaataaaagctccatcaagcatgcat

SEQ ID NO: 2294 - DNA, 1250 bp, Homo sapiens; identical to SEQ ID NO: 2293

SEQ ID NO: 2295 - DNA, 1804 bp, Homo sapiens
cgctgatgtaaagagagattggaaatgatatatctggctgggcaggtcactcatgcctgtaatcccagcactttgggaggctgaggcaggcagatcacctaaggccaggaattcgacaccagcctggccaacgtggcaaaacccgtctctactaaaaatacaaaaattagccgggcgtggtggtgtgcgcctggaatcccagctacccaggaggctgaggcaggagaaatgctggaacccgggaggcagaggctgcagtgagctgagatcatgccactactgcactccagcctgggtgacacagcaagactccctctaaaaaaagaaaaaaagaaaagaaaagaaaagaaaatgatatatccatgatgaattaaaatggagtggaacccactgatgggaaagccacagaaggtaccagttatccactcactgacttaggtgcctccactagaattctcagcacgtttttgcagaagtaagttatcttcactattgctctaacacttcttagtctcctttttctttcttttctttttttttagacaaaggaaaagtaaaccgctggtttagagtctttggaaggcaattgtatctgactagaatttaatattattgtttttctttcattgtattgcatttatctgtatggctagttaaactgattttccatttaaaagtagtaatgcatttttttataattacattgttttaagtaaacaagaattattcaaaggacaaaaacactagcacagatggcattcaatgattgcagatatcataaagatagttcatgaatgacaaagatttgagaagtactgtgttcacgatgcttcctggaagaggtgggttatacagtgtttcttagagaaagggataggggtctactgctaggagggaaagatgaagctacttagggggactaggaaacacgcagttggcctgccctctgcttggagatcacagccaaggaaacacaggagaggcaccccctggaggagctccgtgggctgcagggctgacgtggcccagcctgggcaacaagagcgaaaccccatctcaaaaccacaacaacaacaacaggacaacagagatggacgacggatcgggaaagccaaccagacagcgtgaggccaggacggaaagaggcacagggagctctgctcagtgtcgctacaggggatctctcaggctcacaacgggccactcctctagggaagttctggtctcatcatgatccttgtttggtctcactccccatgtccttctctgtccctcctccaactgccatttatttatttaactgaaaaagtaccaatcacccacataggcatgacatactcatccatgtacccatttcttaaaattgatcattgttaacatttggtgtaatttgctttatttatttttaatgaaataaataaaactttacagaaaatgctttatttttctctttgttccctccccatcctatatttttctcctaaaaaaccctattatcagaaatattagtgtgtattcccagtttcgactttttattttattacacacacactcccacacatagctgtgacaatgaacttcacatagtatggttctgtattttctctttgtttttcaaacttacataagtattttactatttctcatggaaaaactcacttttcccatccaacgttatgtttccttaagatctctctatgttgatataaagaaatctagctcattctttttaatgaaaataaagtatattttatgaatgtaactcatgctaaccatggcaataaaagctccatcaagcatgcat

SEQ ID NO: 2296 - DNA, 1804 bp, Homo sapiens; identical to SEQ ID NO: 2295

SEQ ID NO: 2297 - DNA, 1333 bp, Homo sapiens
atccaagttacctaaaaggctaattcctaatgagaaggaaaggaaacataccataaagtaaaagtgcaaacaattgcaaaacagaggcaaacagtgtcagttggatatacgtaagcgctgatgtaaagagagattggaaatgatatatctggctgggcaggtcactcatgcctgtaatcccagcactttgggaggctgaggcaggcagatcacctaaggccaggaattcgacaccagcctggccaacgtggcaaaacccgtctctactaaaaatacaaaaattagccgggcgtggtggtgtgcgcctggaatcccagctacccaggaggctgaggcaggagaaatgctggaacccgggaggcagaggctgcagtgagctgagatcatgccactactgcactccagcctgggtgacacagcaagactccctctaaaaaaagaaaaaaagaaaagaaaagaaaagaaaatgatatatccatgatgaattaaaatggagtggaacccactgatggtatgcagctgataagacgctatagagaaatgatatccggacacatgcctgggcaacaagagcgaaaccccatctcaaaaccacaacaacaacaacaggacaacagagatggacgacggatcgggaaagccaaccagacagcgtgaggccaggacggaaagaggcacagggagctctgctcagtgtcgctacaggggatctctcaggctcacaacgggccactcctctagggaagttctggtctcatcatgatccttgtttggtctcactccccatgtccttctctgtccctcctccaactgccatttatttatttaactgaaaaagtaccaatcacccacataggcatgacatactcatccatgtacccatttcttaaaattgatcattgttaacatttggtgtaatttgctttatttatttttaatgaaataaataaaactttacagaaaatgctttatttttctctttgttccctccccatcctatatttttctcctaaaaaaccctattatcagaaatattagtgtgtattcccagtttcgactttttattttattacacacacactcccacacatagctgtgacaatgaacttcacatagtatggttctgtattttctctttgtttttcaaacttacataagtattttactatttctcatggaaaaactcacttttcccatccaacgttatgtttccttaagatctctctatgttgatataaagaaatctagctcattctttttaatgaaaataaagtatattttatgaatgtaactcatgctaaccatggcaataaaagctccatcaagcatgcat

SEQ ID NO: 2298 - DNA, 1333 bp, Homo sapiens; identical to SEQ ID NO: 2297

SEQ ID NO: 2299 - DNA, 2359 bp, Homo sapiens
atccaagttacctaaaaggctaattcctaatgagaaggaaaggaaacataccataaagtaaaagtgcaaacaattgcaaaacagaggcaaacagtgtcagttggatatacgtaagcgctgatgtaaagagagattggaaatgatatatctggctgggcaggtcactcatgcctgtaatcccagcactttgggaggctgaggcaggcagatcacctaaggccaggaattcgacaccagcctggccaacgtggcaaaacccgtctctactaaaaatacaaaaattagccgggcgtggtggtgtgcgcctggaatcccagctacccaggaggctgaggcaggagaaatgctggaacccgggaggcagaggctgcagtgagctgagatcatgccactactgcactccagcctgggtgacacagcaagactccctctaaaaaaagaaaaaaagaaaagaaaagaaaagaaaatgatatatccatgatgaattaaaatggagtggaacccactgatgggaaagccacagaaggtaccagttatccactcactgacttaggtgcctccactagaattctcagcacgtttttgcagaagtaagttatcttcactattgctctaacacttcttagtctcctttttctttcttttctttttttttagacaaaggaaaagtaaaccgctggtttagagtctttggaaggcaattgtatctgactagaatttaatattattgtttttctttcattgtattgcatttatctgtatggctagttaaactgattttccatttaaaagtagtaatgcatttttttataattacattgttttaagtaaacaagaattattcaaaggacaaaaacactagcacagatggcattcaatgattgcagatatcataaagatagttcatgaatgacaaagatttgagaagtactgtgttcacgatgcttcctggaagaggtgggttatacagtgtttcttagagaaagggataggggtctactgctaggagggaaagatgaagctacttagggggactaggaaacacgcagttggcctgccctctgcttggagatcacagccaaggaaacacaggagaggcaccccctggaggagctccgtgggctgcagggctgacgtggcccaggtaagtgggagttcagggaggcccacaggttggtgctaggatagtggcagatgattttcattgtcagactgtgagacaaaaggtagacataagggaggcagaggtgaaatcgggatggttaaaacagagaatgctgagagcagagcaaggcagttgctaaagctgttactaaaactggacagcagaaggcctggcgtggtggctcacagctgtaatcccagcactttgggaggcctaggtgggtggatcatcagaggtcaggagttagagactagcctgaccaacatggtgaaaccccatctctactaaaaatacaaagttagccaggcatggtggcccatgcctgtaatcccagctactcgggaggctgaggcaggagaattgcttgaatttgggaggtggaggttgcggtgagctgagatcgcaccattgctctccagcctgggcaacaagagcgaaaccccatctcaaaaccacaacaacaacaacaggacaacagagatggacgacggatcgggaaagccaaccagacagcgtgaggccaggacggaaagaggcacagggagctctgctcagtgtcgctacaggggatctctcaggctcacaacgggccactcctctagggaagttctggtctcatcatgatccttgtttggtctcactccccatgtccttctctgtccctcctccaactgccatttatttatttaactgaaaaagtaccaatcacccacataggcatgacatactcatccatgtacccatttcttaaaattgatcattgttaacatttggtgtaatttgctttatttatttttaatgaaataaataaaactttacagaaaatgctttatttttctctttgttccctccccatcctatatttttctcctaaaaaaccctattatcagaaatattagtgtgtattcccagtttcgactttttattttattacacacacactcccacacatagctgtgacaatgaacttcacatagtatggttctgtattttctctttgtttttcaaacttacataagtattttactatttctcatggaaaaactcacttttcccatccaacgttatgtttccttaagatctctctatgttgatataaagaaatctagctcattctttttaatgaaaataaagtatattttatgaatgtaactcatgctaaccatggcaataaaagctccatcaagcatgcat

SEQ ID NO: 2300 - DNA, 2359 bp, Homo sapiens; identical to SEQ ID NO: 2299

SEQ ID NO: 2301 - DNA, 970 bp, Homo sapiens
cagctgaaacgccggctgatgaaactgacaaaggcgagagcgcgcagcagcccacagcagccgagttcgcgccgccggtaggtgctgccatgccagggggcgggatcgtggagcgcctcgcagaaccgcacgaaagcaaaaacaaagccatctctccggagcagaaatagaacagacgtggccggggaaagccaaatatttgtgagatgatgtgaacaaagggggaaaagtcaatccagggaagtttgagtttctggttggaggcttcagcggctctgatcgctggatactttaagagaacatcctttgcccccgctctccctctctccccgaagaaaaataaatccttggcaaaatgagacttgacggcatgaaaagaaggtctccagactgtcccagctaaaaaagccataaagcctctctccaatcgctttctcggagggagtttttgcaacccccacaacacaggttgattggaaaggtctctctcccggataacaacaattcaatgtgccttgacattttaatagcctgccgtcctggtgaacacaatcgagcaaggcagtgaagcaaacatcattaggtggctggactcagacacatcacgctccagtttgggttccaaggtgcttctctctggattttcacctgccttgccaaaaatgattgattacgctgggccaactgggtgtccggcaatacccaacaaatgactttggcccctaacagcaggtcttggccagacagaaatcaatatttcaccattaaaatctatcaaagaagagttaaggcaccatctgtccctgccgcctctctatggtgtgtgaacattaaatccgacacttgtactacatgggtaatcaatatatagtggttcacagatcatttgtggttcccttttagcagtgatggatgtctggaatcgttgtgattcattttgtcagaccattaaacaagattctgtccagtt

SEQ ID NO: 2302 - DNA, 680 bp, Homo sapiens
ccggaagaacgggctgcgccaacaacgagaaaataaagtggcgagctgggaagggtgtagcgcgggctagaagggcgggaaacttgagaaccacgggcgcgggagcctggcggggacgcaagcccggaactggcggaggggtgggcaggcgcatgcgcgcgcgcagctgaaacgccggctgatgaaactgacaaaggcgagagcgcgcagcagcccacagcagccgagttcgcgccgccgcctgccgtcctggtgaacacaatcgagcaaggcagtgaagcaaacatcattaggtggctggactcagacacatcacgctccagtttgggttccaaggtgcttctctctggattttcacctgccttgccaaaaatgattgattacgctgggccaactgggtgtccggcaatacccaacaaatgactttggcccctaacagcaggtcttggccagacagaaatcaatatttcaccattaaaatctatcaaagaagagttaaggcaccatctgtccctgccgcctctctatggtgtgtgaacattaaatccgacacttgtactacatgggtaatcaatatatagtggttcacagatcatttgtggttcccttttagcagtgatggatgtctggaatcgttgtgattcattttgtcagaccattaaacaagattctgtccagtt

SEQ ID NO: 2303 - DNA, 796 bp, Homo sapiens
gggaaaacagaccaaagcaagtctcgctggccagtgacactccaggagcatggcccatggaaggatccaaggctgagggatctggggtagccccacagagatactctgccaaaatccagtcacgagaaggagggaggaggcgaggaacgaaaatgagatttggtttaggccggaagaacgggctgcgccaacaacgagaaaataaagtggcgagctgggaagggtgtagcgcgggctagaagggcgggaaacttgagaaccacgggcgcgggagcctggcggggacgcaagcccggaactggcggaggggtgggcaggcgcatgcgcgcgcgcagctgaaacgccggctgatgaaactgacaaaggcgagagcgcgcagcagcccacagcagccgagttcgcgccgccggtggctggactcagacacatcacgctccagtttgggttccaaggtgcttctctctggattttcacctgccttgccaaaaatgattgattacgctgggccaactgggtgtccggcaatacccaacaaatgactttggcccctaacagcaggtcttggccagacagaaatcaatatttcaccattaaaatctatcaaagaagagttaaggcaccatctgtccctgccgcctctctatggtgtgtgaacattaaatccgacacttgtactacatgggtaatcaatatatagtggttcacagatcatttgtggttcccttttagcagtgatggatgtctggaatcgttgtgattcattttgtcagaccattaaacaagattctgtccagtt

SEQ ID NO: 2304 - DNA, 1273 bp, Homo sapiens
gtttttcttcccagtatatccccaacatttaacaacaggttaatacttaaatatagtagattctcaataaatatgtgttgattaaataaataaaccaatttaattcaagacaagtaaacggacactttcaaggaagcattttaaagctataggggagagaaaagtggcctgggaactcaaatatgcggccctcacccctactagggaagcagaaggagggagcatcccgtccaaagcttcccaagcggcgccggactgcgtgctgcggctgtgggggtagaagtcttcagataaaagatggggaaaacagaccaaagcaagtctcgctggccagtgacactccaggagcatggcccatggaaggatccaaggctgagggatctggggtagccccacagagatactctgccaaaatccagtcacgagaaggagggaggaggcgaggaacgaaaatgagatttggtttaggccggaagaacgggctgcgccaacaacgagaaaataaagtggcgagctgggaagggtgtagcgcgggctagaagggcgggaaacttgagaaccacgggcgcgggagcctggcggggacgcaagcccggaactggcggaggggtgggcaggcgcatgcgcgcgcgcagctgaaacgccggctgatgaaactgacaaaggcgagagcgcgcagcagcccacagcagccgagttcgcgccgccggtaggtgctgccatgccagggggcgggatcgtggagcgcctcgcagaaccgcacgaaagcaaaaacaaagccatctctccggagcagaaatagaacagacgtggccggggaaagccaaatatttcctgccgtcctggtgaacacaatcgagcaaggcagtgaagcaaacatcattaggtggctggactcagacacatcacgctccagtttgggttccaaggtgcttctctctggattttcacctgccttgccaaaaatgattgattacgctgggccaactgggtgtccggcaatacccaacaaatgactttggcccctaacagcaggtcttggccagacagaaatcaatatttcaccattaaaatctatcaaagaagagttaaggcaccatctgtccctgccgcctctctatggtgtgtgaacattaaatccgacacttgtactacatgggtaatcaatatatagtggttcacagatcatttgtggttcccttttagcagtgatggatgtctggaatcgttgtgattcattttgtcagaccattaaacaagattctgtccagtt

SEQ ID NO: 2305 - DNA, 1220 bp, Homo sapiens
gtttttcttcccagtatatccccaacatttaacaacaggttaatacttaaatatagtagattctcaataaatatgtgttgattaaataaataaaccaatttaattcaagacaagtaaacggacactttcaaggaagcattttaaagctataggggagagaaaagtggcctgggaactcaaatatgcggccctcacccctactagggaagcagaaggagggagcatcccgtccaaagcttcccaagcggcgccggactgcgtgctgcggctgtgggggtagaagtcttcagataaaagatggggaaaacagaccaaagcaagtctcgctggccagtgacactccaggagcatggcccatggaaggatccaaggctgagggatctggggtagccccacagagatactctgccaaaatccagtcacgagaaggagggaggaggcgaggaacgaaaatgagatttggtttaggccggaagaacgggctgcgccaacaacgagaaaataaagtggcgagctgggaagggtgtagcgcgggctagaagggcgggaaacttgagaaccacgggcgcgggagcctggcggggacgcaagcccggaactggcggaggggtgggcaggcgcatgcgcgcgcgcagctgaaacgccggctgatgaaactgacaaaggcgagagcgcgcagcagcccacagcagccgagttcgcgccgccggtaggtgctgccatgccagggggcgggatcgtggagcgcctcgcagaaccgcacgaaagcaaaaacaaagccatctctccggagcagaaatagaacagacgtggccggggaaagccaaatatttgtggctggactcagacacatcacgctccagtttgggttccaaggtgcttctctctggattttcacctgccttgccaaaaatgattgattacgctgggccaactgggtgtccggcaatacccaacaaatgactttggcccctaacagcaggtcttggccagacagaaatcaatatttcaccattaaaatctatcaaagaagagttaaggcaccatctgtccctgccgcctctctatggtgtgtgaacattaaatccgacacttgtactacatgggtaatcaatatatagtggttcacagatcatttgtggttcccttttagcagtgatggatgtctggaatcgttgtgattcattttgtcagaccattaaacaagattctgtccagtt

SEQ ID NO: 2306 - DNA, 1941 bp, Homo sapiens
gtttttcttcccagtatatccccaacatttaacaacaggttaatacttaaatatagtagattctcaataaatatgtgttgattaaataaataaaccaatttaattcaagacaagtaaacggacactttcaaggaagcattttaaagctataggggagagaaaagtggcctgggaactcaaatatgcggccctcacccctactagggaagcagaaggagggagcatcccgtccaaagcttcccaagcggcgccggactgcgtgctgcggctgtgggggtagaagtcttcagataaaagatggggaaaacagaccaaagcaagtctcgctggccagtgacactccaggagcatggcccatggaaggatccaaggctgagggatctggggtagccccacagagatactctgccaaaatccagtcacgagaaggagggaggaggcgaggaacgaaaatgagatttggtttaggccggaagaacgggctgcgccaacaacgagaaaataaagtggcgagctgggaagggtgtagcgcgggctagaagggcgggaaacttgagaaccacgggcgcgggagcctggcggggacgcaagcccggaactggcggaggggtgggcaggcgcatgcgcgcgcgcagctgaaacgccggctgatgaaactgacaaaggcgagagcgcgcagcagcccacagcagccgagttcgcgccgccggtaggtgctgccatgccagggggcgggatcgtggagcgcctcgcagaaccgcacgaaagcaaaaacaaagccatctctccggagcagaaatagaacagacgtggccggggaaagccaaatatttgtgagatgatgtgaacaaagggggaaaagtcaatccagggaagtttgagtttctggttggaggcttcagcggctctgatcgctggatactttaagagaacatcctttgcccccgctctccctctctccccgaagaaaaataaatccttggcaaaatgagacttgacggcatgaaaagaaggtctccagactgtcccagctggcgcgggcggggccggggccgaggtgccgcttggtgacactgcagccgcggctcagcactgtcacccagaaaggcccgccgacgtctgtatgcagggaacgtggctcttagcagagcctggacaggcgcagggccaaggaagtctttgtttttgtttctttctctagcccttcctgccaatacatcagggatataactccttggtgtttctgccttacaatcgctccttataccccacccagatcctcagcactgcagctcccactgccactgcccgctgtgagtcacctccccctctccctccctctctcaacctccccgctcacccccatctatgtaaaaaagccataaagcctctctccaatcgctttctcggagggagtttttgcaacccccacaacacaggttgattggaaaggtctctctcccggataacaacaattcaatgtgccttgacattttaatagcctgccgtcctggtgaacacaatcgagcaaggcagtgaagcaaacatcattaggtggctggactcagacacatcacgctccagtttgggttccaaggtgcttctctctggattttcacctgccttgccaaaaatgattgattacgctgggccaactgggtgtccggcaatacccaacaaatgactttggcccctaacagcaggtcttggccagacagaaatcaatatttcaccattaaaatctatcaaagaagagttaaggcaccatctgtccctgccgcctctctatggtgtgtgaacattaaatccgacacttgtactacatgggtaatcaatatatagtggttcacagatcatttgtggttcccttttagcagtgatggatgtctggaatcgttgtgattcattttgtcagaccattaaacaagattctgtccagtt

SEQ ID NO: 2307 - DNA, 2041 bp, Homo sapiens
gtttttcttcccagtatatccccaacatttaacaacaggttaatacttaaatatagtagattctcaataaatatgtgttgattaaataaataaaccaatttaattcaagacaagtaaacggacactttcaaggaagcattttaaagctataggggagagaaaagtggcctgggaactcaaatatgcggccctcacccctactagggaagcagaaggagggagcatcccgtccaaagcttcccaagcggcgccggactgcgtgctgcggctgtgggggtagaagtcttcagataaaagatggggaaaacagaccaaagcaagtctcgctggccagtgacactccaggagcatggcccatggaaggatccaaggctgagggatctggggtagccccacagagatactctgccaaaatccagtcacgagaaggagggaggaggcgaggaacgaaaatgagatttggtttaggccggaagaacgggctgcgccaacaacgagaaaataaagtggcgagctgggaagggtgtagcgcgggctagaagggcgggaaacttgagaaccacgggcgcgggagcctggcggggacgcaagcccggaactggcggaggggtgggcaggcgcatgcgcgcgcgcagctgaaacgccggctgatgaaactgacaaaggcgagagcgcgcagcagcccacagcagccgagttcgcgccgccggtaggtgctgccatgccagggggcgggatcgtggagcgcctcgcagaaccgcacgaaagcaaaaacaaagccatctctccggagcagaaatagaacagacgtggccggggaaagccaaatatttgtgagatgatgtgaacaaagggggaaaagtcaatccagggaagtttgagtttctggttggaggcttcagcggctctgatcgctggatactttaagagaacatcctttgcccccgctctccctctctccccgaagaaaaataaatccttggcaaaatgagacttgacggcatgaaaagaaggtctccagactgtcccagctggcgcgggcggggccggggccgaggtgccgcttggtgacactgcagccgcggctcagcactgtcacccagaaaggcccgccgacgtctgtatgcagggaacgtggctcttagcagagcctggacaggcgcagggccaaggaagtctttgtttttgtttctttctctagcccttcctgccaatacatcagggatataactccttggtgtttctgccttacaatcgctccttataccccacccagatcctcagcactgcagctcccactgccactgcccgctgtgagtcacctccccctctcccttttttaaaccaaacggcaaggccatattgcagttatccataaatggaaaagcaagaagccaccaatacctgtttgagaagatggcattttaattagcacactccggctgccataaacccgggctcctgccccacctctccccgccataaagcctctctccaatcgctttctcggagggagtttttgcaacccccacaacacaggttgattggaaaggtctctctcccggataacaacaattcaatgtgccttgacattttaatagcctgccgtcctggtgaacacaatcgagcaaggcagtgaagcaaacatcattaggtggctggactcagacacatcacgctccagtttgggttccaaggtgcttctctctggattttcacctgccttgccaaaaatgattgattacgctgggccaactgggtgtccggcaatacccaacaaatgactttggcccctaacagcaggtcttggccagacagaaatcaatatttcaccattaaaatctatcaaagaagagttaaggcaccatctgtccctgccgcctctctatggtgtgtgaacattaaatccgacacttgtactacatgggtaatcaatatatagtggttcacagatcatttgtggttcccttttagcagtgatggatgtctggaatcgttgtgattcattttgtcagaccattaaacaagattctgtccagtt

SEQ ID NO: 2308 - DNA, 2043 bp, Homo sapiens
gtttttcttcccagtatatccccaacatttaacaacaggttaatacttaaatatagtagattctcaataaatatgtgttgattaaataaataaaccaatttaattcaagacaagtaaacggacactttcaaggaagcattttaaagctataggggagagaaaagtggcctgggaactcaaatatgcggccctcacccctactagggaagcagaaggagggagcatcccgtccaaagcttcccaagcggcgccggactgcgtgctgcggctgtgggggtagaagtcttcagataaaagatggggaaaacagaccaaagcaagtctcgctggccagtgacactccaggagcatggcccatggaaggatccaaggctgagggatctggggtagccccacagagatactctgccaaaatccagtcacgagaaggagggaggaggcgaggaacgaaaatgagatttggtttaggccggaagaacgggctgcgccaacaacgagaaaataaagtggcgagctgggaagggtgtagcgcgggctagaagggcgggaaacttgagaaccacgggcgcgggagcctggcggggacgcaagcccggaactggcggaggggtgggcaggcgcatgcgcgcgcgcagctgaaacgccggctgatgaaactgacaaaggcgagagcgcgcagcagcccacagcagccgagttcgcgccgccggtaggtgctgccatgccagggggcgggatcgtggagcgcctcgcagaaccgcacgaaagcaaaaacaaagccatctctccggagcagaaatagaacagacgtggccggggaaagccaaatatttgtgagatgatgtgaacaaagggggaaaagtcaatccagggaagtttgagtttctggttggaggcttcagcggctctgatcgctggatactttaagagaacatcctttgcccccgctctccctctctccccgaagaaaaataaatccttggcaaaatgagacttgacggcatgaaaagaaggtctccagactgtcccagctggcgcgggcggggccggggccgaggtgccgcttggtgacactgcagccgcggctcagcactgtcacccagaaaggcccgccgacgtctgtatgcagggaacgtggctcttagcagagcctggacaggcgcagggccaaggaagtctttgtttttgtttctttctctagcccttcctgccaatacatcagggatataactccttggtgtttctgccttacaatcgctccttataccccacccagatcctcagcactgcagctcccactgccactgcccgctgtgagtcacctccccctctcccttttttaaaccaaacggcaaggccatattgcagttatccataaatggaaaagcaagaagccaccaatacctgtttgagaagatggcattttaattagcacactccggctctcaacctccccgctcacccccatctatgtaaaaaagccataaagcctctctccaatcgctttctcggagggagtttttgcaacccccacaacacaggttgattggaaaggtctctctcccggataacaacaattcaatgtgccttgacattttaatagcctgccgtcctggtgaacacaatcgagcaaggcagtgaagcaaacatcattaggtggctggactcagacacatcacgctccagtttgggttccaaggtgcttctctctggattttcacctgccttgccaaaaatgattgattacgctgggccaactgggtgtccggcaatacccaacaaatgactttggcccctaacagcaggtcttggccagacagaaatcaatatttcaccattaaaatctatcaaagaagagttaaggcaccatctgtccctgccgcctctctatggtgtgtgaacattaaatccgacacttgtactacatgggtaatcaatatatagtggttcacagatcatttgtggttcccttttagcagtgatggatgtctggaatcgttgtgattcattttgtcagaccattaaacaagattctgtccagtt

SEQ ID NO: 2309 - DNA, 2100 bp, Homo sapiens
gtttttcttcccagtatatccccaacatttaacaacaggttaatacttaaatatagtagattctcaataaatatgtgttgattaaataaataaaccaatttaattcaagacaagtaaacggacactttcaaggaagcattttaaagctataggggagagaaaagtggcctgggaactcaaatatgcggccctcacccctactagggaagcagaaggagggagcatcccgtccaaagcttcccaagcggcgccggactgcgtgctgcggctgtgggggtagaagtcttcagataaaagatggggaaaacagaccaaagcaagtctcgctggccagtgacactccaggagcatggcccatggaaggatccaaggctgagggatctggggtagccccacagagatactctgccaaaatccagtcacgagaaggagggaggaggcgaggaacgaaaatgagatttggtttaggccggaagaacgggctgcgccaacaacgagaaaataaagtggcgagctgggaagggtgtagcgcgggctagaagggcgggaaacttgagaaccacgggcgcgggagcctggcggggacgcaagcccggaactggcggaggggtgggcaggcgcatgcgcgcgcgcagctgaaacgccggctgatgaaactgacaaaggcgagagcgcgcagcagcccacagcagccgagttcgcgccgccggtaggtgctgccatgccagggggcgggatcgtggagcgcctcgcagaaccgcacgaaagcaaaaacaaagccatctctccggagcagaaatagaacagacgtggccggggaaagccaaatatttgtgagatgatgtgaacaaagggggaaaagtcaatccagggaagtttgagtttctggttggaggcttcagcggctctgatcgctggatactttaagagaacatcctttgcccccgctctccctctctccccgaagaaaaataaatccttggcaaaatgagacttgacggcatgaaaagaaggtctccagactgtcccagctggcgcgggcggggccggggccgaggtgccgcttggtgacactgcagccgcggctcagcactgtcacccagaaaggcccgccgacgtctgtatgcagggaacgtggctcttagcagagcctggacaggcgcagggccaaggaagtctttgtttttgtttctttctctagcccttcctgccaatacatcagggatataactccttggtgtttctgccttacaatcgctccttataccccacccagatcctcagcactgcagctcccactgccactgcccgctgtgagtcacctccccctctcccttttttaaaccaaacggcaaggccatattgcagttatccataaatggaaaagcaagaagccaccaatacctgtttgagaagatggcattttaattagcacactccggctgccataaacccgggctcctgccccacccctcctcccccctcccccgccgtgccctctctcaacctccccgctcacccccatctatgtaaaaaagccataaagcctctctccaatcgctttctcggagggagtttttgcaacccccacaacacaggttgattggaaaggtctctctcccggataacaacaattcaatgtgccttgacattttaatagcctgccgtcctggtgaacacaatcgagcaaggcagtgaagcaaacatcattaggtggctggactcagacacatcacgctccagtttgggttccaaggtgcttctctctggattttcacctgccttgccaaaaatgattgattacgctgggccaactgggtgtccggcaatacccaacaaatgactttggcccctaacagcaggtcttggccagacagaaatcaatatttcaccattaaaatctatcaaagaagagttaaggcaccatctgtccctgccgcctctctatggtgtgtgaacattaaatccgacacttgtactacatgggtaatcaatatatagtggttcacagatcatttgtggttcccttttagcagtgatggatgtctggaatcgttgtgattcattttgtcagaccattaaacaagattctgtccagtt
